United States Patent 10,662,479 (IMMUNOGLOBULIN EXPRESSION LEVELS AS BIOMARKER FOR PROTEASOME INHIBITOR RESPONSE) - sequence listing, part 12

SEQ ID NO: 758 - DNA, 382463 bp, Homo sapiens
gcccccggaaacggaagtcaggctacgagtcacggtggctccgcgctggcggcgggttcccccacaaggtcttggggaaaggagcatgcgctggaagctgtgtgctgttggttttgaggatcttcagtaagctgaaagcggagagtcaggggccttgtgtcctaccatggtatttgctaacgtttagagagtgcttccccttgccgagcactgggtaagcgcttcacatgcgtcatctcatttggaacaagtctcttttgttctagcacctatgaagtggcagagactgatttctgttttaaagctggagacaccgagtctctccagcttatttaaatatctttctcaaaatgtcatgccactagttcctgatttctgtattgccatcactattttagcactgtttacttcatatttttctttagtttaaaaaaaatagaaatagtggggctcactatgttgcctaagctggtctcgaacatctgggttcaagtgattcttctgtctagccctcctaaagtgctgggattacaggcatgagccactgtgcccaatcagatgaactttatttctcataaagggttgaacctggccgggcacagtggctcatgcctgtaatcccagcactttgggaggctgaggcgggtggatcacttgaggtcaggagtttgaggccaggctggccaacatggtgaaactccatctctactaaaaatacaaaagttagctggatgtggtggcctgcacctgtagtcctagctacttgggaagatgaagcagaagagttgcttacccaggaggcagaggttgcagagagccaagattgtgccactgcactccagtctgggagcaagacatcatctcaaaaaaaaaaaaaaaaaaaaaaaaaaagagttgaacctgcatggtagccattttgacagactgggaagcctagcttccagtcagaagccaaaaacaggcacttccagggttggaagaataagacagggatttatgctaaacacagtggccaaatatacatgttaaataaactgtaagaggggtcacgaatatttatgaaaggagcaatttgtgcatgtgcagttgagcttcatgcctctctgtggatcccatgtttaaaaaatggtggccttagcatgatccaagggtagagttttctaccgcttgacttcaaaaggtgaagcaggggatgtgaaaaccctcactgcacgtcctctgtcgactggccagaaccactccctggatggtgggtgatctcttatcaggaaggaatgctagtcggttgttctattgaaactgcaaatgggagggtcagcatcaggctggtggagtgagtctttcaaaagggctggtttctgtttaacccttaggaaagaaaatctaatggcgattatagagggaggggttataaagaggtgtgtccgacttcccatcctgtcatgagtaggaactcagcttccaagttttttctagggtctccttggccaagagagggcctgttcagtcagttggggggcatagaattttatttttatttttcagttgacaaaagttaacttattgtgaaaggaacccaacaacaaaaagataaaccgaatttaaaacaaaacaaaaccaaaaagaacacaatttataaatgtgcaaaggggctgggagtggtggttcatgcctgtagtcccagcgctttgggaggctgaggtgagtggctcgcttgagctcagagtttgagactagctctggcaacatggcaaaactctgtcgctacaaaaaaatgacaaaaattagctaggcatggtgacactcacctgtagtcccagctactcgggaggctgagacaggagaatagcttgagctggggaggttgaggctgtaatgagttatgatcacatcactgcacttcagcccaggtgacagagtgagaccttgtctcaaaaataaaatgaaaaatatgtaaagggcttgaatagatatttctccaaaagatggacaaatggccaataagcacatgaaaagatgctgaacatcattagtcattagggaattgcaaattaatcacaatgggatactcatcaaaatgactaaaagtaaaaaacaaaaaatcaacagttccaagttctaatgagtatgtggggcaatggagcacttatacattgctgatgaaaatacaaaatgatatatgccctggtatgttttagctctgtgactccacctaaatttcatcttgaagtatactcccataattcccatatattgtgggagggacccagtgggagatgattgaatcatgggggtgattccctgcatactgttcttgtggtagtgaataagtctcacaagatctgatggtttgataagaggtttccacttccgcttctcccattctctttcttgctgccgccatgtaagaagtgcctttcaccttccaccatgattgtgaggcctccgtagccacatggaactgtaaatccattaaacctctttcttttgcaaattgcccagtcttgggtatgtctctatcagcagtgtgaaaatggactaatacacgtccattggaaaacaatttagcctttcgtcaaaaaattaaacatagaacacattactcaccaattccactacagatgctttctgacttaggatggtttgacttacaattttttgactttacaatgggctgatgggttataatgcatttttaacttacactattttctgcgtatggtgggtttattgggatataatcccattgtaagtcaaggaacatctgtaatagctttatacccaagaagactgaaaacaagtgttcaaacaaaaacttgtacacaaactgggcatgctggctcatgcctgtaattctagcaatttgggaggcagaggcgggaagattgcttgagcccaagagtttgagaccagcctggacaacatagggagacctgtctctacaaaaaatttagaaagtagctgggtgtggtggcactcatctgtggtaccagacactgaagaggctgacatgggaggattgcttgggcccaggagttcgagtctgtagtgaactatgattgcaccactgtactccagcctgggcaacagagagcgttcccatctctaaacaacaaaaacaacaacttgtacacaaatgtgcctagcggccttattgatttagtcaaaaagtagaaacaacccaaatgttcatcagctaatgaatagacaaacaagtgtgttatatctatagagtagaatattatttggtcataaaaaggaatggaatactgtgatatgatacattggttttcatccacagttcctagctcataactttcctagcccattttgcagtaaacagaatctctttctctgaccttctcttgccctcctttcacctgcctacttggcaagactctaatctgattgtggtcgtaaggcatctattccagagagggccctaccccatatcctggaggaaggaatgctgcacagagaggccaagaggcatctgaatagacagaccttgctgggtttagagcatgtatttttttgtccaatcactttttgatatggttgtccatgcctcaatcatgagcatggttgtccatgcttcaatcatgagcaaccaatgaagtcttcatgaaaggtcagagggagtgcagggaattttatcccaaaatatggctccctggtataatgaggattttgagttaaaaactcttaggtatcaagttggaagagactttttccctatctacataaagatagtatggaccctccaaggagaacagttgctcccctccttgtctcattatccattacaggaaagaagaccaagaatgtacctgaacggacccttttataagatcatgactgtccctgaggatcatttaagttccaaagagaactattaatgaattaatttctgttccccatccaatcattctccctagtaaccatttattgcccctaaatagaatttatatccccccaccataatctgttttgccaggatccaagtccgtgttctttctgtaacctcaagatggtgttaagcttctgaaccccattgggatattgggcaatcactctgtgattctccctgtgtacatggtttaataaatttgtatacctcttcttttattaatctgccttcttgtgagtagatttttcagtaaaccttcagagggccaagggccctctgatgggtgtcctttcccctatcccttgccctatgcatctcttcatctgtatcctttgtaatatcttttgtaataaaccagaaaatatgtgttacactgggttctgtgagccgctccagcaaatcaattgaacccaaagagggggtcatggaaaccccaacttaaagcctgttggtcagaagttctggagacccaaacttgcaactgatatctgaggtggggatagtcttggagactgaacccttaacctgtaggatctgacattatgtctaggtagatagtgttgaaattgagttggagaacacacagctggtgtccgctgcagaactgattgcttgcctgctggctgatgaggagaaatccccacatattttggggtcccagaagtcttgactgtttttgtgttggtgtgagagcagaggagaagcatggtttgagagtttttccaaagtacagatatattctacaatatggatggacttttgaaacactatgctgagatgccagacacaaaagaccatgtgttatacaggcatacatgattttattcatatgaaatattcaaaataggtaaatatatagagacagaaagcaggttaatggttgcttagggctgggggaagtagggggttggcaggtgatagctaaagggggtagagtttcttatggaagtgatgagaatgttctggaattaggtagtaaagatggtcacacattgttatgaatatactaagaaacactgaattttacagtttaaaatatttcagagtttgagaccagcctggccaacatggtgaaagcccgtctctactaaaaatacaaaaactagctgggtgtggtggcgtgcatctctaatcccagctactcgagtggctgaggcaggagaatcatttgaacctgggaagcagaggttgcaatgagccgggattgtgccactgcattccagtctgggagacagagtgagactccatctcaaaaaagaaaaaaaaaaaaatttcaaatggggaattttgtgttatgtgaacttttataaaggaaaaaggaaactttggtcatatgggtaactcatcatttccctcctagacttatattgggagacttaaatgtgattaacacattaccaggcaaataatgaaaataaatagtatccttaagaataaatacaatgaaaacaaagcaaagttattaaattctggtcagacactgttccttgcaaaggctcttaggctctaatgtaaggcccattttatactctttttttttttttttcttttacatactccccagaagagtaacattctctattccttaaggataaattatcaagccaggtatggtggtgtgtgcctgtaatctcagctaattgggaggcagaagtgggaggatcacttgagcctaggagtttaagaccatcagatgcatgctacaatatggatggacttttgaaatattatgctaagatgccagacacgaaagaccacatgtctttcgttgttgagaaatacctacatgaaatacctacatgatttcatttacatgaaatacccagaataggcaaatatatagagacagaaagcatagtgagatcccattatcaattaaaaaaaatgtatatatattttgagatgaggtctcactctgttgcccaggctggagtgcagtggtgcgatctcagctcactgcagcctctggctcccaggctcaagcgactctcccacctcagcctctggctcacaccaccatgcttggctaatttttgtacttttagtagagatggggttttgccatgttgcccaggctggtcttgaactcctgagctcaagtgatctgcctgccttggccttgcaaagtgctggaattacaggcatgagccaccacacccaccccccaaaataaaataatataaaaaaatacaaattacaaatattagagacaaactagcaataatgagattttcttgacataatgagagagattaagtcatcaaaagaaaatattctcttgacctgatttggtgttatttaatgcctatctttgtactatctaaaatcatgtcccaggctgggcacagtggctcatggctgtaatcccagcactttaggaggccgaggcaggtgggttgcttgagctcaggagtttgagaccaacctgggcaacatggcaaaacctcatctctacaaaaaatacaaaaattggctgagcgtggtggctcacgcctgtaatcctagcactgtgggaggctgaggcgggcggatcacgaggtcaggagatcgagaccatcctggctaacacggtgaaaccccatctctactaaaaatacaaaaaaattagccggatgtggtggcgggcgcctgtagtcccagctacgcaggaggctgaggcaggaggatggcatgaacccgggaggcagcactttcagtgagcccagtttgcgccactgcactccagcctgggcgatagagcgggactctgtctcaaaaaaaaaaaaaaaaaaaaaaaaaaaaaaaattagctggccatgatagtgcatacctgtggtcccagctacttaggagggtgaggtgggaggattgcttgagcctgggaggtggaggttgcagtgagccaagatcgtgccatggtattccagcctgggtgacagtgagatcctgtctcaaaaaaaaaaaaaaaaaaagaaaaaaaagtcccataaacaggtctcacggttcaggaaatatctctctatcccatgttgttcaccggtagtatgttactgtggtttgaatgtgtgccaccaaagttcatgtgtttgaaacttaagccccattggaacagtgttgagaagtgggatctttaagctgtgattagatcatgagggctctacctagatgaatgaattaatgctgttatcatggaagtaggttaattattgcaggagtggattccagataaaaggatgagttttgctcccttctccctctcatgtgtgttctctttcccttctgccttctgccgtggggtgacatagcaagaaggccctcaccagatgccagcaccttgacattggactttccagcctccagaaatgtgagaaataaatgtctttactttataaattacttgtgttctaatggaagaaacagataatacagaaaatatatacatcacatttctgtggtaataagcattagggagaaaaattaagcaaggtggttggtggacggtgctggagaggtggaggaatatgtctattgtatgtcaggtggtcaggtaaagcctctttgataaggtgacaaagtagaccctgaatgaaacaacagagcaagctatttagatagccaggaggggagcatcccaggcagaaggcctcagcatattcagcagggcctaggaatagccaggtggccagtgaggctgcagaggagtgagcaggatagaggtggaagagagatgggatggatacatcgtagaagtcagtgtctcacaaattatcaccgtgcctgaccaaaacaaacgaacaaacagacaatcactctggctgctgcctggacaatgttagggagcaggaatggaagcagttactaggtgatttcattggtccaagtgagagatgatgatatctcaaactaggatattaggggtgggtgtggtgagaactgtcaaattctggggtgttttgaaggatgggctgtcattgctggtgttttagatttgggtttgaaaagaaaggagaggaagtttgagggtcagacttagcagatttgctggtttagagtaaccatgtcctgctgacagatgcatggccaagaacgaggctaaactgtcacaaagtaagtacaagtgggcacatatgctctttatggttctggtttattacaaagaaaaatggtatgttcgtttatatcagaaagaaccagatgacctccttggaaaatattgactaaaatggatcttgctagaaaatgccagtttgagacaggtaacattacatgtagaaattgaagccactcatttctttctaactggaagtagtggttatattaaactaaagagtaaacaagcatatgattaagtgtgatgattcatatcagatatagtgacacaaatgaggaggagctcagtggtgcttgttcccacaaacctggatatcttttttaccttaatgtcttcctatccttgcctattcttttttttttttttttttttgagatggagtctcgctctgtcaccccggctggagtgcagtggcgcaatctcggctcactgcaagctccgcctcccgggttcacaccattcttctgcctcagcctcctcagtagctgggagtacaggcgcctgccaccatgtccggctaattttttttgtgttttttagtagagaccgggtttcaccgtgttagccaggatggtttcgatctcctaacctcgtgatccacccgcctcggcctcccaaagtgctgggattacaggcatgagccaccgcgcccggcctccttgcctattcttaaagtaaaacaaggtcctgggtagaaagtcagatagcacagccactcccttgcccaccttcttcctctcctgcagagagaggcaaggactgttagccacttctgcttttcgtttctatggtgattaccttcatggctctaaaagacacgtttgtagtgccatttcttgctttttcaatttttgctattatctgcggactttgttatggtacttgaagtttagcctattaacattaccaccatcctgtcgcccccttccttcttctgccattatagctacaacccaatgtagtttgttcctctacattaaatttaccttttaagtgtaagggatatattagtattaaacatcttcttgttctgtcagttatgcacagcatctcttgatcccccgcactgtgagacaagggtttcattggcactcctggcctttacctctcctcccttccttgtactccccaatctattttgttaaaagaagatcccacttggccagttggattcctgtggggatgtaattgaaagaaggatgcccctacacctgcttttcattcagtacactactgaaattccatctcccccaagaaaaccttttgggacctcattgagagataagagatgtatctattaatataatcttattaatgaaataatagcctaggagtccatgaacctttaacccgaaggacctttgtcctgtcaggtgttaacaactagagggaaatacaatcagctttggctgtgctctaagcaagcagaggcttatttacttttcccgtgccctttcaagccaagggctataaaaccgctttagtaacataacccctgtgagagcttgttggtggacttagtgccatcacagtaaattttcaagagaatgtatatgaaatttattcttctccttgaatttcatgttgataagtaagttgatttaaaagcagctcattcgtttggaaaggaactgtatccttataactgagattactggaagaaggtcatgagctggggaatgcagcacccctgccacctagtggttcctcctgctgaaacactgcttttgcaaagcacagaaaacacaaattgagttagtataggagtcaaatacagcgaatgtcctgaatctgggaaacttccattctctcctccctgtgtgatatcagaggaacgaaaagagcactgacaagggagaatgttgtaggtaaacatggatagccatcaggtctcctgcacaaaggggcagctgcaggaagcaggaagtgcaacaaatgagcaaagaaagggacaggatccctcagcagtggtcactgcagcagcaacacggtgccaaaggcaaagcagaatcaccagcaagatcagcagggacaatgatgataaagccacataggctcagcatcaacaacagccctagagactgtggccttgggactgtagtactgcttgattcatggtaaaccaatcaggacactcagggaacaacaacagaaatcagcatttacagagcacatactcagttgaggcagagttttacctgtatatcacataatagtctatgggggtagatattcttattagccgtgttatacaggtgatgaaattgaggctaactaactggcctaaagtcacagagttgatgagacttagagccaagattcaaacgcacaccaaggtggcctgaccccagctgcagagctcttaactacagacatgcattgctaaaagaaggggatatgatccgagaaatgtgctgttaggtgattttgtcattgtgtgaacccatagccagctacacactgttaacaaaagaccatgaggccaggcatggtggctcacgccagtaatcccagcactttgggaggccgaggtgggtggatcacctgaggtcaggagtttgagaccagcctggtcaacatggtgaaaccctatctctactaataatacaaaaattagccaggcgtagtgatgcgtgcctgtaatcccagcaactcaggaggctgaggcaggagaatcacttgaagctgggaggtggaggcagcagtgagctgagatcgtgccactgtgcttcagcctgggtgacagagtgagactccatctcaaaaaaaaaaaaaaaaaaaatgtccataacatctgtggaggaaaaggggagagttttattttctgtaaaaaacaatctgcagattggggaaatgcagcttcaggtgtaaaacagaagtgggctctaagcagggtggaaagttagagattataaaggcaaaaactgcaggacaggggagggtaatcaggggagtcagaaacagagtgtcgattagatggccttaaagccccaaatcaccagtctctcttaattggctggttccaggttgtctgttggcaggaggtggtcttgtggtggtcaactggggaattcccagctgccgttgtttccaggaactcttctttgacttggttgcagaaaaacaggttttgcagcattctctaaggacacgaagagcttgactgctccctcacccttccatggccccttgggtctgtttttacttttgagccacagagaatccattttgtctgttaactgggggtataatttgacaacacctaggctgtttgatacagcctgttgctcctaggctacaaacctgacagtatgttactgtattggatactgtaggcaattgtaacacaatggtaagtatatgtgtatctaaacataaaaaaggtacaggaaaaatagagtattataatcttatgggaccacttttgtatatgcggtccatgcattcactaaaactttgttacgcagcacatgactgttccaggctcttcttcttccctcagggaggagggaatatggggttcaatccctctaactctactgaccttattgagggatgcttgtgaattgggatcccttattgaaggatgcttgtgaattggaactctaacgcgattaagattggtcctagatcttccaccaacttgcaaaaggatatttagcctttcaggaacattttctttgactggaaaatagggatacaatggtgactatctcataaattgctgggaagtttcactgagataaggtaaaatttctggcacatggcaaatgaagtagattgcctacaaaggtttttcaacaattcttctcatggttataagtaccactattgctttctagaaaaggtggtatctcggctgggtttatgatttactttgaccccctagaatgtggcagatgtgtcactggctaattccaagtctaggttgcaagagcctccttttttcctctcttggactgctcttgcctctatgtaaagaagcccagcctgaactcttgcatgttgaaagaccacatgaaaaaagaggcatgagggagccagcatcctagcagagcccaccatctgactacagtcacatgagcaagcctaggtgagcccagaactcacctgccaacccccgggatgacaagaaataataaatcactgtggtaaactactaagttttggggtagtttgttatgtagcaaataataagttctcagttaatggtatctattaatattatggttggtgctggtgagaaattcagccagctagctggctcatcattaggccactgattttttttccctttcaccagagtagctggaagaaagaagagttacatgtgcaagtgaacactgcttattacagatgtgtctgatctctttattaaaacagaaagactattcagaaagtctattcagaaagactttgttagcacctcaaattaccatctacatttgaaataatgtggaagcatatttcttcaaacatagttacaactcagacttttcactaaacccattgtactgggaccctcctagccatcatgttgaagagtctgaggcatggacagggacttatccatttcatccagcatctcaaagccctgaagatgatgctttactctaaccttcttctcctttgcattcccctccctaaattatctttttctgtccatacatatcctttccctctctccttgcctttcctatctcttttctttgttgtgatgattaaataagaccttccctactgaaatgtaagctccaagaaggagattttcatctgttttgttctctacaaaaatattctttgcttagaaaagtgcctggcacacacaaggtgtgcagtgaatatgtgttgactgaattaaattgtgcacgtaaagcacttaggacagtgtctgacatagagtagatggcactcaataaatataacctatggcaactcaggactataataaatgaaattattcacatttgtctttttttttttacagatcactcctttattgtacagatcaggaaaaaggatttagtactgctatgctcaaatgaacactgggcccatgtgtcagggccaagcaactagaacatgattcagaaatcagtcagagagagacacacttggacaagaccaagaggcatttcattgtcacgaaacaaggtgggggagggattccaaaacacacagcaggaagtacttctaaccctcagaggtcaaggagcttattccatgttggtatgaggaatggcttattttctgatgaccacatgtgggactatttcaactgccacgagaaatcccagaaggattattgttttgtattatttatatatactatacctttttaaaaaaataaaataaatgtaacacataaactaaattcaggattgatcccaaccttctggagccagcttctctggggtcagggaagaaacagttgtcatatcaccatagaggttatattcatcttccactggaatgaatagagcccccaggcagtggcttaacaggctgtcttgcttcattggtcatggcttggcatggttcctccccacaaatccttagtaaacaaagcacttgtgaaaacccaggtcactacctttaaactctgttggacaagaggagctttccacagcttgggctgagaagccttgccctagaagtgctgttctgactagattgtatgaagggagtgggtgcaggagacaaaatggctaaaatgaaaatgggagccactggtgcccatctgcagctacagctcaagatgcctacagatgtggtcagtgtgacatgtgcaggagggaggggcagggggacgcgatgggcagggagggtgctcctggggacagtagcctgcccgctggcctttacttcttggccttaccctgggcagccacagcttccatggctttacgcatggtctcttcatcccccaggaactgtatgggtttcaagttcttgtccaattcatagacaacgggaataccagtgggcaggttcagctccatgatagcctcttcagagaggccctccagatgcttgacaatgcccggggggctgttgccatgggctgcaattagtacctgcttcccctccttgatctggggaactatttcttcattccaaaagggcagagccttggcaatagtgtccttcagactctcacaggagggtagctgatcttcagtgaggtttgcaaacctgcgatccttactgatgttgtagaaaggatggtcgggctccattagaggtggtgggacatcataggagtgcctccagatcttcacctgggcctcaccatgctttgcagcagtttctgctttattgagaccgatcagacccccagagtgctgctcattgaggcaccaatcctcactactggcagccacgtctgatcaatggcatctagcactgtccagagggtctggatcactctcttctgcactgaggtgaagcagatgtcaaactcagccggcttctcacagcacctgcctgccacacttcgcctccttatggcccgctgggctcaggtcggtgttgtaccagctgctgaagcggttctccggattccacatgctctcgccatgctggatcaacaccaatttgtaggcagccatggtggcgggctggggatgcgacgctgactggggttcgcggattctggaggcacatttgtctttttaaatgtttgattacttttagtctttctcccttttctttccactcttcttttcactctttgtctctttcttgttttctctcttccttagtcattgcatattctctgctacccttactgtggtctgccagggactctcatagatgtcatttcacctaccacagagaatgtgcagagaaaaggttttggagctttgtcttggatgaaatgtaactatttgtgattcatagctgacttagtactgcacataaaattctactgttgcggtgaacccaattttggtgctactgaataatgaggagcctagatgattgaaaatggcaagctcattaggttgtagcctaacaaatgcctggcagtacatgtctgtgagtgtgtgggtgtttctagtgcctgttggtgagtaaccatgctactcttggcagtagaaatgtgagcaaaatcaagttgtactgatttagccaattttctcttctcttcctccatacgggaatggaaatgtattactcagtagatcagttctttctcaggctggtaacattacagaatccctgtcgaagtgcaagttgggctggtggaaatcagatttccacatccttttgtaagctttgtttgtcaaggtaaatcccatacattttaaaagcatgacttcctagggctagatgggaaaataagaagctttgaacctgtcaccagaatcaattgtacagatgtctccatttccttggatagtaacttatataggaagatctgtctcctcttttctgctagtctttcatattctaataaagagtatgaatctgcaggtcagtggctgagtagcttgggccgagcacagagcagtgttaatgtagttctcaacacagccttgtttatgcttagattaggctcatcggtagctcagacctcgtagccctgctgatatttaacagagtcctgcatatattcttctgtaatgtaagatcagtgtttgaaaaactgaaagttgccctgtctctacaaattaaaaaaaattatcatttaaaaaattatacatagatgtatgcctactcaccagccaggcatggtggtgcatgcctgtggtcccagcaactttggaggctgaatctctcgcctaaatccgaaagattgaggttgcagtgagccatgatcacgccactgcactcctgcctgggcagcagagcaataccctgtctcaaaaacaaagaaacaaaaaaagcaacagagttgggaggggagtgagtctttgagcctccctgtcatctttcctcaaaattgcttttagttggctgggcacggtggctcatgcctataatcccagcactttgggagggcgaggtgggcggatcacctgaggtaaggagttcgagactagcctgggcggatcacctgaggtaaggagttcgagactagcctggccaacatggtaaaaccccatctctactaaaaatacaaaaactagccaggtgtggtggcaggcgcctgtaatcccagctacttgggaggctgaggcaggagaattgcttgaacccaggaggcagaggttgcagtgagccaggatcgcgccattgcacttcagcctcaggggagaagagtgagactttgtctcaaaaaaaaaaaaaaaaaagaaaaaattgcttttagttgctctattcttgttcctcccttgaaacatctgatcatcttatagtcagtaacttaccagctctccttaggagttagccaatgtagtaaatctaggaaacaaacctagactcagggtggggagatttggaggcatctagaccatcagttcttgaacatgctcacttaattgggtcaaaagaccccaagatatacctaccctaaattcatttcacttctggtggggagtaatttggtgaaattaaaaatgaaagaggaacaaaataacaaccaaaaatggcaacatcatagcatgtttaatgaacaaaatgattaaaaatagaaaaacaagtctggcatgctggcaagtgcctatagtcctagctacttgggaggctgagatggcggaacacttgagcccaggagttcaaggtgcagtgagctatgatttcaccactgcactccagcctgggtgacagagcaagacccaatctctaaaaaatataaaaaataaaaaaatttaaagatagaaaaacaacattacactttaacatactaaaaaaaaaaatccttgaaaattgtggaaactccagcaacctgtgttttcacatgtgcagtaagaaatttgcatcattgccaaactttctgtgaagagcaaagttttcaatacttggcactactgcacgttttttgtgaatataaaattttaattacagttaataatgaacaaaggaagctattaaggacttaagtcatatgtaaaaatgaaagtccttgggctggcatttgctgtaagaattaaagaacttggatttaaaaatctcttcttggttcatccagaagactaatgggccatactgtgcttggaggcactatggcctagattactatgacagtcttgtttctgggccttctctgctcttctgttctctctctctttcttttttcttttctttttttttttttttttttgagttggagtcttgctctgtcacccaggctggagtgcagtggtgcaatgttggcttactgcaacctccatctcccgtgttcaagtgattctcctgcctcagcctcccaggtagctgggattacaggtgcctgccaccatgcccggctaatttttttgcatttttagtagagacggggtttcaccatgttggctatggctggttttaaactcctggcctcaagtgatccaccttcctcggcctcccaaagtgctaggattacaagcgttagccaccgcacctggcctcttttttcttttttttttgagatggggtcttgctctgttacccaggctggagtgcagtggtgtgtttatggctcactgtagccttcacttcctggtgggctcaagcaataccctcacctcagcctccagagtagctgggactaccacccctggctgtttatttttatttttgcagggacaggtgtctccctgttttgtccaggctggtctcaaactcctggcctcaggcaattttcctgcctgggcctcccgaattgctgagattacatgtgtgagccatcatgcctggcctgcttttctgttcttgaacctgcaacagttctcccagtctttgagtcacaatctggcttgtacattaaaatgatcattctactggtagaagtattggataagacctttctgggagagtatttggcaacaggtttagagtcttaaatatgtagcctccttggctttttttttttgagacggagtctcgctctgtcaccaggctggagtgcagtggtgcaatctcagctcactgcaacctctgtctcccaggttcaagtgattctcctgcctcagcctcctgagtagctgggactacaggcgcacgccaccacacccagctaatttttgtatttttagtagagacagggtttttcaccatgttggccaggatggtcttgatttcctgacctcgtgatccacccgcctaggcctcccaaagtgctgggattacaggcatgagccaccacgcttggccaatatttttttaatattaggaaatatagaaaggtagtagggggttggttaaacaaatgatgctatttccattggataaaatctcctgttttctttctttctttttttttgttttttgtttttgagacggagtctgactttgtcacctaggctggagtgcagtggtgtgatctcggctcactgcaacctccgcctcccggctccaagcaattctcctgcctcagtcttctgagtaactggggattataggtgcctgccgtcacacctggctaatttttgtattgtttttatttttggttttttttgagacggagtctctgttgcccaggctagagtccggtggcacgatctcagctcattgcaacctctgcctcccaggttcaagcgattctcctgcctcagcctcctgaatagctggaattacaggcacccaccacaatgcccagctaatttttgtatttttagtagagacggattttcaccatgttggccaggctgatctccaacttctgacctcaggtgatccgcccgcctcggcctcccaaagttctgggattacaggcgtgagccaccgtgcccagccaatttttgtatttttagtagagatcggctttcaccacgttggccaggctggtctccaactcctgacctcaggtgatctgcccgtcttggcctcccaaagtgctgggattacaggtgtgagacaccgtgcccacgctattttcattataaaaatgataatgagtgttactgatacagaaaaattgttcccaagactaatttttaattataatttttaaaagtagggcaggctgtgtgtggtggctcatgcctgtaatcctagaactttaggcagattagaagttcgaggccagcctgggcaacatggcaaaaccctgtccctacaaaaaatacaaaaattagctgggcatgatactgtgcgctgtagtcctgctcctcgggatgctgaggtcggaggatagcttgagactgggaggtcaaggctgcagtgagccattattgtgtgtctgcactctagcctgggtgacagagaaagaccctgtctcaaaaaatttaaaagtagagcatataagagtatgcataatataatctttttaatataaagatgtatgcctattcatagaaaatggctagaagtatatataatacaatgctactagtaattgtgtttttgtactattaaggatttttctgaaatgtctacaataaacatatatgacttctataaaaaagaaaaaagtatttacaaatacttgaaacaaaagattactttggcagcatttatgagaatgtgaatgagagagactggatgagagattgttgtagtagttcgggaaaaaggcaatgtaagtaagaaccaaggtcatggtgtggatggagaaggaaaagctgatttaagacatattcaacagccctacgaggactataaacacataccacaccttcaagtcaataataaaattggtctttcaaagagccagcatgattcttccatatccttaaagtatcttcaaatacgcatttgaagaaacttggggttttggctttccagcttgtttagctacgttaatggacatacagttgagcaaaaaggagaatatgagaggaggatcagactgtggaagaagacaataaatttaattttgcatgtgtgcagtttgaagggcttgtgggagatgtactaagagctgagcaggggatgccaggggacaaggagtccagtgagaagatcgaagaggcatggtgggcccggacagcccagaatgggctagtctgggttgaaagcctggcaagaatgaccagttggacaagttcgaggttgctttcatttcagctttctgtgaaacctgcaagtaatcagaacaggcacaggaaatgagaataataaaagcgaatgagtacactctggaggttcttctgcctcctcatggagttgtaaccaaagttcaagggtgagtgaagccattctcaaatctgatcttcaattcactgtttttcaggtagggaaagccctcaagagtctaagtaaaggcactgaaggccactttattccttgctgtgccataggcacatgttgatgtgttttcttttcttactacctcttcactggcatcaggcccacccatggtataacaagatggtcagagagaccagaggaagaagtcaaaggaagagagaatatcagggaagaaattgtcaacaatggcagctgccagagaagtcaagaaatataagtactgaaaagttccggtgacacttggcaaggtgcaggctatttgcagccatgtatgtagagtaccaccaagctcagattcccgtgaaagtcattttgattctcatgaaatacaatcaaaatgattttttgctttcctttttttttttttgagatggagtcttgatttgtctcccaggctggagtacagtggcgcaatctcagctcactgcaacctctgcctcccgggttcaagcgattcttctgcctcagcctcccgattagctgggactataggcatgcgccaccacgcccaggtaatttttgtatttttagtagagatggggttttgccatgttggccagactcgtctccaactcctggcctcaggtgattcgcctgcctcggcttcccgaagtgctgggattacaggtgtgagccatcacccccggcctgatttttagctttcctatttgacttttaattgaaacttcggcaaaagttactgttgttagcaaagtgttagtaaagcctgtatctagattctcaagcagtttgggataagatgattctatgagtcagtgatctgtagggtgttaggagaacgccggtagcacaaatgtctcttggccttaccgactggtgaagacaaatgtgacatttacagccatacttcaatccatgtctaccagaaagcctagtcagtctagaaatcagtggcccaggcccggtgcggtggctcacacctgtaatctcaacactttgggaggccgaggtgggtggattgcttgaggtcaggagttcaagaccagcctggccaacatggtgaagccccatctctataacgcaaacaaacaaacaaacaaatgtagcaatcagtggcccaagtagttgaccaagttgtctgccagcctcctttgggtgctgacctgcaccctgctcaggtagggaccacagcacagcctgtgttgctgctgacctcttctcccaacactttccccccagaatactgatctccagtattcttccacagctgtaagcagctgggaaatattttccttctcctgggtatttatttcaggggaggctcctatagctgagctcttgagccctagggacacattcttttcttcgtgctttaagcatctctttcccagagcaaaggagcacttgagtgtggagggtagggaagaaaatcctactggactgggggataatcaggcaactgttctaggaaccttcagtgtccacatcgtgctgctctctctagcccactgctatggactgaattgtgttcctctcccctcctcaaattaatatgccgaagccctaacctgctatgtgactctatctggagcgagggtgtttaggaagtaattagggttatatgaggtattaagagtggtgtcctaatcacataggactctggctttataagaagaggaagattcccattctctctttctgtctcaatctgttatgtgaggacactttctgcgagacaggaagaaggccctcaccaaaacccagccatactggctccttgatcttggacttccagcctctagaattgtgagaaaataaatttctgttgcttaaattacttagtctatggcatttcgttatagcagcccaggatgccagactccttcattcacggtgattttcttttagtggccccattgtctcttctaatagtctagccttttcttagagcaactcccagtccgtcatacagggttgtatatctcaattgtgggcagagtccaacatctcttccacagggctcttgtacacatcaagaaatggggctgggtactcattttattgtttctagatcttcccagcaagtaaaaaaactactggatgttggttttcccagagcatatgatggacttctgggatgactcaggtctatcagggtcatctctgactcatggaatcctgttacccttctatggctggacaagagaaacacattaaaggagggcatgtgagtctctagcacaattataattactggggtttataaagccaggtgaatgtcagagttaataatgcttagactcttctggaaggggtgaggcagctccattctagtagtctattggagaagcttcatttggggccttaaaccaaagtaatacaaatctttttacatctgtcactgtttattatttagttttccatctggcctgctctgaagcaggagggggaagagagcacagagggaaatcatgagctctttggaggaatagtgccagatattaaatctataaacaaaatagattgaactggaaagaatgagtcagagacaaaggaagcagtagaagcagtgaatatcaccttgggaaatatcacctgaaagtgctggcagaatctttctggtgtatttgtgatcgtccctgtggtagatacctttaaatccaatcagcacaatttggtgcctgaactgcttgtgcttcactcctctctgttggggtcccttttcattgtttcctcctgtctagccctatattcatttctataatgcaagctgatgacccatggtgagatttttctttcctctggtgataatgatcctgtcactccaggttcctgtttcagcagagcatgaagagagttatgctgattgattgagaccaagctggagtgaaataaggattttacctgagggtccattagccttcctgcatcatgccccagagagtactgaaaactgggagttatccaagtgccttgccttcttggggttagcttgtatagaggttgcaaactggcagcccctaggttaggtgtattttatttggcccacccagggtttgaaattagttgtcaacatttaaatatagggatatttcctgcttctctttaaagactgggagaacacttaatctgcatccccttctggaaacaatcagccgatgctgactgggtctctaccctttaatgaagtcgtgagctctccatatcacattgccacagtcacatatcacattgccactgctgcacatgtttatgttggccaccataggcacttgagtttgtgtcctctgatctataggaaagaaaggaactagtgtttattgagtcccttttatgcatgaaccactgtaccttgtaatttgcatacatcatttgatttttttaaaaacccagtaagatttaagctccctgcctttagggaccatgcctgcttcttttgccactgtgagagtgctcaagacttggtatagtcgtaagtgggagctgaacagtatttgctgaatgaaggtatgtatgaatgcataaacaaatgaataaggtattttttatcacatttttgtaggtgagaaaaccaaggcccagggcagttaagtaaccggttcagaatcataatcatatggcccatagggctgacaggattcaaatatgggactgtgcaactccagaggtccagtgtggagaagggaaaagaccatgggtcatttcagggctaagtacacgaagactctttgtaagtccctgcagaattgattgacagtgcacaaacatattttcgtaagtactagcttccagaagaatgcacgttttttagcttatgaaatttgtctaaaacctactgtgtatggataccttcagctttgggattgtataatattgaggctctgcagtagagggtacgtgccattggtttggcatgtaatgagagcagaatatttctgtctacagttgacttgtgttctgtaaatgtggtaacattccaaagttaattttccttgtatatctaaggaactccttccagggcttattttcgttaacttcttgctgatggtgcatggttaacactattcagtgcagagctgcattcaggaatgactataattaaaagtgcttctttgtgaggcttatcaagaagacctgaggctgattgaggaagcatgcctctgaaaatgaagccacttgcaaagagaagggattggtctggctgagggaaatgggaaggagagtaagagtttaatcctatgacttagtttccatcccaatgctggtgatttccaaattcatctataattttgacatccttcacacaagcctcataattccaaaattggctagatatttcttacagacctctttctaccatgattctaaaccgaacatatcaataactgaacacatcacattttgcccctgaaccagcctttcctttggtggctatttagtctttcacctaccaagctccaaactgtggaggtttctactactctttttttatttagaatctatatatgcaagcacttttccataaaatggctcattatcttccttttctgccccattcccccccaagtgcaagcctctatcacttcagacctggattgctaaagtagcttcctagcagggctctagcttctaggctgtttctgctttaatatcactgcacacgacttcaaatttatcttactaaaatcctgttttcatgtccctttccacattccaaatccatattatcttctactggcttagagtagcttttcccaaagtatgttatgtgaaactttagttccatgggagattaataggtgttaagtaaaaactggcattgtaatcaaatgccagaattgacaaaattataaaccatttctttcctgcaggatgattcataactttgatgtgttaatatgccttagtatgtattgttttccaagacatgtattttcacagagcctcttttggtggagtatttaattggcctaggtcttcataaactacattttgtgtcttagtctattttgggttgctgtaacagaataccacaaactgggtaacttgtaaataattgaaatttatttgactcaacagttcttgaggctggaaagtccaagagcatggcactggcatctggtgagggccttcctgttgcattatcccatggcagaagggggaatggtaagcaagcctgcaagacacagagagaaaattgggccaaacttatccttttttatcaggaacccaatccagtagtaacagcattaatctattcatgagggattctctaatcacctgtttatcatcctacctcttaatctcatcaaaatggcaattaaatttcaacatgacttttggaggggacatttgaatcatagcatttgggaaatgctagtccacagataataagtccatatttcctgtgatgataaattttgtgtgtcaaattgactaggccatggttacccagatatttggtcaaacattattctgggtgtttttgtgaaggtatttttcagatgatattagcatttaaattggtagactgagtaaagcatgttgctcttttcatgtgggtgggcctcataaaaccagttgaaggcctgagtagaacacaaaggctaagagtaactttgcctgcctgactgactttgaactgggacatcagctttttcctgcctttttgcaagggctcacctgggtctccagcttgccagtttaccttgcagatcttagaaattgtcagccagccagactcatgcctgtaatcctagcaccttgggagtgaaaggtgggaggattgcttgaggccaggagttcgagaccagcctaggcaacatagtgagactccatctatattaaaaaataaaagagagagagagaaattggcagcctctataattacatgagcccattcatgtatagatatatctccattttattggttctgtttctctggagaactctaacatactctctgttgtcttcttcaaggctgtttaaagtaagactcttattccacctatctgagtttatttacttccatttctcaacacatatcttctgccccagctaagatggtctcctcactctctaaataccccttgcagaattcacctccaggctttgctcaagttgtttcttttgttcagaatgtggccctcccttttcttatatattcacattctacccatcgtgctctctttttctccttccctctcccaacaacatttctttaaaattagaaaataaacttcagccaggcatggtgtctcatgcctgtaatcctaacaacttgagagtctgaggtgggatgatgacttgaggccaggagtttgagaccaacctgtgcaatatagcaagaccccatctctacaaaaaataaaaatttaatcaggcacagtggtgtgtgcatatagtcccagctactcaggaggctgaggaaggaggatccttctctccaggagtttgaggttacagtgagctatgatcacaccactgaactatagtctgggttacagaatgagactcgagagggagagggagagagaagagagggagggggagggggagagggcttccaaaagacaagttctgaaaagcattgaattacattcattcctgtgcactgtgctttgtggggatgaccaaaatactggtatatttgaagttcaaggaaggaagacctaggggaagcctccgttacaaatgaatagagaaaaaagtgagtttatttcctaatgttctaattccccagtgtttttccccagagataggtagagtctcaaccatcttcttttttcccctagtttcaaggtccaagtgaagtcccatggctgcaaattagagtcatttaaaaattctaaaggctggataagcaagagactgactaaaaaaaataataataagaaaacgaagaaaaatcctaaagtccaggctgcatcccagaccatttaaatcttaatctctgtggctggtaccttggcattgatattttataaacttctccaggtgatttcagtgcatagctaggattgagaaccagtgtgaagtcttcccgatacctgagtttcatccacagagtataagaatcagtaggtctggggtggggctcaataatgtgcatttctaacaaattcagaggtgatgctgatgctactggtgtggggaacctcactttgagaactactgtccaaaaggaccaggactaaggaagagagcccaaatgagcctgatatggctccctgtgattgaggaaaacctaatagaatggacagaaaagtaaggaccagctggaaacattacttggaggttactaattgatggcccaagccccaaatctcctagtccatagatatgttttgtagagtcacatgatgttttccatttaaaaaaattagttaatatttcaaaatcaaagatttatacacacatataaattcactcacacgtacaaatcttttgacttttcaagaaaaataggctggcaacaaggagcccaatttcctacatggcaacattcaacattagcaacaagtactagcggccctgctatcccaaatgagcccagcccccaggcaatctttcaaatcaatgggaccatatgagtgagcccaggcaaaaccagcagaaaaactgctgagaaaacccacaaaatagtgaaaagtaatatacattgttaatgtaagccactaagttgtgggatgatttgttatgcaagaatagctaactgatacaattggcagagttcccataggcctgctttgctcagttttgttacctccctggcccctgtaggcaggtacatttccagcctggctcttaccctgaagacactggacagatttcaaagccttttccacacccgttatcccaacaaccttgcatggtcagctggtattaaatccccattttgcagatgaggaatctaagaaccagagggctaagggacattcctagagccacgtagtagcagagcacgatttctcatcctatcacttttcacttttggttcagtgcttttttctttccatttgggtagttgactgtcagtctcctgaggccattagacctggcagtcaccaaggccaaactctgtaaactaatggagtgggatgttttcaagaagggggaccctccatcttgtctttgtttatgagaatattatctgcaaagtgcctaatatagtgactagtacataaagggccttaatgagagatgattactcatgttattacccactctgtttccatagtatccattgatgtttctttccttctttccctccctccataccctggttggattagttaatctcttatctaagattggatacattttctgtatatctagtacaacacatatcacattgtattatatttttcgtgtgtctctctactgcctcagcccttgggtgctctagtttcaggaatcatggatttcctgtttatttccaatctctctagcacaggacctggctgaataaatgatgattgaataccattgaaattgaattacacagttgcaagatacgttcaatcacattcttgtttaaatttttttaaaaaaactttattttgaaataattatatattcataggaagttgcaaaaacaaaataaatcaacattcacacacacattctagtttgactcttacagcaatcatcctgtgaagtattattgttaatatcatgttaaatgatattaatattaatattaaaatattaaaatatgaggaaacagaggctcagtatcctgagaatttctttgcagttggtgatgctaaaggggtgtttatgaggtgattgctattccttgcatttctttaccatttctgccatgttttcttcttgatggcagagcccaagtcttatgttgacctctatccccagcatgaggcatagcaggtgggagactctcagtaattgttgatttgaatttaattttcacttgtatatgttagaagttatgtctagtaccactctagggaaatgtttaaaaattgcctatgattaagtctaccaaattgtaccctcattcttttatcgcagatcagatgcttacagagagagagggagagagactgggagaaagaaagaaagggaaagagagaaatctttgagaaaagaaagacatgggaaattgctaggtaacccaaccctgtctgaagaaataattgtttctttgtgccaccaccggagaaatgcaggactgttatgtgaggaacaattttgctttttgtgtatcaggtaaggcagaaaggagcggagtaaggttcaagacaaggaggaattagaaggggccaagcgattgaaatcaacaaagggaacagaccaagaaatatgagaaatggagaggaaggaaaggctgagtgggtgtaatgttgatagcatttaaaagggagtagggaatgcaaagtgacctgctgtgaaggagccctaagatatcatctgaattatttttcctgtgagatactttctcttgaaaagaattcttgtcatccaaccctaaacaccactacagtattttttgggtgtagttgcttttaacaagttacatagctttataccagtgagtctgatggctttattattgtttgcattcttcctttccgagagtaataacaagctttaaaaagtagactataattttaatttaataatttgattaatctgtgataatattctggtttttataaaactaaaatatgctaagtcattctgtcaagaagctagcgtattttttccccctgccattgtggttgcgaatgttgttaaggaatgacctatatgcaagaaacatctcttggtatagtgggttccatatcatgctttgagctaatatgattttctagtgtggagccatttgagtctgaataaaagtgacagctacgggaacaaattgtcatattctccttgcagcaagttccgttgctcacgagtctattattattgaagaagcatttagttgtaggtaaatgacccttgccttctgtctttaattgaaactcagcctgccacagttaatatgttttatgagtcagtaaagcttggaagaaaatcctaatgtgtttttaaaagcaaaggaaaaaaattaattggtttcagcacacgttttcctatgcaaacaattcttttcttttatatagaaaaaaactctcttgacattcttttttttgcgtaatcttctgcactgtctcatcagtatctgttcagttgcacatagttgtgttttgaaaagaagaaacctttggtccatttggaagggagtgtgagacctataatcactctctgaccatggaatttgggcttgatctgtgaactaggagaggagatacaagataacctcactgggctgggtgtggtggctcatgcctgtaaccccagcactttggaaggccaaggcaggtggatcacttgaggttgggagttcaagatcagcctggccaacatggtgaaaccctgtccctactaaaaatacaaaaattagttgggtgtggtggtgcacacctgtaatcccagctattcaggaggctgaggcatgaaaattgtttgaacctgggaggcgagtttgcagtgagccaagatggcaccactgcactccagcctgtgtgacagagtgagactccatctcaaaataataataataataataacctcaatgaaagggcttgtaccacattgaataactttaatatttcttcgtagcattggcccagcataggcacctcaatgacttgagatcttctttcactttgtaaattgaagttgtatcagttagctattgctctataacaaataatcccacaacttagtggcttaattaacaacagtatattacttttcactattttatgggttttctgggtagtttttctgctaattttgtctgggctcacttatatgggttaattcatttggaaggttgttggctggaggctgggttcgtttgttataacaggaatgtctaggcctctctccatgtggtatttcattttaggcttgtttacaccatggtggtcttggacaggggttctgagaatatgagagtgaaatctgcaagtcctctgcaacttatgcaatgtcatttctgccctattctgtcagtcaaagcaagtctcaaggccaactcagatttgaggaatggggaatatacctcttgaaagaaggagctccaaaaccttgtggccaagtctttttagtctaccatgtggctagttatcgaggagagaattattaggacatatggggctggggtgggtggtcatatctgggttttgagtctcacatagttgccatctgagccagccagctcagctgagtctttatgtatttatgagggtagctggttctgtgcatgcatgcatgcatatgtaattgcattccaaagtcagtccccatcatatggccccaagcttcatctcttcatctttaaagtaggaataataatagtgcctcttacataaattgtgaggattaaatgagagagggaatgtgtggaaagtgctttgcagttcctggcacgtggtaggtattcaaatgaatgatagctaattttacttttaaattttcttattttaaattcttagctatttgtgtgtgtttgttttataagcaatccacattctttgcagaaaaattggaaaatatggaaaagcaaaaagagaaaaaaagctaatttcaagttactcagtatcttactgcccagatttagttactgtcaatcttttggtgaaatccatttatagttgttaaagcaaactaaatatggtctgagaaggactctgtacttctatatttgagtccttttggatgaactgtaacctagtttaatagtcagacaaaaacctaacttagtagtatgcgtctgtaataatagctgagtgttggccaatcccagcagccataatttaaccactcattgactgctgaatcttcaaactccattcaaataaggcaaatgctgagctgtaatcaatctcactgtttctgtacctcacttctgattcctgtacgtcactttaccttttttgtctataaatttgttctgaccacaagctacccatggagtctctgtgggtctgctgtgattctgggggctgcctgattcacaaatcattcattgctcaattaaactcctttaaatttaatttgactgaagtttttcttttatcagatgatgtcagaagtgggatccgaagtggagcttctggtgacgcccaggagtgctgagtgaacacgcaaggtacctgcaggacccgtttgtgtccattgatctctcagagtggctggggatcgtgggtgctaagctccctttcggattttggagctctacggatttgtgttttaagctctccaagtttctttgagcaaatttctgatccaaactgggtttggagttgcaacagaaactggactgggtccagggatggatttgatctgggaattaactggcttggatccagttagaggactctcatatctgactgggtcataaaggaactggtagtaagcagtaatattgcagggattataaaatatggcttttggaaattcacagggattattgtgttctgcctctttgtttcatttttcttgcacacttaggaaaaatcattggctaagttattcaggaaaacctgaataaagtcaatattttaggtagaaatgtgatccttaatttctggaaaactgagttccttctggcttatgcattaggcctgggaggcagcgaagtcttatagaaatggcaaaatcttactaaagataacttgcagtggaacattccaaatgaacaataatgcattgaagtacttttaaaaatgagggctcttggtaaagtcccttttggctaagaacgggtttggcactgtgggatgtcaactgctcttctgtttggaataatctgccttgcactctttgctgatggctgtgggtgacaggattaggcatgtacaggatcgtgggacatggggagctttttcctcccacccaaaaaaggggaaacttgagagctgatgggactgctggaaaagatccctttgctgctaacaagtggccacctgaacttttcagtgttgctgaaacgaatgggtcttgctctggcctccctgagctcttcaccttccgcaccctgccataggcaatacttgctcttttcttcttttcctttcctatcttttctgttattcagggtgaccatcttacccagacaccatgtgttgaaatttctagtcggaggttgggttaaagatgaggggcccatctgagggcaaatgtaagccttgctggtttgatattgggtgctaagcagagtagctaatgtctgtgttttatcacacgtattttgctatggccagaacaaaaaaagatcatttttcctttatgatgcagcttggcccccagtgtgatggtgcagcaagctgggtcactggggcccctcagggaaaggaaacccagaagcctggcatgccggcaaaagggcaagaatttcttaccagtcagatttctggcttctctctttctgtgcgaatggttgaatgaatggtaaaaatcactgtttttctcctctgtaaagttttgattatgcaaaagaagaattctgaggctagtcttaagctgatgtattttgtgcgatgaattcatttttctgtgtcgcggagtaccttaggataaaacgtggggttaggaccccataaactcgtgctcaggatggcccaacaagctgttccataacaaactgctgcaggtccctgaaacaaacaaaaaaaactggatggggtctccatcttgttttatgtccttgggagcttgaccttgtaagcttgtggcagtactttctcttggtctccgccttccagagaacaggaattttagggtttatgtcatagttagctctaaaaattatcttgagtagttaaaagcctttgcaagttcaaaattaactactctagattccttctgggaagagcagtggagactaccccacgctgtagctcggtagctaaggttctgccctttcacactggtggttggggttggagtccctggttgggaagtaagtcctttctggtttaacatctgcatgaccttgtctattctcttctcttccacagactattttaaattttcctttctctgagcaactattttaaattttcctttctctgagcacctgggaggttacctttggtaaagttcagaagccagaaatatcagccgtttggcctggctaaaattggataataagaagttttaaaaggactttattaaagagtgctatggttaaaaagtcagcttaattaaaagtggatattcaagctccaacagcctggactccttgggaaaaacaggaggcactacagacccctttcctggccctgctcttccaaggactccaccataaagcctataaccaattaagaaacttaaaatgtggcaaatgaaaaatcgtacaactactgtagtaatcttcttctgtctgtctgtgtaattatatatgtgttgtgtgtaatgtttatataaaagagctctaattaattggcttaaaagtaagtgcttaaatcaagtattttgaaagcaaaataaaaactgtaatgcctttagttcatgtaactttagtaacctttgggaaataaaaacagctttaaagattattgataaaataaagacattttatctaaattatgcagggcagatattaggttttttaaatgctttaaggtcataaactgctttgacttttgaaaattgttcaatttattttggagaccttaaattctaaataaggtctggggatatatggaattaaccatacccagtaactatgcaaagaaggttatgaagaaaagagatcttatataaaaaggatgttgtatggtaaattcctgtcccgaagtaaaatgactggttgtttgaatttagggcaagtcagaaagtctaaacatgtcatacatggtctgtgtaagtcatgaaagaatttatgaaatggaatttatgccagaaatatacaactgaaaggtaattaggcctcctaaatgcttcataaaatgctactatgacttttaactgtacagcttgcctgctttacagctaggtaaggcctgggacatgtggagttagatgctggaaagagtcagaccttatctgcatttctgtctgggtcctaggcttcacacctagtgcataattaaaatcctatacttaccaagattttcaccaaaagtaaaagttgctaagagttaacattgtaatatgtagttgagactactgaaaaaataggtttacatgcaaggtgtgtaaagagaatgaaatgtgttatttgtaagggattataagaaggtatggaaatgtaaatttttgcctaggttagagggttaaaggattgttaaataaagctaaagatttgaacaagttacggaaggtttatagaacattaattgtaagagattctgtgtgtgaacatgttggctaaagttaaaatggtgttattcagttttttccataaattgcacattggaataaaagtacaacagagttttcttagaacattgttctactcagagaaaaaaattgtaaagggttataagaggtttataaaaatcttaccttacggtaaaactgattaaaactgaatagattataaaatgttattaaaaactagctttaacattaaaaatacactaatggaaacataaaatttggttttctcttttaaaaatgatttttatgtaatattaaacaataatgaaaggtttttatttaccttttaagtaaactacaaaagaaaaagcggggaagggaaagaaaggagacagagtcagttggcctcatgctatcttcattgggtcttgtttggagagctgagtctcctctgtatcagactaatgtttcttcctttagaaaatttttgacttatcattttggtgaaatgaatgacttatggtaacgtgagattctattttgtaatatccaatgttttaaacctttggtattttaacagatttttcaaaatcaagctctagattatcatgctaaaccagccaatactaaaattgtttaaatatacaatttaaatgaactccatggtcttaagtcaaattacctgtgataactcagtagttatcactgctgtgcacctaaattggagaagcaactggcattcgagaggacataagttcagtgttaagcatggactcatgaagaaccaggacagccaccttatccttcccaagtccttaaagcttttgttattaaaggttctgcattccatgactcgccatggaaaagataaaataatccaaactgaatatattgatgtggtgacttatacattgtggaaatagtttaaaaccaatgtttggttccatatacctgggaagacagtcaaaactttaggtacatttgagtacctgatggtccatttaaacatttataaagggatttcattcaattgtcattttcagtgcatgttttctggttgtataaaagctttcccatgcaagagggctgttgttataacagtagattattatgctatagtgtattttcaccaggtaaataaagctttttatggttcactgataacaatccctttacaatctagaacccaaagattggatcttctgagaacatcagagaaagactgtccttaccatccacaccacagcaaaactttggagccttgaacattgggttcataatctcacagctgagaaaggtccctccacactcctggaactgtacacctattggaacccttaaggtaaaactaaccaggaaagtttctccccagaaggagatggcatccttgttgtgaacagcttttccccacaagaatggatcaagacttctgctatcatgagattcttatccttgaatattttttctctgtttatgcctctatgaacaatagaaatgaaaaaggggtctattatgtacacttatagggtatagttttatttgtgaatgattttgcagccagccttatacatgaataactttatactttaatagataaaagatgaaggcccaatgtaggtgagaaaccttagtggtacatacgttgcctcataatcagtcaaaacacctcttaacccacatcatggattaaagagaatattgccaggaggccttcactcgtctagaaggacatcatttgttaggcccttttcccaggatttaggatgaaagaggcaataattagaaatgtctccttcataatagcctccacagcaaattctactttaaaggccatcatacataacagactttaaattcttatgtgaaagttatgctaaataatagaattgactaaacagaaaagtacatgtgcagctgctgacacttgtggcctatggagaaatacatcaaatgtagattataaaaattcagttttatgggattaatgaaaagaccactcagtcaagtgaatagactctttatctagctcattctttaatctatttaactttatgtggtttggtttatggggaccctgggtaaggagcatactccaaactcttggtattatcctcccgatagtcataacaatagcctccttagtgctctctgttctctaaaaggttttaaatgtttgcatgcagccatctctagaacgtcaagtagtctctcttcaagtggaatgacaaaaactgaaagaaatgtgcgaccatgaggacattgtaccctatgaatgacatgctgggactggaaacccaaaatgacggtaactgagagtggtgctaaggccctaagttttggttacactctcacctaagtgagaacctggccaaaaagggggaatttttttttttttgagatggagtctggctctgtcgcccaggctggagtgcagtggcgcgatctcggctcactgcaagctccgcctcccgggttcatgccattttcctgcctcagcctcccaagtagctgggactacaggtgcctgccacctcgcccagttaattttttgtatttttagtagacacggagtttcaccgtgttagccaggatggtctcgatctcctgacctcgtgatctgcccaccttggcctctcaaagtgctggagatgacaggcgtgagccactgcacccagcccaaaagggggaatttttctaaacaaaattatgagaggccattattttgcactgagctcatgcactaggccccgacaaacgaaaccaaactaaaatgaagtcactcgtgttaaatgtgacataatcaaactaaggctttaaagaaacatagatcctagaacagatcaggttttgtttttgtcctgtaaacaggatgttccagcatagggaggtagcttctactcagtctttattctttccttggaaaacccactgctcttctgtttcccagtgggtttcaaaaccatgtaagtacatttacaatagtgatagtagttatcaattaatgaggttttggtcaatctctcaaaattgagaaaatgaccaaaaggggggaattgttaaagcaaactaaatgtggccttagaaggactctgtatttctatgtttgagtccttgtggatgaactgtaacctagcttaatagtcagacaaaattgaaaacctaacttagtagtatgcgcctgaaacaatagctgagtgttggccaatcccagtgaccatacttcaaccactcatagactgctgaatgttcaaactccattcaaataaggcaaactctgagctgtaaccaacctcactgtttcagtacctcacttctgattcctgtacgtcactttaccttttttgtctataaatttattctgaccatgaggcacccctggagtctttgtgaatctgttgtgattctgggggctgcccaattcgcaaatcgttcattgctcaaactcttttaaatttaattccgctgaagtttttcttttatcataatttaaacctttttttcagtggtatgcatatatgaataagtgtgtgtgtgtgtgtgtgtgtgtgtgtgttagatacacagggagagacatttgtgtgtatttgtacttagatacattattcataaaatttaataaagaagaaaaccagaactggtcattactttttatcatctgtaccttctcatcccagaatttgtttagggcacagagactgcattgttaagtagtatctgattcacagcctaccattttagttttccttggatcccagagatcaagacaccagctcatacctgctactagacctgaatcttccagagtgagtctagaaaactctaggccttcgagatgttctgagaaagaagagttccttgtcaaataaattagagaaacgctgcatattccctgccagtctttgagaatcatagataccaaatggtatattcaaggctctgatatgtcctgtgataaagattcttatttcactttaacacagtattttccaaatttacatgaagtcttccttttattttgaaaagtaatacacagtaaaattaactttttttggtatatagttccataaaattgcacacatacacagattcatgtaatcatcaccacagtcaagatacagaacagtttcatcccaccccaaaactccctgtgctgtccctttatagtcagcacccctccctgtccacctctggcaactatgaatctgttttccaccacagtagttttctttttttccaagaatgtcatattttggacatacagatggaatcatacaccatgtagcctttgtaactgtcttttttcactcagggaatgcctctgggacatatctgtgttatatgtatgaatagttaggtcttttttgttgctgagtcatattccatagtgtgaatataccaaaatttgcttatcctgttgaaggatatttctaggctttggtgagtatgaatagagctgctagaaacattcacgtacaggtgtttgtgtgaacttaaattttcactttcttgaggaatgggattgctgggccgtatggtaagtgtatgtaaacaattttttacttgttttaatctattaagatggcagtccccaacctttttggtaccagggactcgttttgtggaagacaatttccatggacggtggggggtgatggggggatggtctcaggatgaagctgttccaccccagatcatcaggcattggattctcataaggagcatgcaacctacatcccttgcatgtgcagttcacaatagggttcacagtcctgtgagaatctaatgccacgccgatgcaacaggaggtggagctcaggtggtaatgctcccttgcccaccactcacctcctgctgtgcagccctgttcctaataggccacggggactggcaccagtccacggcccaggggttggggacccctgtattaagatcccacatcaccagggtttcatagaacatgctattaacatcctacagacctagtctttcatggaacccactttgggaaggccttgtgtgctgccacttaacgcacttggaaagtccaatccaccttaaatccatctcacgtacccaaatcttgctgaggttcggccacaactcccaccacactcccctttgttgagtgcctactgccagacattggtatcattatctcatttaattgaactcacaccacaatctacgattttacagctgaggaaactgaggcccagagaggctaaatgagtagcctaagtttccatagctggtaagtagctaagatttgaaccctggtatcttatctccaagatcagtgcttcctctcctatcctacttacttgcctttttcttcctttccttctttaaacatttattattattattattattattttttaagttgtatttcaggttcagtggtatgtgtgcagttttgttacataggtaagcttgtgttacagaggtttgttgtgcagattattttgtcacctaggtactaagcctagtacccaaaaattttttctgatcctctccctcctctcaccctccaccctctgataggccccagtgggtattattcccctctatgtgtccatgtgttctcctcatttagctcccacttataaggtattgggttttctgttcctgtgttagtttgctgaggataatggccaccagctccatccgtgttcccgtaaaagacatgatctgattctttttcgtggctgcatagtatctttgaacatttttatctgggtttgtggttggttgtagaccagcaccaacaaatgacaaacccgactgctgtcacttcccacttctatgctcatggcagacatcattaactgaatttcatcttctctttttcactcagtcctgatgcatccttctccagacaactatcggttggtcagagttagcacttgagctaattaccattcactgttttgtccttgtattagttatctattgctatataacaaactacctcaaaacacagtggcttaaaaatagtaaaaatcacttatgatcactcatgatttctatgggtcaggaattcagacagcagagcagaatggccatccctgttccaccatgcctggggtcatgttcactggaagacttgaaggctggggctgaagtcctctgaaggcttgtccactctcttgtctggtggctgattctgactgttggctgagggctagctggggctgttgtctgaacacccacatgtgttttctccatgtgacttgggcttccttgtcatatgacaccttggttccaaaagctggcatctcaggagagtgagaggcaagtagaagtaacaaagcattacttccaccacgttctattttttagaagtaagtcactaagtctggctcattttcaaagggcagtaattagattctactttaaaaaatgtatatattacatatactgtctgtatatacacactatatatatataatgtgaacatattttcattattcagagtaaatttttatgtatagtgcattagcaaggtctctttcagaaagtgacagatactcaaaaagggaatttattggtttacttaactgagaagttcaaggtgatcaatttgtcatgactggatccagggcctcaaggagtgttgttaggatacagtctctcactctcggtctctgtattagtctgttcttgcactgctataaagaaatacctaagactgtgtaatttgtaaataaaagaggtttaattggctcatggttctgcaggctgtacaggaagcatagcagcttctgctgctgaggagacctcaggaagcttccaatcatggcggaaagcaaagggggagcgagtcgtctcacatggcaggagcaggagcaagagagagaggtgggggaggtgctgcacacttttaaacagccagatctcagaataactcactcactatcacaagaaccagcaccaaggggatagtgttaaaccattcatgagaaatccacctccatgatccaaccacctcccaccaggccccacctccaacattgggtactgcagtttgacattgagatttggtggggaacacagatccaaaccatatatatcagttttcctctatattttagccctacttccttctctgttggctttattctcagggaagctctacctgggagatggtccggatggacatgccagctccaagtttacttaccaggttaacaagcccagagggccatgtctcctctttttccatagctccaggaaagcaccaagattggcactgattagcctgcattgggtcacacactcacccctgagccaatccatgtgacagggaatccagacccagccagttggcatgaactaggttgggggaatttgttcctcaaaaggatgagaccagctttgttctcagaagaaggctgctagacaaaaacaaaagatgttccctgtgcacggtgacatgcttttgactcggggctttctctgctccctgctcccctgagcctgtcctggctttgcacttcttactctcacagtcatgttcctgctcaaccgcagacactctgagtctctgccccaggaggacaactaaagggcaaacacaccctttctagtataaggtctagctcttgactgccaatactttgatttacttccataactccctggattcctgactcctaatctagtgagaatttgagggattcagatcgctttggttttggagttaattttctgcactccttacctgtctctcatagtcaggaaatgattactccttgacctgcgaccttgactttgaacctcttgacttcttagtccctggtgtttacatacctgttaacttttactttccttgaatcccgtctcttggtttttttcctctgcctgttaccacccattctggcccttgctgtcatctgctgtgcagttgtcagttgaggactgatttctatgccttgtgtccacatcttgaattaatagtatctcttggcccaaatgatttcctaacacacatcccctgatgagtattctgggtcataccttctgcactgacaggcctccctctgtccctttctcttttggaggacaagctaaggtacaaaggaatgagccttgaattcagaaccagcatcgctgggtttggcattatgtgactttaggcaaggctttttaatctctctgagcctgttttcttatttgtaaaatggagtgaatgacatctacttcacaggattgccttgaagattaaacaggagaatgcaggcattgcaagataataattctaaaatactaatatgtgtgtgtatgtatttaaaatgaatgtattttttccccttttaagcatctccctttattcagttttgtcccctcaagcaggcaagccattctgtgcttattgactcagggaagaaaatggcagatcagaaaaaacaaaataaggatcttcctggctttgattttctttctttcttttcttttctttcttttttttcttgagatgcggtctcagtctgtcacccaggctggagtgcaggtgtgtgatcacaggtcactgcagcctcgacctcccaggctcaagcgatccccccatctcagcctcctaagtagctacaactacaggcacatgctgctatgcctggctatttaaattttttttttttttgtacagatggggtcttgctatgttactgaggcttgtcttaaactcctgggctcaagtgatcctctgcctcagcctctcaaagtgctgggattacaggtatgagccacggcacctggccctggcttgattttcaaaagctttaagttctcaggggactattgagggcacctgcatgtggccaaaataagtgagggcaagggggttgaagagagtccccctcagactagcaaacattccactgctctgggcagagaagcggggtaggtagcagggggaaggaggaaagaggaggtgtgatgaaagcagatatacagccagccccagagagaggggccctgtgccctgctttctgtgtggagccctgtggagcagaaaggacatggctgggtagtaagccggtagattctgggttcccagtgtggcccagaaagggtgctgggctggaggtgagggacatgtcggtggtgatgagtgaggactggtgcctatgggccagacaaggtgatgaaattgtctgacaatttcaacagacaactgcatggatagacaacagcaaggaccagaatgcaccactctccctcccatgattctccataaacaccgagaacctggaggcattccctgaaagtgggaagaagatttcaaattagcggaggttatatatttgccactctagtcggataggggctaaaaatgaaattgaaatgttatattttgtgtacaactgtgcagtagattaagaaccataaccagcacctgtagaaagcatgtagcctgtatccataggtgggtaccacaatatgtttactgagtctgaatccagatgttgttgagcctttgaatatgtccaatgtcttgcttgatgtgtgaggcctgatggagtcactccccgtatcagtggttttcaagtgtggtccctggaccagcagcatcagcatcagagggcacttgttagaaatgcacattctcaggccttgtcctggagtgactgaattggaaagtctctcaggtctttctgatgcatactagagtttgagaacctcccttctacatcacttctgttttctcttcttacactctcagtttctcagacttattcttagatttaaatagccaacttactgattgacacttgaccagctttagctttgggccagccacacattttaagcttttactctgaagacaggagagagcttctgattttacccagagcttttggcatagctatcccagtttcattgaggatctagtttctggaaggaaaacagtgagatggggagaagaccctttagtaaatgagaaggaattgcaggcaaacatgatcttaaaaacctttaccaaatcttcatggagccggtgaacttcacagggaacgattttgtagccaggccagctcctagggaaatttacggccgaaatatttccctgtttctgggtcaggaagtgatagcacacagatggaatttacaatgggagcgtgaatggagtctacgttagctggtggcccctccaaggctgcagagcaaaggcgcttttcactggctctattcacatataatgagtgctccccaggctctcggaagaacgcggctgctggctggcccctttttctttttcctcgactgctttcacttttcagagggttgccctgttgcggtccacttgggattggtgtgagccttgatttggcaggagaaaggaagaagtacacggtggcctacagaattgaattctctgcctctctggcccctttccttgaataataggcctttgtgctttgaaatgcagggaagtcccagtttctcaggctttaaaaaaactcagaccttcctctaacctcctctcccgccttcagatgcttagcagggagtagttaagggggcagaacaattatcaaatcaagtatttctttaatgttagaaattgcttggatagttgatttctaaacaatatatgtgatgcattccttcagatggacaaaaatattggcttaacttaaaaattcagcttaaaaaattatatgagattgctatattaatttttttttgtttttgagatggagtctctgtcaccaggctggagtgcagtggtgcgatctcagctcactgcaacctccgcctcctgggttcaagccattctcctgcctcagcctcccgagtagctgggactgcaaggcatgcgccaccatgcccagctaatttttttgtatttttagtagagacggggtttcaccatgttggccaggatggtctcaatctcctgacattgggatccacccgcctcggcctcccaaagtgctgggattacaggcgtgagccaccgcgcctggcctattaatttttttttttttaaccaagaaggctgagtgtggtggctcacacctgtaatcccagcactttgggaggccaaggcaggtggttctcttgaggccagcagttcaagaccagcctggacaacatggtgaaacccggtctccactgaaaatacaaaaattagccaggtgtggtggtgtgtgcctgttatcccagcaacttggatggctgaggcataagaacctcttgaatccaagaggcggaggttgcaatgagctgagatcgtgccactgcactccagcctgggtgacagagggacactctgtctcaaaaaaaataaatacaataaaatattaaaatattcaacaaaaccaagcactgtttgactctaacctgtgatccactttcgtgaagtatttgacagagcaaaattacattgccaaagaggaattcagcctttgcagtctattgagatgggtttttataataaatatagtttaagtaattcatctctgttttcccttccctaattttatgctgcagtttcttttaaaggtgtgtgttaatagcattgcattcttttttttaatcttgaaagcaaattttgtagaaaaatcattatcatcatttaggcgctcacattttcagtggtttaagcatattttgtacatctttaatttttatttcactgtaaaacatatgatttcactacatgtatttgaattttgtacagtgtggcagaagatggaaaacattcttccatcaaggactattattgaactgtttggctgagttactcaaggtcttgctttagaactataaacttcacgtaagaggttattgtctcccatccccagcagccattacccttcctttcgtttcaagcccagatttgtgttttctccttgtctcagtccacgtgctctctgtgaggttccactcacagctccaggactggaagacatgaccctcacctggccaatcaaatgatcaaatcctcttcccaggatggggaagggaggctagagtgattggtttaaggagggggttgtggtccagccatagcctgtgaaatgcagtgggacttttctgggattggtgggagagaggcaggggccctctttccacccaagcttcaatctgggaaaaggttgggtgggaggtgcagcagcccagttgaaagccttaagctgctggcagaggttgggagccttggaagagcctggggctgaatgaagccaacccagctgaagatagactggagaggtggaaacatagtcccgatgatgtcatttgaaccctggtgtgaggccagccctaccagaccagcctgaccagtatagttttttgagccaataaatcttcatagtgcttatgccagtttagttgggtttcctgttactttcaatggaagaggctttttgataacactggtcatgccaaggctggtctggagttcaaatgtgctgggaatttgccaagatgaggctccaggcactgagaatgaagctgaagtctggttatcagaacccgggctccagtgccaggtcccctccctggcctctgcccagagaaggagaatccctatgctggtttctgtagaggggcactgaagctacctacagccttactttcccgggtcaagtctgttctgagagctgagagcaggactggacttggaggtgggggatcacagccctccagcactggggagaggagggcagggtggagagaggagggcagggtggggagaggagggcaggctggacacatattgtgagggggctatagtaagacaaaaaactcacccagtattacatctctttcattgcagggacttttccctgctctgtttctcagtgtgcccatgagagcagggaatgtgtctactttgggtctctgtcccgaacattcttttcttcttcttccccttctccttctccttccttctttcttctttcttcttcctcctgtctcccttctgtcttctctcttctttattcttcgagatagggtctccctgtgttgcccaggctggtctcgaactcccaggctcaagtgatactctcagcttggcttcccaaagtgttggaattacaggcatgagccaccacacctgccctggaacatcttctcaccctgttgtggtctgcctaacttccacaactggattagacatctctcctcagtattctcctacatgcctttacttaatgatcatcacatttcttgtcccgtatttttattcattcattcaatagctatttatcaagtgctattccaggcactggtggtacagcagtgaacaagacagacaaaagttctgccctgaaggagttatgttctaataggcagagatatacaaaaaacaaaataaattataagctattttctttttctttttagacggagtctcactctgtcatctagcctggagtgcagtggcacgatctcggctcactgcaacctctgcctccgggttcaagcgattctcccacctcaaccttccaagtagctgggactgcaggcgcatgccaccacacccggctaatttttgtattttagtagagatggggtttcgccctattggccaggctggtctcgaactcctgatctcaggtgatctgtccatctcggcctcccagaatgctgggattacaggcgtgagccaccatactggccaattatgagctattttcttttttctttttttttttaagacatagagtcttgctctgtcacccaggctggagtgcagtggtgcaatcttggctcactgcaacctctgcctcccaggttcaagcaattctcctgcctcagtctcttaagtacctgggattacaggtgtggctgattttttgtattttttagtagagatggagtttcgctatgttggccaggctggtctcgaactcctgacctcaagtcatctgcctgtctcagcctcccaaagtgctgggattacaggtgtgggccaccatgcctggccaattatgagctacctttcaaagtagataaatgtgaaggggaaaaacagagaggataggaactgacagggaaagggcttgtaatttttaatggacttggaagtgaagacttcattgagaaagtggcagttgagcaagacttgaagaagctgagtgaacgtgccatgtgggtatctagggagggagaaagctttccaggtgaatgcaacagcaagtgcaaaggctcttaggcgggggcttagtgtttgagcaaggaagccagtttgggaggagtggagtaagcacttgggagaggagtgtggctgggaacatgggtagattgcagatcacccccagccttgtagatggggagcaatgggggcttttcaggagaggaggaagatgacgtttgttttttgttttatttatttatttttagagacaaagtctcgctctgtcacccaggccgtagtgcagtggcacaaacatagctcactgtaaccttgaactcccgggctcaagtgatccccctgcctcagtctccttaatagctaggactgcatgtgggcaccaccacacctggctaattttttaaattttaattttttgaagagacagggtctcgctatgttgcccaggctggtctccaacttccagcctccagcattccccccaactcagcctcccaaaaggctgggattacaggtgtgaatcactgcgcccagccttgtctattttaaaagaacctttggctactcagctgaggatggactgttaaataacctctctcccatgctcatcagttcatttcataacagcagagactctaattgtgtcgttcatgactgcttccagtgacctacccaatgtctggctctttgagcttgttgaatgaacaaaagaaggcctgagcatgtggctagacagagatattcgctgttcattgcatgacacatgtcaaaaattgaatctcggccaggtgcggtggctcacgcctgtaatcccagcactttgggtggccgaggcgggcagatcacttgaggtcaggagtttgagaccagcctggccaacatggtgaaactccgtctctactaaaaatacaaaaaaattagccgggcgtggtggtgggtgcctgtagtcccagctacctgggaggctgaggtgggagaatcacttgaacccaggaggcagaggttgcactgagccaagattgcaccattgcactccaggctgggcgacagagcaagactccatctcaaaaaacaacaacaataacaacaacaacaaaaaacaacataaacaaaaattgaatctcagctaattgtcagtttttcagagtaatgaaagaaaactgtggttcctgtggcccacatgcacagacgattgtgcagattagatataaaaattataacatttgctcaactttcatttactagtccagctgaactctatgcattggcaagtggatgcattagcactcatgtaaattactttagaaatagtggagtgttacagttactttctgttcaatcctatcagcagagatttgacacagaaaatatttctagtattacagcagggtaagtaatggcaatgcatgagtgctccctgaccctacccccacctcctccaaccccagcatcattaattttaggaaaccctttatagcagaggaagacaacctgtggtctgcaggccaaacgcagcctgtggcctgttttcatacagcctgtaagttctaagaagggcttttacatatttgaatagttgaaaaaaagtcgaaggaagaataacattttgtgacatgtgaaaatgatacagaattcagattttagtgtccataaatacagttgtatttgggtgcagccacacgcattcattggtatattgatgtggctgcttttgtactgcacctgcagagctgagtggttgcgacagacttgatggattgtaaagctcaaaatatttactagctggctctttgcagaaaaagttggctgacctctattttacagtaatgccaaagtttccttcccaagttgtcctgaatagtttgtattttatgagtgtgcactttttcctgaagtacgttaccttgcactttacgtgtattgaaatgtatcagcctcttttctgcatattcttgcctcttcgcgattatcttcctagagtttattacaattaactattaaccatctggaaattcaggtgtcctttgtaaacctggaagtgtcggtgtatgtatcttttttttttttttgagctggagtcttgctctatcgcccaggctggagtgcagtgacgcaacctgggctcactgcaacctccacctcctgggttcaagagattctcccacctcagccttccgagtagctgggattacaggcacccaccaccacacccagctaatttttgtatttttagtagagatggggtttcactatgttggccaggttggtcttaaactcctgacttcaagtgatctgcccacctcagcctcccaaagtgctgggattacaggtgtgagccacagcacctggccgactgtatatattattcaggaatctttagattgcaggtaacaaaaacctcattcaagcagcttaaagagtcaagggaattatcaccttctataattgaaaagttaggtttaggactagtttcaggtgaggtttgagttgacctctcaaataatgtccctaaagacctagtttgatccttctttcttctcagcagtcagctggttttcactctctggccctgcatgatgattccaggttcttttcttgaggtatcaactggttatagcagttccagaccttgtaaccttatatcacaccttagtgaagaggggaatgtctctttcactagctcatgcagaagcacctcttcccagaagcactggcaaacatctcctggagtgccattggccctgatcgggttgcaggcccacacctaagccagtctctgtggtcaaagatgggatacactgatgagcttatggtaaccaagatccacctctgcagctagaggtgggttattcctacccaaactgtgtggctgaagacaacagatagggatactgttggcaggagaagagaggagtggatgctaggaaaagcaccaataagcatccactagattggacattctacctttgtgcttatacacagctctgaccttggggccactccaatatttacccatgttcatcctgggaagtgtctgtttatttctacctgttctttgtgatgaaaaggaaacctggtcctgacttggctctgctaccgattagcttaatgagctcagagaagtaacttacttttctcgtcctcggttttcttttctgtataacaagaaagggatcaaacatgctatggtgagtattaattccaccagtttgttaggtgagactcaatgagtagatgtcagggtcctctctaggatgttcttaatgactgtaacaccttgtgcccagtacttattagatgctcagtaaatatttattgcatgaataagtgaatgatcatgttggtggactagcagttccttgtggttttatctcttttttttgagacagggtctcactctgtcacccaggctggagtgcagtggtgatcatggctccctgcagcctcgacctcccatgttcaagcagtcctcccaccacagccttctgagtagctgggactacaggtctgtgccctcacatctgtctgattttcaaatttttgtagagatggggtctcactatgttgccaggctggtctggaatgcctaggctcaagtgatcctcctgccttggcctcccaaagtgttgggattacagccctgagccaccacacctggctagcctgtggctttatcttgattcctttcaaatttaggtgaatgacattgatcctaatttcctggattctccctgaaagcgcagggttggaggctactctctaaagcagtgtaatgttaaggaggtgtcctgggtatggcaatcaaaccgagcaggaaggggtattattgtcaaggttaactaaagtgcatagaggaaaggaggaaagagggtagtgaaggttacagggaaatagggatcagaggctacttcagtattaactgctgcctaaggagacactccaaaagttagtagcttaatacaacactctgttgttcctcttagttctgtcatttgactaggcaattctgctggtctcacccaaggtccctcatggggtgctcagccaggatgctaggagggctgggtctcaccccacatggtttctcatcattcagttgtcttgcctggtcttacacagcaagtgagtccccaaaaggagcatcctgaggggacaagcctgaatgtggaagcacttatctagcctctgtttgaaccatacttggtaatgttccattggccaaagcaaagtcatatggccaagcccagaatcagtgtgggagagaacgacatatgaggatgtgaatatcaggatgcctggttcactgggaagcatccagagaggctcagggatcctggtttctaaacccattgaaagagtggggcaagggtgtacatgatcgatgggctgtggggttgggatggggtggaggagaggccaggtcaagaatgttgaccacattcctgttgactagcttcatcccttggtagagccaaggaatcaccgaggagactataattccccatcatttccatcagcctctgcttccttttatagaaatacttggtgtcattgcagtcttatttaaggtgctgtgcaaacatggcttcagcataagttcccaagctgaatatccaactagactgctgcctgtaagttccacctatatacacattttggaattaccactgaccctgtaaacaagaggaaatgagatttagtgaatcacatgggccctcagtgataattgctacctttgttaaatgctcataaaaagatctggcaggccctcttctctgaactgcagttctccttctagctctttattgtccttggccttgggagtcatttcagtgcccttctgattattttgtttttcaaagtgaaaactttacacactgtttttcttggctttataaatgttatatgctttttaaaacacccaaacaacacagaccaatataaagaagagtgtaaaatcctcttgaaagttcaccacccagagggtaccactgttgatgtgttcatgaacatgcttcagttgtccctcagtgaacatacgtgcacacatgcaacaaatgggatggtgctgtggcctgttttttgagacagagtctagctctgtcgaccaaactggagtgcagtggcatgatctcagctcactgtaacttatgcctcccgggttcaagtgattctcctgcctcagcctcccaagtagctgggattacaggcatgcaccaccacgtccagctaatttttgtatttttagtagagacggggtttcgccatattggccaggcttgtctcgaactcctgaccttaagtgatccgcccgctttggcctcccaaagtgctgggattacaggtgtgagctgccacgcccagcctgtggcctaactttttaaaccccattttatgaatgtgcaaatttgttcaatcccacatttatggatacatgggttgtttctaacttttgcaattctgattaagtaatttttgattctctgattttaaatatgcccctgaggttttcctttctctgtctggaatctattcctattttgccaaagatgccatctgtgtaggctttcttttcttttgtctcagcagctttcatcatggacatacattttgtttaggacctttaatagtactccttttataaatggttttcaagtaatgtgtaatagacttttaaaagcttgttttaatcttctctttaaatagagtatgcattttggttgactaaacattcacctgtatagctgggtcgtaggttcatgggctgctctccctcccattgttcagtcacattgtgtgtaaccacggttaccaggcttggtgtcattacttccttaaggtgatttcatgccatcagcatttccagcccccaggacccctggctgttcacaggctaaactccttccagaggtttgatgccctggcggtgctggagtggggcaggcagtgacagatcctaactgggggctgggcacagtggctcatgcctgtaatcccagcactttgggaggctgaggtgggtggattgcttgaggccaggagttcaagaccagcctggccaacatggtgaaaccccatctctactaaaaacacaaaaaataagccaggcgtgatggcacgtgcctctagtcccaactactcgggaggctgtggcaggaggactgcttgagcctgggaggctgaggctacagtaagccatgattgcaccactgtacttcagcctgggtaacagagcaagaccctatctcaaaaaagaaaaaaaagtcatacaagtgtgtaaagagccgtgtataatgattacacataaatatttgaaaaacaaacatctcgcttatgaacgtatttgaaaaacaaacatctctcttaagtctctaagttaaaaaaatactttatagaatgacatgtataataggttgtcatttttgtgacttttttttgtggcagccaggagattgtgctgctcaggtcaggtttaagagaggacctcctcctcagaaatagcaccacacatctacaaccatctgatctttgacaaacctgacaaaaacaagaaatggggaagggatttcctatttaataaatggtgctgggaaaactggctagccataggtagaaagctgaaactggatcccttccttaacaccttatacaaaaattaattcaagatggattaaagacttaaatgttatacctaaaaccataaaaaccctagaagaaaacctaggcaataccattcaggacataggcatgggcaaggacttcaatgactaaaacaccaaaagcaagggcaacaaaagccaaaatagacaaatgggatctaattaaactaaagagcttctgcatggcaaaagaaagtaccatcagagtgaacaggcaacctacagaatgggagaaaatttttgcaatctacccatctgacaaagggctaatatccagagtctacaaagaacttaaacaaatttacagaaaaaaatcaaacaaccccatcaaaaagtgggcaaaggatatgaacagacgcttctcaaaagaagacatttatgcagccaaaaaacacatgaaaaaatgctcgtcatcactggtcatcagagaaatgcagatcaaaaccacaatgagatgccatctcacgccatttggaatggagatcattaaaaattcaagaaacaacagatgatggagaggatgtggagaagaaataggaacacttttacattgttggtgggagtgtaaattagttcaaccattgtggaagacagtgtggtgattcctcaaggatctagaactggaaataccatttgacttagcaaacccattgctgggtatatacccaaaggattataaatcatgccactataaagacacatgcacacgtatgtttattgcggcactattcacaatagcaaagacttggaaccagcccaaatgtctatcaatgatagactggattaaggaaatgtggcacatatacaccatggaatactatgcagccctaaaaacggatgagttcatgtcctttgcagggacatggatgaaactggaaaccatcattctcagcaaactatcacaaggacagaaaaccaaacactgcatgttctcacttataggtgggaattgaacaatgagaacacctggacacagggtggggaacatcacacactggggcctgtcggggggtgggagactgggggacggatagcattaggagaaatatctaatgtaaatgacaagttgatgggtgcagcaaaccaacatggcacatgtatacctatgtaccaaacctgcacattgtgcacatgtaccctagaacttaaagtataataaaaaaataaaaataaaaaacagcaacaaaaaaaatctaaaaaaaaaaaaaaaaaaaaagagaggacctcctgtgagggctgtgggtagcttcagcccctccctgttacaccgcagcgttcgcgtggaggtcacactcttcttgagctgccctcaccagtgactgagcaccaggaggacactacagtcccgaagcctgaggctcttcctgcccaatccttcctccccttctctcttctttggtggcagacctgcagcagggtctgagactttctgggcctgctcctattccctcactcctttatccttcttagatgtttcttccaattagtcttttgtatgtctaattttgtcttagcgtcagcttcctggaaggcccaacctgacatttctttgttctcaggaccctgacataatggagatggaacaacctctgaaggttgttgtgaggattaaatgaggtattgttgagaaaggcttagcagaaggccagcacagaggaggagcttagtgatattattccccaggtgagcaggtggagaatggtatctgtcagatgtcagtttcattagctgttgcaacccagtggactgtccctgaatacctgtcccctgggagtttcttcaggaataagggactcaaaattggaaatgggaagccctgggaagatgcatcccaggccctcagggagtgagcatacgacctctggaagaaactcctggttttggggaggtcctagtgcggagggggagaagcccaaatgggaggctttgagctttatccctcactgacaacagcaccggccactcgctgtagcttggaggagagagccaagggcagcagaacatggtgaacctgggcgtcagagtaaaatcccagctctgccatttactacctacccaccagggctgctgttagatttaagatgctaaagatagaatgctgagcacagagtgaatgtctaagacctactagttccactcccctccccgataccattttcattctaccgttcttgtaactactctgggtttgagaattatggcaggagactgtgctaaggagccaaagtctaatctctggattgctgagaataaaaggaaggtctggggaaagaaaggagggagggcaagtgggcatgaagaagaacagagctttcattaggcaagtgtttatgggcaacccccacgtgccaggctctctgctgggtgttgggttatgcaggtgattaggacacaggcactgttcttaaggagctcaggtgctgaaggggaagttactgttgtggactaactggtctgtaagtcgtacatggggtcccgtaccacaggcaggcacagagcttggcagcagtgcgaccctggacagaattgtttgtgaaacgtctccccttccagacgaagttattatagctcttgtgattttgtgtggtgcctagatttcccccgttgtacactcagttcaggagtacttactcaagtctcactcaagggcatggggaccccaaacaccttgttcatgtgcaccccagggcccagcacactgtaggcagatgtgtgttgactgagtggtcttcagtttccttattttaagatgaagataatgttgatcttaacaggctgttgtgtggattaaatgaagtaatgtttatcaagtgtaaatcgccttccaaatgttattattgtagacttttcaaattggtgcagtctcttgtggattaagccagtgacttgagcagtcattctataccttcctcatggctattttgaagattaaataaattaatataaataaaatgcttagaacaaggcttatcacatcacaaacactcaaaaagtgttagctaaatcaacaaggataaaatttcaggtatgcaagatgattaagttttagagatctctatataggtgtagtatatagttaatactgctgtattgtgtactggaaaatccattaagagggtaggtcttatgttaagtgttcttttttttttttttttgagatggagtctcactctgtcgcccaggctggagtgcagtggtgcgatctcagcttgctgcaacctccacctcccgggttcaagcaattctcctgcttcagcctcctcagtagctgggactacaggcatgcgccaccatgcccagctaatttgcgtacttttagtagagatggggttttaccatgttggccaggctggtcttgaactcctggcctcaagtaatctgcccgcctaggcctcccaaagtgctgggattacagacatgagccaccgcgcctggcacgtgttcttgccacaattaaaaacaaacaaacaaacaaacaaacaaatgtaaaggaaaaaatataagtaagaaaaaatcgaggcagtgttacagcttgtcagagtgctcagaacaaatgctgtataacttctagaatttatcatctacattggtttataaccatttactatttcaaaagtggtgacaaaaggtggtggtgggagatattaggtactttaagtattatcttcgttgccattcttcggtgtcattttacccattcgaattctgaggttcagagaactgaagccccttgctcggattgcagagcctctcccccttgtacccgggagactgttcctagtggctgttctgggacattctcagagcggttcgccaggtggcgctcttcccccgggataggatccggccaagacccaccccgcggcagacgctagcccttcctcactgcaagaacctggcgttctacagccagcaggggttttgagcgtgtctaagctctcattttagagggagagaaataaagctctgcgagagtatgtccctgggctcagagccacccacaggctccaggtggtgctggggcggagtcccagtttatccagtgacgaatcccatttgcctcttacctccctgcggcatcctgacctagctccccacgcccacctgagccccttccttgcagacaccatgtcatgcctggctgcagctgggcagagcgaagtgcttctctgccgagctgtcgcaaagctccactatctaggagtagagcgagtgtttgggagcagggcaagcgtttaggcaggctggggaggggtgagggggatacccagggacgcaccctcccgtttctcattcgtctctagctgcagtcagaagcagtgtatgcactgctaaggccagggcccctggagtcaaactgccttcgcggaaacccttggcctccccttacccagcagtgggccctgggggctcactaagtttcccatctctaaaatgggaatagtaatacttacctcattgggtcaccgtggggactcggtgaacgtacataaggcactgaggacggttgtaagcacatgataagcacaataaaaatgttagctctcggcaagacgactcaccagcaccctacctggatagaagagtttaggtgagaatttcaggatgattcatcatactcctcgcctattcactcaccccacaatatcctttcagagtaacaactgccgtttattggcagttatgccaggcagtatgcgaaacctgtgatttccatgatctcaattaatccgcagatcaaccctgtgaagtaggtactattattgttcctctctcatggttgaggcttacacaagattaagtcatttatcccaggtcacgcagttaatgacagaagtgcgtcccacgctcattcctgtctggtgccaaagatgaagctttttactactactcaatattctacctcctcttgaagccagttaaaaacaacaaacacagcccctcaacaaacacaggctcccaaaggagccacaggcatcagccgtgctcactgtaattctacaggacccaccccttacagaaaccatggtctgtagagtgagatttctttctgctcttacgtggcacaaaagagagaattttacagatgtctccctgctcccctgcaaagtgctttgactgacacagaggcctctacacattaaagctaagttagccatggagcctttaagggccaccttcccctcttcctgtttcttctgaacctcaaggccacccatctgggcaggcgggggacctgcatctcaggcatgtgcgttaacttaacttctgggccatcccggatgtaatgcaagggctcagtgactcaggccagtctatctgggatttgtcctctcttggcatgtgagagtctgtgcagcattgacatcttttggccatgaatgaaacaacaggaaccaacctacaaatgcagaatcccagaaagtcagggccggaagaggctgtaggaagttaaaaaacgaaacttcaccaagggaagggtcttgatgaggatcacattgagaggaaggaaggtgaccagatttaagcccttttttaacttccataccttcctggtaccctctgctcccagaggtgctgagctgggaggggtgggagtgggcagccaggttgctaagcttgtgcattcagtcaggtgtctctttcttcccctccccagcatgtgattatcctctaaaacaagacttctcaacctcagcatagcccagacatttagggttggatcattccttgttgtggcagcggtcctgtgcattgtctgatgctgagcacaatatttgtccactacccaccacccactggtttccagtaacacttccttctcccactctgttgcatgacaaccaaaaatgtcttcaaacatcatgaaatatctcctgggggacaaaatttctcccctctctcccttctgttgagaaccactactccaaaagcagactccttcctccttcccttcctggaacacatcttaagagcttggtatatgccatgctttgctggctcatgaatcaagccctggctctgtccttaaacaattcagagtctagctgaggagacaaggcccacacaggtggcaaagatgggaagcctctccacagagacaagggcgaggtgcccaaaggagcacaggggcagatgcctcactgtctggggagatgtgaggaagcgtcacagaaggacagatggcaatttctcaggcaggcaaggtgggtaaaggacattccaggcagaagaaatggaatgtacaaaggtaaagagttgtgaagtgtgaagttttggggaaaaatattttagtatgactgtactccagagtgcacatgaggagagattaaggaaaggggctggagagtcaggcagcacaagttgatgatagtgttgttggtggtggtgatgatggtggtgatgatgaagatgatgatggtggtggtgacgatggtggctaacacatatagagcacttagcgtatgccagacattgttccaagtatttctcatacattatctcttaattttcatggcaatcctttgaggaaggtgctatcattacctcagtttacatatgggaaaaatgttgcagagagatgaagtaacatgccaaagtcacatagcttgtgaaggttccttgtgagccctgagaaatttggctatggagagctaagggtgtttgtttgtttttgagatagagtctcactctgtcgcccaggctagagtgcactggtgtgatgttggctcaccgcaacctccgcctcccaggttcaatctcctgcctcagcctcctgagtagcagggattacaggtgtgtgccaccatgcctggctaatttttgtatttttagtggagatggggtttcaccatgttggccaggctggtctcgaactcctaagctcagatgatccacctgcctcagcctcccaaagtgctgggattacaggcgtgagccacctcacctggccgagccaaggatcttaagtagagcagcaacatgatcagtgtttcagttatttttagctgtataataaaccaccaaaaacgtacttgcctaccaccagcgttttatgatagctcatgattctgtgggttggctggggctcagctgggttgttcttccactagtctggcttttgcagtggcagtaacatggtggatggggatgctagttggggctggatgtctactatcttgaagtttcttttcttttcttttctttttttttttttttttgggacggagtctcgctctgccaccaggctggagtgcagtggcgcgatcttggctcactgcagtctccgcctctcgagttcaagcaattctcctgcctcagactcccgtgtagctgggactacaggcatgcaccagcatgcccagctaattttttgtattttagtagagacagggtttcactgtgttggccaggatgatcttgatctcctgacctcgtgatccatccggctcggcctcccaaagtgctgtgattacaggtgtgagccaccatgcccagccatctattttctttttttttttttttttttgagatggagtctcactctgtcacccaggctggagtgcagtggcatgatctcagcttactgcaacttctgcctccctggttcaagcgattctcccacttcagcctcccgagtagccaggattacaggtacccaccaccacgcccggctaatttttctatttttagtagagatggggtttcaccatgttggccaggctggtctcaaactcctggcctcaagtgatctgcctgcctcggcctcccaaaatgctgagattacaggcatgagccatgccacctggccttaatgttttttcatgtggctgctatttctctctctatctaaatccttctaggtctttccctgtgaccactctctccagcagagtagcccgtccttggtggctcaagctgccaggccttcttaatgcctaaacctgaaagtcccaggacatcatttcctctgcattgtactggtcaaatggttacaagatttatggaaagggtacataggatccatttctggtagaaggaggggcatgtgcatacagggaggggtggaattgtttggccatctttggatactagctatcacagccagatttttatagggaagaatgttctggcagcattatgtagggtgttttgaagagagcaagactaaagacatgatgatgaattatgaagtcatggataattctagttgagttagtcagctagcttctctttttccttctgttactgtggaaagaccagagtaattatgttttaatagtaataataataaaacaataatcctactaacctacatttcttgagcacatactgtgtgccaagcactatggtaagtacatttctccacaatttaatacagttatctcacgagatatatatattcctattttatctttcagaaaactgaggtcaagtgtattagtgtgctaaggctgccataactgtaagtactactgactaggtggtgtaagcaacagacattaattttctcacaattctggatgctaaaagtccaagatcaaggtgtcagcagggttggtgtcttctgaggcttatctccttggcgtgtaggtggccttcttattccttggtcttcacatagtcttccttcaatgcacatctatgtcctaattttcatactctctttctctttttttttttttgagactgagtctcactctgttgcccaggctagagtgcagtagtgccatcttggctcactgcaacctctgcctcctgggttctagcgattctcgtgcctcagcctcctgagtagctgggactacaggcacacgccacaatgcccagctaatttttgcatttttagtagagatggggtttcaccacgttggccaggctggtctcgaactcctgacctcaagtgatccatctgcctcgggctcccaaagtgctgggattataggcgtgggtcaccgtgcctggccctaattttctcttttttttaaggaaacaggtcatgttggattagggtccacctgaatgaccttattttaattatcttgttaaaagactctgtctccaaatttagtcacattctgaggtactaggagttaggatttcaacatgtgcattttggagacacacaattcagcctataatattatgtaattagtttatcctcatgtagataataggtgggaagtcagactttaacccaaatttgcctgacttcaagctcctgctattaactaccctgtatattattcttacccacaagtgtctttagtttttgccccaagcaggaaaatagcaaggtggaggaggacactgggcctgcatagctttgtatttaggacatagctctttctaacctgaggaacagggcttggattccagttatgtgttctgtgtctgttaacccgtaactcaatcataatgatctttttggaaggacagtgaaaggcagcagggatttgcttgaacccaggagttcaagaccaccctgggaaacatagtgagaccttgtttctacaaaaaataaagaaattagctgggtgcggtggtgcacacctgtagtcccagctaccttggaggctgaggtaggaggatcacttgagtctgggaggttgagtctgcagtaagctgtgattgcaccactgtacgctagcctgggtgacagagcaagaccctgtctcaaaaaacaaaaacaaaaacaaaactaaaggtggtagaggtggcatatcctgatggatatggttccataataggggatgataataatcactaatacttcagggatgtgtgctgtgtgctaggcacaatgttaagtgctttacacatgttattctcacaataaatctatttggtagtattatgtttcctattttacatatggggaaactgaggcagggtggtgagttaacctgcccaaattcattctgctgataagaagtggcagagccaagctgagcattcaggcaatctgaatccagaacctgtactcttaactattatgcttccacactgcctctggggacccagtgaagaatgaatatgtaccatttctacaaaaagaatctaagtcagagaagactcattaggcttcccttactctgccaagatggctaccattcctccatctgttttccatcttctagaaatgaatgggataaatggccaataagcacatgaaaagatgttcaacattactaatccctagggaaatgcaaactgaagacacagtgagacaccaccaacatccattaggatgactattatcaaaaacagaaaacaataagcattggcctgtgtgtggagaaactggaacccttgcgcattgctgttggggatgtaaaatggtacagccattatggaaaacagtatgattgttcctcaaaaaattagatataaaatcaccacatgatccagtaatttgacttctgggtatgtacacaaaagaactgaaagtatgaacttgaacaaatatttagatactaatgttcatagcagcattctttgcaataaccaaaaagtggaaacagcaccagacatccatcagtggatgaatggataaagaaaatgtgctctaagtatacaatgaatattattcagcctcaaaaggaaggaattctgataaatacagcaagttggatgaaccttgaagacatgatgttaattgaaataagccaggtacaaaagggtatatgtatatgattcctcttacatgaagtgtctagattagtcaaatacatagagaaagtggaatagaggttaccagaggctggggaagaggagaatggggagttcgtgtttaatgggtacagagtttcagtttgggatgatgaaaatctccattctggagatggatggtagtgatagttgcacaatgatatgaatatacttaatgtcattgaactgtacacttaaaaatggttaaaatggtaaaatttatgttatgtgtattttaccacgatagaaaaaaagagctaaaaaatggaaatctcttgcccattgtgacattattttccattttccttgtctgtatgtctttttatgcctttgctgtcattttagtgggctctcaggatgaagaaataaatgtgtgtggttaatccaccaatcacaacgaattcccctgaaatgtattttgcatgcctgctacctggatggcacgatgctagagtgtagagatatggtaggttttcatgttgaggagaggaagaaaaacagcaggcacaacacttcttcaaaacttccatgctgtaaaacagttttggttctgaggtcactaaagaatgaagagaatagatttgcagcaatatttaatatatttgctgtcatcttgtactacagtcctaagttgccatagcaacagaccagagcagaaacttcattagaggaagagctccttggattttaaccctgttattcaatcaggcatgagtgatggggaaggccatcagatggcacccataagatcttttactttgataagctgtataattagctaaatctaataagcctttgtaacaagtaaaacaacaaccccaaacctcactttttgcatcttttccagagtcaacaagtagccaaaagatttcctaggagtttccttcgtggaactattcaaagcaatgctagcaataatattggagcatcccattcatcaacgaagggcaggaaggaacactaacagattgatgatagataatagcttattttattggcatttggcatttggaagaagatgcctggcataagcaggtcatcaaataaagagattactgtgtaatagtcaagtctgtgtcacaggtggggggagctgtttctttggagaggagaaggatgccctcccaaacacacacacacacacacacacacacacacacacacacacacacacgaaagcttcaatagcaatttcaatgcaacatgcagtgagttcatattgctaagggaatttagaataaaatgtggtccgaatcaagcaggtgtgggtggtggtcattcccaccaaggatggcttgcaagaattggtgtttttttttgtttgtttgtttgtttttttacttttattttaagttccaggatacatgtgcaggtttgctacataggtaaatgtgtgtcatgggagtttgttttatggttatttcatcactcaagtattaagcctagtacctattagttatttttcttgatcctctccctcctcccaccatccaccatctgataggccccagtgtgtgctgtttccctctatgtgaccatgtgttctcatcatttagctcccacttgtaagtgagaacatgcagtatttggttttctgtttctgcactagtttgctaaggataatggcctccagctccatccatgtccctgcaaaggacatgatctcattctttttttggctgcatagtattctatggtgtgtatggatctcattcttttttatggctgcatagtattccatggtgtataccacattttctttacccagtctatcattgatgggcatttacgttgattccatgtctttgctattggaataatgctgcaacaaatgtatgtgtgcatgtgtatttataagagaatgatttatattcctttgggtatataaccggtaatgggattgttgggttgaatggtgtttctttctttaggtctttgaggaattgctacactgtcttctacaatggttgggctaatttacattcccaccaacagtgtgtgtttctttttctccataacctctccagcatctgttattttttgaatttttaatagtagccattctgactgatgtgagatgatatctcattgtggttttgatttgcatttctctaatgatcaatgctgctgagattttttttcgtatgtttgttggctgcatgtatgtcttcttttgagaagtgtctgttcatgtcctttgcccactttttaatggggttgtttgttttttcttgtaaatttgttacgttccttatagatgctggatattaaacctttgtcggatgcatggtttgcaaaaattttcttccattctttaagtctgtttactctgttgatagtttcttttgttgtgcagaaggtctttagtttaattagatcaggacagcagttttaagcagagttttggaaaaagaaagagtcacgtattctcgaggaagacagatatttctgagtcattaagatcttaccatcagtccacatcctcagtttgtccgtttgtgattaagttgtactcatttcaaacatttcccctttaccagccttccaggaggcaccagtcagagcaatcaaatggaatcatctcctggtgaagttacccaggcaagtggatattttcaggtctctttaccaaccctggaaaggccattgttttgttgactcattttcctcccacaaagggtaactttggaatttaactctcctatttacaatacaggtctgttttactgcaaatattcttttattgtgttgctctcccctggatgcaattgtgatatagtcaaacatatttgaaatcagcagtgggtgggttttttttttcattttcttttttctttctttctttctttcttttttttttcagctgctaaatctaaagccctgagcaaggtactgtacagtttacaaagaagagtcagatgcagccccattgtactcttaagggacaacaatagaagaaatgacagaagacaatcagagattaatgaccagatgaatgatatataccaggtggtcccaacctgagctcccaggctcccaagggtcttagagagcagtaatggggggagaaggaaggggtgcttatgagctatttgcagtacttcaaaaagactaatccaaagagctcatatttgctagatattagatgcacaggctaattaaaagaaaacatcaggtttctttgctcggggctagaaacaccagttaccccatgctgactggaagatctgattggcagttaccgttgtctttgattaataaaacatgagaaaatgaattaattattacttgataaatgtcttttatttgatagacaaaaaacatttcaaagcatgggatttgtgaaatgagaataataaaatgtttgctttgagtgaaaagaataggaatcaatgagatggacaataagtgactattttggaagtgtaaggtggatagagaaggcagagaaggcttcatggagggcagaaaaggaaggactcacccaagcagggttttgaacgatgtataggattgatctatgcagtggttctcaacgtgtggtctcaatcaacagcatcagccccatctgggaactcgttagaaatacaaattcttgggctttgcctactgagtcagaaactcaaaggatgaggcacagccatctgtgttctaacgggccctctgggggattctgatgcacgctacagtttgagaaccaaagatctatgtcattgtttctcaaagtctgagatgcgaatgcaacagtaggtgattccaagaggtatctgttcagcctaaaaacaaaacagaatcactaccaagaaagttatttccttttccaatctcttatgccttctgttaacatcatgggaaaacactcagtttgatcctagtagggctttaatgagaaacagccacatctctttttcttttggacaaagagaagaggctctatttagtttctgggctttggctggcaatagaacttaagttgagtgtgataatttggctcactctgtcttacatttatttttacagttgccttcttttttttggcaagtgaaactaattttccatttgctgaaagggtataaactattttttatgaaaatcttatttatataaaaatctgattcgatttaaagaagaaaggtaaatagtagtgccagaggtatgtagaaatggaaaacataataaagacactgagtgaatgaaatttgtgaaatatatttaagacaacaaatgtgtgtgcgtgtgtgtgtgtgtgtgtgtgtgtgtgtgtgtggtgttgatgcatgaatggatgcatttgtatttgtccttgcttattgattgttttttgggagaatagaccatagatatatacaccattgcagcaaatacaagagcaaggaaaaaagtatccaaataaaatgtattccaggctacaacctgtgacccgttggtggaagcagtgctcagtataacgaaatcctgtacagcaaagggactcacatggtactttgtgccagttgtgccaggattttgtgataccttatctccttaaatacagggctgctgagatgtaatgagagcgggaacacaggttttgtaatctcttcaggcaaataagaaaacgcttgtggaataggtgacaattcgcagcatgctttcaccataccatgttcattgagatgcttttcatcactttactttgagtcagaaagtgccgagatgaattgatcatgtatacacatcaatgtgagcctgcatgctacaggaaggagttattcaggggggaattttattgcactccttttcctcttaatattttatttatcggtaaagtgtgattaaaaagaatataaagggcatcctccaaggcaatgcctctcttttttgacctcagcacataaaacacattttatagcttagcccagaacacacgtacacacacacaccatcaccactaccaccacaacaaaagttttgtgaaataatacacatccttatagcaagatatatactctgagagttttcattctattttagctcattaaaaatgatttcccatcttgctagtggtctcattagctgttaggaaagcattgctctgactcacggctctgggagtttagtgtgcataaggtttacttgcaagcttgttaaaattgtgggtcttgagaattccccccttctaacactcactccctagggatactgattcagtaggtttggggtatagcttggatctgcaagttttgataagtgagttagaggattctgaagagggtagagcttggaccacactttgagaaacactacttgaaaggaaacaataatataaaaaactttatgaaccttgtgatctgaatttggaagtccctccattacctactggataaggttcgaatgtcaaatgacatttagggcccctcattgcctagtccctactgagcttttcaggtgcatctccagctccaatcttgctgtccccccacacacctgtcctatgtaaccaaacaacatcagaccattcatcatttacatagcacatactttgatgtggactttcatttcttgcagtatggcagaaaagataccttgacttatcctcctgttgtaaacaactaaaaattctggataacatttaaaaccattaaaaatatgttagtgagctagcaagttatgaagaaatactcagaggccaaaaatgaagaaaggtaagcagggccccaaactggcttgtgtttgcttcatagacacttgctgaactgggtgatggtggttttttttttaagaccgagtcttgctctgtcgcccaggctggagtgcagtggcacaatctcagctcgctgcaacccctgcctcctgagttcaagcgattctcctgtctcagcctcctgagtagctgggactacagttgtttaccatgacacccggctaatttttgtatttttagtagagacagggtttcttcaccatgttggccaggctggtctcaaactcctgacctcaagtgatctgcctgcctcagcctcccaaagtgctggtattacaggcatgagccaccattcccagcctgaactgggtgagttttgagctttggtttttttcattgtctcagttacgggagacagaagatgaagcccagaacctgtccaaggtaagggtctaataggacccctcccataaagttatgtccttaaatagccaagtgtaatggtaatttagtgtgagggtgatttggaaataaatctgtcacctaaaggataaaaacaattgtctgtcttgaacatcggggctggttgtagggcccccccaaaaaaaatctctgagaatttgtaactacaagtaaactgttacgaggatctataacatgaattcacacaaccaaagtgatgttagactagtagtgttcttaagatgcctagcagaaacaaatgcatatcccatagaagaacttgtcttttcccagatctcaaggaattcattttgatgaagttttaagagatttcaattcatggtgaaaaattacagggaagcaaggcaacaagtattgagccagcagaaacaacagatagcagaatcagatccatggagactgcagatggtataattatcagtcacagaatataaaagaagtattcgaatatgttaaaagaaatcagaaataaaattgtgaataaagaattaaactaggtaaactaggccaggcatgctggctcacgcctgtaatcccagcgctttgggaggctgaggtgggtggatcacttgaggtcaggggttctagactaccatgatcaacgtggtaaaaccccatctctactaaaaaatacaaaaaattagccaggcttgatggcgcatgcctgtagtcccggctacttgggaggctgaggcaggagaatcgcttgaatccaggaggtggaggttgcagttagccaagatcacgccactgaactccaccttgggtgacagagcgagactccatctgaaaaaaagaaagaattaaactggaaaaatgacaatgtgtggccaggcatagtggctcatacctgtaatcccagcactttgggaggctgaggtaagagaatcacttgagcccaggagttcaagaccagcctgggcaaaatagtggaacccctgtctctacaaaaaatttaaaaaattagctgggtgtggtgacatgcactatagtcccaactacttgggaggctgagacaggaggattacttgagcccaggagttggaggctgcagtaagctctgatcacacactgtactccagcctgggtgacagagtgagaacttgtctaaaaaaaaaaaaaagacaaagtgaattttataaaaataacttctacaaatgaaaaattatagattccacagttaattagacaagttgagaagagaattagtaacctaggggagagttctggaacaatatctagagctctggaagatagaatgaaacaaggctggatgtggtggctcatgcctgcaatcccagcactttgggaggctgaggtgggcagatcatccgagatcaggagtttgagactagactggctaacatggtgaaacccgtctctactaaaaatatgaaaattagccaggtgtggtggtgtgtgcctgtaatcctagctacttgggaggctgaggcaggataatcacttgaacctgggaggcagaggttgcagtgagccgaggctgcgctattgcactccagtctaggcaacaagaagtgaaactctgtctccaaagaaaaaaaaaaaaaaaaaacaaagatagaatgaaacaattcaatattgctttattgaatattgaaatgtataattagtattccataagaagaggagacaaagaatgtggagataatatttgaacaggtagtggttaagaatttttcagtactggtgaaagatacctgtccatacattcaggaagcccagtaaatctcaagtaagatagattaaaaaaaaattcacacctacatacatcacaaatgaaacttcagaacatcaagacaaagaaaagatcttaaagcaatcagagtgaaagacagatgacctctaaagaacgatgattattctgacagttgtcttctcaatggcaataatacaaaccactaatgagtcttaaaaaaattaaaattttcatgtatttagggggtacaagtgcaggtttcttgcatatatgtattgtataatgttgaagtctgggcttttagtgtacccatcactcgaatagtgaacattgtacccaatacacagtttttcaacgcttactgcacctcaccctcctgccttttataggctccactgcctattatttcactctgtgagttcatgtgtggccattgtttagctcccacttctaagtgagaacatgggagaaaccactaaaatatcttacatatgctaagggaaaatcactgtgaatgtaggattatatatgcaacaaaaatattattcaccaggaagtggaaaaacattttcaggcaaaatctgagagaactcgtcaccagtagactctttccaagggaaattctaaagaatatactttaagcagaaggaggactaaaatgcaagaagaaatgaggatcaaaagagtgttaatgtgctggggtgtggtggttcacgcctgtcatcccagcagttcacgagggtgaggtgggaggatcgcttgagccaaggtgttcaagaccagcctgggcaacatggtgaaaccctgtctctactaaaactacaaaaattagccaggcatggtggcacctgcctgtagtcccaactaatcaggaggctgaggtaggaagattgcttgagcccaggaggtcgaggctgcagtgagccataaatgcagtactccaatccagcctgggtgacagagctagaccctgtcccaaaaaaaaaaaaaaaaaaaaaaagagtgtcagtgtgtggacaaggcaaacgagtattacctctagaagataataacgatgtcctgaaagattaaaaaaacacaagatagcctaggggcggtggctcacgcctgtaatcccagcactttgggaggctgaggcaggcagatcatgaggtcaggagatcgagaccatcctggctaacacagtgagaccccgtctctactaaaaatacgaaaaattagccgggtgtggtggcgggcgcctgtagtcccagctactcaggaggctgaggcaggagaatggcgggaacccgggaggcgaagcttgtagtgagccgagatcgcgccactgcactccagcctgggcgacagagcgagactccgtctcaaaaacaacaacaacaacaacgacaaaaacaaaataaataaagtgactaaagttaggagtcatagtctttatttttcatggggttatttttaaggtactgatcaatcttggatttaaaaaaaaatagagatggggtcttgctgtgttgcccaggctggtctggaactcctggtctcaagtgatcctcccacctcagcctcccaaagttcagggattataggtgtgagccaccgtgcccagccaaccttggattttggtatgtatccatgttaacatttctaaaatagtgtgtgttggggggcatgctggaagaaatctttcctcacccattaccaggttcaaggttgaggcctctataacaaaagacagataaacgagaagaaagtatacagatctattcattataagtgttgtgtgacacaggagccttcagaaatgaagaccaagacacagataaatgtgtgtgtgtgtgtgtgtgtgtgtgtgtgtgtgtgtgtgtgtgtgtgtttgagatagggtctcgctttgtcacccaggctggagtgcagtggcatgatcacagctcactgcagccatgatctcccaggctcaggcagtctactcacttcagcctcccagcagctgggactacaggtgcacgtcactaagctgagctaatttttaaactttgtttttagtagagaagagatctcactgtattgcccaggctggtctcttgggattgagtttaatcgatcctcccacctcagcctcccaaaatgctgggattacaggagtgagctattgcacctggccaacttctgtattttaatgcttaggtttgtttttcatttaacttttttttttttttttgaggtggggcgtcactatgttgcccaggctggactttgaataactcctaggctcaagtaatctgcctgcctcagcttcctgagtagttgggactacaggcacatgccaccacaactggttttatgcttaggtttgatgaagagtggacagatacggacaagtatggttgtggaacaagtaagtgtgagatctaatggtaataaactgggggaaacttagcaaggcctgtttgttcagattcttttctgcatccctgtgtcttcagagatgaggacattttttttcctccaggtatagggaggatacctctcaaatatgagtctcctcacaggtaggttggagaattcttttatggcctgctttagaagagaaaagcggggtcagagagaccttcctgcttctgctgttttctcaaatgccaaggtgtcatattttagagcagcaagttctgagccccatcattaatcactaaaacaatagaatggtggccatctcttcgctacacagcctgccactctaacgtcagtggaccctggtgcttcggtctgtgcttctggacagtaggatggtctgcccacatagggagaagtattttagccctggttttgttgggaattgccagtatgtgataacaatgaaagcatataaacttctagtggattttgtcctcttcactcccctaactcttgcactgttcctagattttcactgattacttttccctttccaagtagtgatccctgtgaggtctggttattcagtttgcagatatctggctcttagcttcttttgcttaatcttcttcaggtcatttccttaatcaacagcattaccttagggcagtggttctaaaagtatgtgccacagacccctggagttccccaaggtcctgtcgaggtcctcaagatcagacccattttttttttttttttttttgaggcagactctcattctattgcccaggctggagtgcagtggtgtgatcttggctcactgcagcctcaacttctcaggctcaagtgatcctcctgtgtcagtctcccgagtagctgggactactacaggtgcatgacaccatgcccagataatttttgtattttttgtagtgatgggattttatcacgttgttcaggctggtctcaaactcctgagctcaaataatccatccgatcagccttctaaaatgttgggattacaggcatgtaccaccacacccagcccagaactatttttatattaatactaagaccattacttgccatttcactgtgttgactttcgcacgaatggtgcaaaagcaatggtagctaaagcttctggcaccttagacagcaaggtggtgacaccaaactttactagtagtcattgtattctttgccacacacacgtggtaaaacaaaacaaaaacctagtttcacctaagaatgtccttgacaaagcagtacacattattaatttattaaatctcaacttttaggcacacatcttttacacatctttttggtattttatgtcatgagataagaaatacacataaagcacttgtgtggcataccgaagtaggatggttgtttcaggaagagcacttgtgtgactgttgagttgtgagctcaactaccagctttttttttttattaaacaccatttttttttaactcgggagaatgagtgacatacaactctaagagaagatttgtgcttcgaaggaaaactgcattgtttgttgcacatccttagttgattctgattctatgggagctattttacaactctgttaagttgtagataactgatggcaatgcaaaataattcttgtctataaatgttaggcaaatgaattctgcctggtggagggacagcccttctccatccagtaaaaaagccagtcttgtgtccatgtgtactatcgttttaacatttcaaaattccttaagaatttgtgcttgtttggtttctcctttgaactggtttaaatatctgcctggttccctcattatgagttttaaaaaactttaacatgtgttcattttgtgtcagtataagagtcatggttttacctttttttcttttttttaaaaaaattatcttttaacaaagaccgtaattgctctagcttgggtatttagcagaaaatttctcaaaaataattaaaatgagcctgtcaaggaaaacaactgacagtatttgttaccaaagatcccattcaagctttcaaatgaaaattagaatatctgctgccctgagcctgacagcttcccaatacttaaagacttaaattatgagattggtggtgatgttagtgaatgtgatgttggataataaaatgtgacagtgtttggaagatctgcataattcagtgagccaatattttccaatatcatccaatgcatgatgttacaaaatcatgcataagaaaaaatccattcaaagtacatgataggccaatagattttaatgttaacggagtatgaaaagttcactgatatggtttcagattctacatgcaactagtctttaagaaactaccagcctggtgcggtggctcatgcctgtaatcccagcactttgggaggccgagggggggtggatcacctgaggtcaggggttcaagaccagcctgggcaacatggagaaaccccgtctctacaacaatagaaaaaactagccaggtataatggcgggtgcctctaatcccagctacttgggaggctgaggcgggagaatcgcttgaacccaggaggcagacagagattgcagtgaaccgagatcctgccattgcactccagcctgagtgacagggtgagactccttctcaaaacaaacaaaaaaaagaaactaccacttgctgaattttggcatagtgtcaaagtagaaaattcacaattatctgaaaagactattacaatattccttccctttccaactatatttatctgtgtgagatcatattttcttcatacccttattcaatcaaaacaatatatcatggctgggcacagtgactcactcctgtaatcccagcactttgggaggctgaggtgggcgaatcacttgaggtcaggagttcgagaccagcttggccaaaccctgtctctactaaaaatacaaaaattagccaggcatggtagtgggcacctgtaatcccagctacttgggaggctgaggcaggagaatcgcttgaacctgggaggcagaggttgcagtgagctgagatctcaccactgcactccagcctgggcgacagagtaagactctgtcccaaaagaaaacaaaaacaaaaacaaaaacaaatatatcataacagcttgaatggagaagcagaaatgagaataaagctctcctctattaagccagacattaaagagatttgcataaatgtaaaacaatgctatgcttcttattaaatatacatttccttaaattttggaagatacttatattttataaaatatgtaatgttcacatgtaatgagttaattgttatcttaaagtaaactaataagtagttttaaaagtcttagttttaatttttaatttggtaactattgatagataaaacctcataaacaaaatctttttgggagtcttcaataatatttaagtgttgaagtcctgagatcaaaatgtttgagaaccatgaccttagtggaaaagattgttaaatttgagctggttgaatggtcggtttatgtcagaagacagggtttggaaagaggtaggattatggattaaggtaaagttgaattcccttctgtattgtgcagaagtcattggctttgccattaataataataacattatcaggttgagcacagtggctcatgcctgtagtcccagcactttgggaggttgaggtgggcgggtcacttgaggtttgagaccagcctggccaacatagcgaaaccctgtctctactaaaaatacaaaaactagccaggcgtggtggtgcatgcctgtagtcccaactacttgggagactgaggcatgagaatcgcttgaacccggatggtggaggttgcagtgagcccagatcatgccactgctctccagcctgggcaacagagcaagaccctgtctcaaacaaacaaacaaacaaacaaaagtatctactaattggggcgcgtattgtgcgctaattacactacataaattactttgtttattcttacaccaacattaaaaggtttgccttttcataataatagtaataataataataataataaaagtaagtacatctaggtccaaaataaacccagattcaaagaagttgagtgacttgcccagagtctaacaaccaagaggggatccttattttgttcttctccatagccagtagccttaaccaggagtccacattatctcctgattctgagtggccatggtcaagtctaattttcatgagtctgttttccgatctgtaaaacaaatgggatcagagagagtttcacctaccacgggccaagtcctcagccctgtatgcagagcatattgcacattcccttgccttcaggaagctcccagtaggatgttctttaaaagctggccatgctgcctgatactgtaattttcataacccatattcttaatgctatcactgtgagtcctgggatttcagtggctttgtggttggagagtgaagaaacctaagtagagaatgcagaggctgccagtttattagtgtggagaggcgagatagcaatccagtaatttatttattttgccactgaatcctagaggccgggaactagaaacctaagcataaagcctccactgctggaagactcccaccacccccaacaattcaggaattgctttcagccaacattacctctgctttctgagcacaagccaggctattgtgctggaaataatcggtgttagtcttattggagtggcttgcgttgccatagttactatttgggttctgtgcacctaaaatttcaagtatttaacaggcaaaaagagttagcttatttttttctttttgcctttggaaaatcagattggagagaaagcagattctgcatcctattaaatgtctgtgtcgagtgggtactgtcatatccggcattgcagagtcatagttaactctcaagcagtgaaaagcagcttggccgtggccttgaaaaaaggggttatcagcatcctgctgaggacccaccgttactgcctcctgatggatggaaatgcagattgtcattgctggttgtgcagctaaagaaattgggcgaggcagctggttatttatgacggagcaacacagagctggtcagtagtttccccagttgccaccacgctgtacatggcaacctgccccccagctctgaaggctgggacagaagtttgcaaagagatgggaaggggaggtgggcacaaactggtgtgtgcgtgggggcggcagcacagcagtagcagaaagggagcaaacttggccactcagcaccttgagtgtgcaacacatgaagactctgctttcgaagctatcatgtttattcgtgctgtctgtttgcctgtctggttcacaggctctgaatcggcccacagtggtgcctagaaatagtcccctttgcttggtcgccatgagtcagactggtctttatgtggctgtctcctaggaacccaaagctatgccacatggctggaagctgtgtttacaagcttttcatccgtcttccttaacttgtggtcgctatggtttcctttgcctgctgggctggccctttaagggggacaagctgtccactcaaccaaatgccagaggcactggctccaatagcttgggtcttttggctatgggcttaaccatatctcatcacctgctcattctgagccccaaacttctcccctggtgaggctgaccttgacctttgccctgtcatgtgtccattgtggggtctgccaccttactgcctgtcctggcaccctctgcatttgccacgatcagggtgtttgtggtcgggtgcagtggctcacccctgtaatcccagcactttgggaggccgaggcgggtggatcatgaggtcaggagtttgagaccagcttggtcaagatggtgaaaccccgtctctactaaaaacaaagaaaattagctgggtgtggtggtgggcacctgtaatcccaggtactcgggaggctgaggcaggagaattgcttgaacccgggaggttgaggtggctgtgagccgagattgcgccactgcactccagcctgggcaacagagtgagactccatctcaaaaaaaaaaaaaaaaaaaaaatcagggtattcgttttgcttcccgttggactgacttcttagtagcttggattttgctcagacagagagccctgtctcctctgccatggtcataatgacttacttagacacagggctcatgttcacttggaggtgccatcctatcctctgtcactttgtcatggacacctgtttatccccttttcaggtaatagcactttgtgttttggggatctgccccattctcagcttataggtgtttctagaggggcttatcccacccctcttcgatgactgatgcagggatgaacacataatgcaagccaggccaatgacaattaatcctggaacttttgctaggagaaagaagtttttttctctgtggttgtttagggtattggatatatccccccctttttttttccctgttgcccaggttggagtgcaatggcgcagtcttggcctcccaggctcaagcgattcttgtgtctcagcctcccaagtagttaggattacagatgtgcaccaccacgcccggccagggtattggatgtaatcctgatgtgctgggtgatgtggaggtgggggctactatttaaaagagaatcaatcaacacacaggagaacagagctaagagatcaaaagacagcctgtgacttgacattgttcacatgcctcaactatagtccagatacctgagtcagaacaaactcccttttaatgccaatgcctattcaggttgggctttctgtcacttgcaactgaaagagtctggtacatccccattcacgaggacaccaaggttcagagaagtgaggtaatctacccaggatacccggctgctgtgatttgaccctgtttctcttggctcccatgactgtgtctctcccactatgcctactttaaatagtaatcttacgtttgtgacacatttcacaagacacaaagcactttctcgtgacatacaccaccacaacaaattctactgctttcattgtgtgcttccagcacagggctgttattattattactagacacacaatattatcaatctcattttccagatgagggcattgagagttggtcacatgcacacttggctggtgagtggcaagtgggactctctgcttcaaggttgacttaatattcttgccatttccctacatcacttcctgggtatgccatggagagtaattgcctcagctggtggcctcttgtcccttgcttttcccccagggagtcttgacccgtgcatatcttggaggtagttgcttttggaggaggcctgacacaatggaaagggcctgaggcctggtgatcaaacagactcaagtttagatcttgcttcccccacttactggctttgtaactgacttagtccactcagactgctataagaaaataccataaactgggtggctaataaacaacaaccatgtatttctcatagctccttaggctgggaagtccaagaccaagatgcctgcagattccgtgtctggtgagggtctgctttccggttcatagatggcatcttccagctgtgtcctcacatggtggaagggacaagacagcttgggcctcttttataaaggcactaatcccattcatgagggcttcacccccttgagctaatcttttccccaaaggtcctatctcctaatactatcatcttattaggagtgttgggatttcaacatacacattttggaggggacacaaatatttatttatttttatttttatgtttgacacagagtcttactctgtcacccaggctgcagtgtagtggcgccatctcaactcactgcaaccttcacattcccaggctcaagcaattctcctgccttggcctttcaagtagctgggattacaggtgtgtgccaccacacctggctaatttttttttttttttttttttttgagatggcttctcactctgtcatccaggctagagtgcagtggtgtgatctcggttcactgcaacctccgcctcccgggttcaagcaattctcctgcctcagcctcccaagtagctgggattacagtagcataccactatgcccagctaatttttgtatttttttttttttagtagagatggggacttgccatgttggccaagctggtctccaactcctgacctcaagtgatctgctcgccttggcctcccaaactgctgggattacaggcgtaagccaccatgcccggcctggtatacaaatatttagaacatagcagtaaccgtgggcaaatcacttgctttatctgaactcttatttcctcttctgtaaaacctatgagtcagagagaataatgtcttgcaaggtttttgtgagcattaaatgaagacaatgcatgtgagttggaataacatccacaattaatattagttgagcatttatgacatgtattgactcacttaaccctcaagataatcttttataataggtattattcttatctccatatgctatatgagaaaatgaggcacacagaggttaagtgacttgcccaaggccacatttcttgtgaatggctgagcagtattcaacccaaacgtgctggttaagagctctgaatcacagcattgtgacgcacctagctcagtgctgagcgcagggtaagtgctcagataatgggagaccctttctccattccaattccatttctttggagaccttagcatccagtatttaggatagaattgaagcagtggaactagtgttgaagagggccacatttgatggtacagattagagcagggctggaagcccaatcagggaggtaataatggtaaaaattcggctggatgcggtggcttacgcctgtaattctagcactttgggaggccaaggtgggcggatcacaaagtcaggagttcaagaccagtctggtcaacatagtgaaaccctgtctctactaaaaatacaaaaaattagccaggtgtggtggtgtgtgcctataatcccagctactcaggaggctgaggcaggagaatcgagtgaaccttggaggcagaggttgcagtgagccgagattgcgccattgcacttcagcctgggcgacagtgggagactccatctcaaaaaaaaaaaaaaacaaacagtcaaaaatctatgtagatcagagatcaggaagacagtcagggtctggatgccaatgaaggagggtccagcaagacaggtgggctcaggaattaaagactcacaggaacaggaaaagctaactaggggaccccttagtcaccagaggctttttatctcagccccagagctttgctgtggtttctgttaagccaggaacccattaaagagtggctgacctgggctctgcagaagaaggggttaggattaagggaggctatggcttctggtgagcatctgtgttttgacattgactaagtcttgatggtgataatcttgattcattcattcaatacatgtttataacccagtggagatccttccttccttccttccgactttttttttgtacagacagggtcttgctatgttgcccaggcttgtctcaaactcctggctccaggtgatccccctgcctcagcctctggtagtgttgggattacaggtgtgagccaccatgactggctgagaaacttatttttttagcagtagattctaccctcccttagtatctgcctcacctttcaggagacctgtggaggtgggttgtattagtttgttttcatgctgctgataaagacatacctgaaactgggtaatttttaaagaaaaagaggttgaatggactcacagttccacgtgatggggtaggcctcacaatcatgacagagggcaaaaggcacatcttacatggcagcaggtaagagagaatgagagccaagtgaaaggggaaagaaaccccttataaaaccatcacatgtcgtgagccttatttactaccaggaggacagtatgggggaaactgcccccatgattcaattatctcccaccacatccctcccacaacatatgggaattatgggagctacaattcaaggtgagatttgggtggggacacagccaaaccatatcatgggtgaacatttggatctactgcttgggtaagaatgagtgtgagcattaggtttgaagagcagtggatagatggttgtactccattaaccagacaccaggctcttatttggctgagtgggttggcactctgaggctgaaaatggaatagttttgagacagtagaacatattttttagaggctgagatagagagacaggaagagaaggaggaaaaacaaagtagctggcagagagaggactttgagggaaaagaagataaatatttaaaggaagttttatgaagttttcccatgttatgcacaatgtaaactttctttcttgtctccccaagaatttttcagtaaaatagacatttcttgttaatgttgatagggagaagaggcagggaaactctgggcagaagagggcaggtccctggtgagggttccaccctcaagcctggaaccttggctcaaagtgagaacttacatccctgttttcctgcttgaatgttgccttttccaaaaccacccatggcctgtctcacccctccatcctgtgcccataaaatccccaggctcagctggcagagagaggagaagcagctggatgtcagagactatggctggacattggagagaagtggcttgacttcagagggacagcttgatgatgtagctttggagaaaagttcagctgggaatggccagatttcaggggaagattaccttcccactctgtcaccttttcagctccccttcccattgaaagccactttcatcagcaataaaatccccctcatttactaccttcaatttgtttgtgcaacctcattcctcctggatgccagacaagaaattgggtgcaggtgtaaaaggctgtcacactgaccctccaccgagctgttaacacttaagctgtcctcagacgacaaagctaaaagggcactgtaacgctccttctggggcttcaggggtcacaggcacttccccctagatgctgctgtggggccacatgaagttttgcttctgctggtgcccaaaagtactcgccctggctcctgcacccactcacctgcatgctccccctcccatgatgggtgaagcccagcaggtctgagtgagtggaattcactcctgtcagtgctgaagcagctggctagttccactgcccctgaactccagttcccacttgtgaaggggtcagggaaatattctgcttcaatgtgttgtagagtttaatttcttttgaggacaccttgaaatacttagtgggattggaatgaacacaaagtcacccaccaggattttgccacattgggtcacatatttttggggcacctcctatgtaccagacatgatgccaggtactgaggtgacaaagatagctaggacatggtctctgctctcaagaagtgtaaagtcttttgggagagcaggtgtggaaacagattagagtggaagacctttaatctagaaggctgaacatcagagttattctaaaaggatattaaaaatgatcacttgcataaagacagacatatagaccaatggaatacaattgagagcccagaaataagcacacacgtatatggtctaatgatttttaacaagggtgccaagaacattcagtggagacagaataatcttttaacaaatggttttggaaaaactggacatccacatgcaaaaaaaaaaaaaatgaagttgaacccttaccttacactatatacaaaaattaactccaaatagttcaaagacttcaatgtaagacctaaaacgataaagctcttagagaaaagtaggggaagccttcatgacattggattttgcagtgatttcttggctatgacaccaaaagcacagacagcaaaagaaaaaataaatcggactacatcaaaatttaaaacttttgtgcatcaaaggacataatcagagtgaaaaggcaatcatggagtggggaagatatttgcaaatcttatgtctgagaggggttaatatctggcttatataaagaactcctaaaactcagcaatgacaaaaacaaacgactggatcaaaaatttggcaaaggacttggatagacattttttgaaagaagatacataaatgtccaataagcacatgaaaagatgctcaacatcacaaattaatagggaaatgaaaattaaaaccacaataagacagggttctctaacccctgttaggaactgggccgcagagcagaaggtgactggctggtgagtgagcattaccacccaagctccacctcctatcagatcagccatggcatcagattctcataggagcgcaaaccctattgtgaactgcacatgtgagggatccaggttgcgtgccccttatcagaatctaactaatacctgatgatctgaggtggaacagtttaatcccaaaaccatctccttgcaacctcgtccttggaaaagttgtcttccgtgaaacccgtccctggtgccaaaaaggttgggaaccactgcaataagatacaaccttacacccattaggatgggtactatccaaaacaaacaaatagacactcccctgcccccaaaataataagtgttagtgaggaagtggagaaattgaaactcttgtgtattgttagtgtgaatataaaatggagcagctactgtggaaaaaagtacttaagttcctaaaaaaaaaataaacagaattattatatgatccagtaatttcacttctaggtatatacaaaaaataattaaaagcagagactccaacaaatagttataccaatattcatagcagtattactcataatagccaaaaggtaaaagcaactcaagtgtccattgatgtatcaaattttgttttaaaacttgatacatatatacattagaatattattcatccttaaagaggaaggaaactctgacccatgctaccacatggatgaaccttatgaacattgtgctgagtgaaataagcgagtcacaaaaagacgaatactgtaagattccatacttgtatgaaatacctagagtagtcaaattcatggaaacagaaagtagaatggaggctaccaggagctggggtaggaaggatgggaagtttaggggatccagagtttcagtttgggatgatgaaaaagttcctgagatggatggtggtgctggctgcacaacaatgtgaatggcttaatgccaaagacctgtacacttaaaaatgattgagatggtagatcttgtgtgtattttaccacaagttttagaaatttaaaaaactttaaaaagtgattactcacttaaaaatcacaccaccgtaacgactgacaacattttctactacgaagggatggtgcaatccagggggctgtgaatgacctgtgggtaaggtcctagctgcccagtaaaggcaggttgtagtggacaatgtccaaacattgcaacagatttgtagcaactgaagttgtaaccggttttggacattcatctgttttggcaggtcatatgactttagtttgatcgttgtggtcttttgttattaagatagccatattccagaacgactataattccagaatggagcaggtctcagaccttccatgcacattatcttctgttgtgatgacaatgtgagaaatgccataaaagatagagataggtgcagggtacctatttgttcattcattcttgagacaggacagaggtgtaaattactgcttctttgctacatcctctgccacgctgtgcttttttcttagtgcatcatgctttggctgtagggtttttcatcttattaatggggcactttatgttcaatggggaagctaattttcctaagttgggttccctggagaacagaccccaaagtggagatctgtgcacaggtttatgagacacctctcagcaacaacaactgtgagggagtgagggtggcaggcttggaagaggcctcagccaatcccatgggaagttctgaaaccgggagggtccttctgaattatccacagggaggtaagggggtgggatcctctgccccatggtctcggacataggctgtcctggggagggagaatgatctggggtgagataatgctccttggctcaggacagtgcttgaggagtgttttagccatgagacctcaatagccaacactttatttatttatttttttgagacagggtctcgctctattgcccaggctggagtgcggtggtgtgatcttggctcactgcaacctctgcctccctggttcaagcgattcttgtgcctcagcctcccaggtagctgggattacaggcgcatgccaccaggcctggctaagttttgtactttcaggtagaaacggggttttgccatgttttccaggctgtcttgaactcctggcctcaagtgatctgcccgccttggcctcccaaagtgttgggattacagtcacgagccactgggcccggctgatagccaacactttaggcatttgagggagtgtgagccttagtccaaaagcccaggcaatgaaagaaaaacaaaacaaaaatcctctgcagggggatctgggcagcacagcatacacatacatgctgtaccagtcttctgcttttgtcttcagcggttattggtaccagaggtaaggcatttccgggaaaggcagcacagaacagtaccagaagcataaacaggaattgacttaaaaaaaaaaatctcttgcttaaataataacagtaaaaatggaaaaaagaaggatgaaactcccacctcccttctgaattacttgttttcacttgctgtgttattgtctggtcaatatccatctgtactcatcaattttacacacttatgattataggtattgtgtatatgtgtgtatataatatttgtattatgtgtatgtatataaaagtgatacttcttttgctgatcacagtgagtttttttaaatgagttaaatttgatagagagaaacagggatattaaatgcacaagtcgattagttttgataagcgtatgcacttgggtaactaccaccccagtcaaggtaaacatttccattactccagatggttcccttgggaccctttctggtcaatctccacccccataggccactattgttctgatttctatcgccatggattagtgttgtctgtttttgaattttacattaaaggaagcagagaggattgactcttttgatacacatatatgtaaagattgacttttttctttccataatactactaatgtgttttttctaattataaaatatgtatacttttattatcaatattacacaatacagattaatattatgcagccttcaaaacaactgtgctcagacccatttcctataggtgtccactgaattttggtatattttcttacagtggttctcaaagtctagtctccagactagcaatgtcagcagaacccagaaagcaaaattttcagccccaccccagatctactaaatcagaaactctgggggtgtagactagccatgtggtttaagaagccctccagatgttcctgacacatcagtatttgagaaccgtttccttatgatttcctccctccctcccttcctccttccttccttccttccttttcccttcctccctctgtccctccctttcttccttccttgccacatttttgtattctactttttcatatgacaccttattagaaacattactatgccatgacaggtaatgagttaatttattcagactaggaaaaactggtgtggtatttaagtgtagaaatcagggtagatatggcctgattggccttttgccctctcttgggataactgtttcccagcctgaccacatttgtgaaaggcctccttactccctctcatccccacacagcatgaggatgctggaaatgtttctgggtggagaggttcaattgtatctgggaagacttacaaataaaccttgtctcatttatagcaggtgaataagaactttgtccaggcaaataacacagaaggctggcacttgtggttcccaaataagaattggtcttgaggagtctaggtgggtggacatggatgtgccagtttcaggggagacatcctgaaggaaagatcactatgtggctctgcaggagacactgtctgggtccttggttgtggtagaacaaggaccccttctcttgcctcataatacagcactgccggggagcactgtgtccactagtggactccagactggcaggcctgactttggtcctccttgggaagtgcctattgactcttcttgttttcagatgacatttgttaggctgaaagaggagaagggactttatccacaatcatccccagagtatagccttccacacaaaggctttctattcatcctgcaagaaatgacctttcaagatatgacctgtgagcacccagagattggggaagtgacttgcccaaggtcacacagtgggcgtgttccggccaacactgagattccaatcctaatcacctaactccaaattctgccgtctttccactctgtggtgctgcctcctggagcaggcaaggttttgttcttcttcacagtggacagggcagtaggaaaagggacagcgttggatgtctcagggagcaagaggcacctatatcagaacttctggggaaaaggaaggaagagaacatgaaatgcagtgtgacgtagtgcaaaaatgagtgggttctggggccagtgtgacctgatttacaatcagagctgaggttcttacgggtcgtgtgatgtatcagttattgattgctgtgtaccaaattacccttaaacttagcagcttgaaaaaacccacacatttgttatctcagagtttttgtggatcaggaatccaggtttgccttacctgggtcctcggcttgtgggtctcttacaagactgcttttgatgtgttggctggtgcctggtgctgaggtctcatatgaaggcttaactagaatgatgctgtcttagtctccccaggcttctaaaacaagatgccatagactgggtggcttaaacagcagacatttcttttgttacaactttggagcctctcagtcggaatttagaggccagctaggttctggtgaaggctgtctcttcctggtttatagacaattgcctccttactgtgtcctcatatggcagagagaagagagaggggggaagagagagagagaaagagagagagagagagagagagagagactcttctctctggtctcttcttataagggcactaatcccatcctgaggctccaacctcatgacctcatctaaccctaattatctcccagaggccctatctccaaataccatcacattgggggttatggcttcaacatgtgaatctggggaggacacagctctgtccatggcagatctgcttccaggctgactcacatggttggtggcaggattcagtttctcctgggttgttggatgagggcctcgggtccttgcttcctgttggtctgaggccatccttgcttccttccacaggggtctccccagcatggcagatgatttaactcttctgaatcccttcaacccttttaacatgtaaaacagcaatagctgtagctatcttagagttgtcatagggattccctgagataatgtagaaaatggccttgcacagaaaacggcaccttgttggggcttcctaaattgcaactgttattcccattattataatttttagggtacctgatactcagaagcttggctgttgtccagacagcatatggagatatacccctgtcccctgctataacacaaagacttccccaggtgaaggacaatttctaagtaccagagaaaatacatctgagactacgtgactggcagttcccagaggtgtgacctgggaaatacaatggtcgcatttattgtcccttcatgataaaaacaggactcagcttctcagagtaggccccagagtgttcttcacatccttgggaacaaacccaactgcaaccgctgcctgcggaacagcctcaactgcacccacaacatccagaacagaccccagctgcccccacggcatccagaacagaccccaactgaaaccactgcatgtggcacagcatgaactctctaggaagtttaacttgagccacttttgtagttgatctcatctctcaaccatcatttctggtttttatcccatatttgttaatatctgaaagcatctctgtctgctgttttcccagccaatcctgggcacaattaacaaggtgttttccagaggccttgggagctatatctttctcagtcatcatttggggccattacagggggaagtagaagtcttattgctgtgggataccatagatgtcctaaatcctcgctgggtagaaacaagaccagactgaatgtctgttctgaattatctttctctgcttaaatggagtccaggaggaacccttacttgcaaaatatatattattcagcccgatgctgcgttcatttcctaaaagagattgggtccaaataacactttaattgaattcagtttcttgacctaacactgacttggttctccctcctgtgtcttccaacattagacagaggaggaggaggaggaggaatagacaaagcgattcacatggatttataggccaagccactcacttccacattccataaagcccaaatgactgtataggaaacagctgcagtatttattggggcctggtaaggcctcattaccatcccacctcctcacagggggtattgcctccaaatggagtgcagtggagggagtaattgactctgctgccctggcacctggtgtttctgccaaatgcctaaggtcagtgctgcaaaaaaaaacccaaaaaccaaaaccaaaccaaaacaaaacaaaaaaaccggatggaaggaggcctccagtgagagtggggagtggagccgagagatgatcagaagggatttcatttgtttgtatttttcttccctcacataaggaatgtttattgatcacctattatatgtcaggcatagttgtaggcactggggatacaagaacagacatggctcctgctgtcttagaacagacactctaggtggctctgcctaaacaatgatcccctgccacatgtggctatttagattttttttttttaattattatactttaagttctgggatacatgtgcagaacatgcaggtttgttatgtaggtacacatgtgccatggtggtttgctgcacctgtcaacctgtcatctacattaggtatttctcctaatgctatccctttccttgccccccatgccatgacaggccccagcatgtgatgttcctctccctgtgtccatatgttctcattgttcaactcccacttatgagtgagaacatgtggtgtttgcttttctgttcctgtgttagtttgctgagaatgatggtttccagcttcatccatgtccctgcaaaggacatgaactcattcttttttatggctgcatagtattctgtggtgtatatgtgctacattttctttatccagtctatcattgatgagcatttgggttggttccaagtctttgctatcgtgaatagtgcctcaataaatatacgtgtgcatgtgtctttatcgtggaatgatttataatcctttgggtatatacccagtaatgagattgctgggttaaatggtatttctggatctagatccttgaggaatcgccacactgtcttccacaatggttgaactaatttacactcccaccaacagtgtaaaagtgttcttatttctccacatcctctccagcatctgttgtttcctgactttttaatgatccccattctaactggtgtgagatggtatctcattgtggttttgatttgcatttctctaatgaccagtgatgatgagttttttttttcatatgtttgtaggccgcataaatgtcttcttttgagaagtgtctgttcatatccttcgcccactttttgatggggtttttttttcttgtaaatttgcttaagttccttgtagattctggatattagccctttgtcagatgagtagattgcaaacattttctcccattctgtaggttgcctgttcactctgatggtagtctcttttgccgtgcagaagctctttagtttaattagaccccatttgtcaattttggcttttgttgtaattgcttttggtgttttagtcatgaagtctttgcccatgcctatgtcctgaatagtattgcctaggttttcttgtagagtttttatggttttatgtcttacatttaagtctttaatccatcttgagttaatttttgtataaggtgtaaggaaggggtccagtttccgttttctgcatatggctagccagtttttccaacaccatttattaaatagggaatcctttccccatttcttgtttttgtcaggtttgtcaaagatcagatggttgtagatgtgtggtgttatttctgaggcctctgttctgttccattggtctatatatctgttttgataccagtaccatgctgttttggttactgtagccttgtagtataatttgaagtcaggtagcgtgatgcctccagctttgttctttttgcttaggattgtcttggctataccagctctttttttggtttcatatgaaatttaaagtagtttttttctaattctgtgaagaaagtcaatggtagcttgatgggaatagcactgaatctataaattactttgggcagtatggccattttcatgatattcattcttcctatccatgagcatggaatgttttttcatttgtttgtgtcctctcttatttccttgagcagtgctctgtagttctccttgaagaggtctttcacacccctcgtaagttgtatttttaggtattttattccctttgtagcaattgtgaatgggagttcactcatgatttggttctttgtttgtctgttattggtgtataggaatgcttgtgatttttgcacatggattttgtaacctgagactttgctgaagttgcttatcagcttacagagtttttgggctgagatgatgggattttctaaatatacaatcatgtcatctgcaaacagagacaatttgacttcctctcttcctatttgaatactttttatttctttctcttgcctgattgccctggccagattttccaatactatgtttaataggagtggtgagagagggcatccttgtcttgtgccagttttcaaagggaatgcttccggcttttgcccattcagtatgatactggctgtgggtttgtcataaatagctcttattattttgagatatggtccatcaatacctagtttattgagtgtttttagcatgaaggggtgttgaattttatcgaagaccttttctgcatctattgagataatcatgtggtttttgtcattggttctgtttatgtgatggattatgtttattgatttgcttatgttgaaccagccttgcatcccaggaatgaagccatcttgattgtggtggataagctttagaacgtgctgctggattcggtttgccaatattttattgaggatttttgcatctatattcatcagggatattggcctgaaattttctctttttgttgtgtctctgccaggttttagtatcaggatgatgctggcttcataacatgagttagggaggagtccctctttttctattgtttggaatagtttcagaagaaatggtaccagctcctctttgtacctctggtagaattcagctgtgaatctctctggtcctgggctttttttgttggtaggttattaattatgcttcaatttcagaacttgttattggtctcttcagggattcaagtttttcctggttgaggcttgggagggtgtatgtgtccaggaatgtatccattacttctagattttctagtttatttgcatagaggtgtttatagtattctctgatggtagtttgtatttctgtgggatcagtggtgatatccccgttatcattttttcttgtgtctatttgattcatctctcttttcttgtttattagcctggctagcagtctatctattttgttaattttttcaaaaaagctagctcctggattcattgatttttttttgaagggtttttcatgtctctgtctccttctgttctgctctgatcttagttatttctcgtcttctggtagcttttgaatttgtttgttcttgcttctctagttcttttaattgtgatgttagggtatcgattttagatctttcctgctttcttctgagggcatttagtgctataaatttccctttaagcactgctttagctgtgtcccagagattctggtacttcgtatctttgttctcattggtttcaaagaacttatttatttttgccttaatttcgttatttacccaataatcattcaggagcaggttgttcagtttccatgtagttgtgtggttttgaatgaacttcttaatcctgagttctaatttgattgcactgtggtctgagagactgttatgatttccattcttttgcatttgctgaggagtgttttacttccaattatgtggtcaattttagaataagtgctatttggtgcagagaagaatgtatactctgttgatttggggtggagagttctgtagatgtctattaggcccacttggtccaaagctgagttcaagtcctgaatatccttgttaattttctgttttgttgatctgtctaatattgacagtggggtgttaaagtctcccactattattgtgtgggagtctaagtctctttgtaggtctctaagaacttgctttatgaatctgggttctcctgtattgggtgcatatatatttaggataattagctcttcttgtgcattgatccctttaccattatgtaatgcccttctttttcttttttgatatttgttggtttgaagtctattttatcagagactaggattgcaaccactgcttttttttttttttttttttttgctttccatttgcttggtaaatcttcctccatccctttattttgagcctatgtgtgtctttgcacgtgagatgggtctcctgaatacagcacaccgatgggtcttgactttattcaatttgccagtctatgtcttttaattggggcatttaatccatttacatttaaagttaatattgttatgtgtgaatttgatcctgtcattatgatgctagctggttattttgcgtattagttgatgcagtttcttcatagtgttgtggtctttacattttggtatgtttttgcagtggctggtaccagtttttcctttccatatttagtgttttcttcaggaactcttgtaaggcagccctggtggtgacaaaatctctcagcatttgcttgtctgtaaaggattttatttctccttctcttatgaagcttagtttggctggatatgaaattctgggttgaaaattcttttctttaaaaatgttgaatatgggcccccactctgttctggcttgtagggtttctgcagagagatccactgttagtctgatgggcttccctttgtaggtaacccgacctttctctctggctgccctaaacattttttcctgcatttcaaccttggtgaatctgaggattatgtgtctttttttttttttttttttaaatatatgaggagtatctttgtggtgttctctgtatttcctgaatttgaatgttgacctgtcttgctaggttggggaagttctcctggataatatcctgaagtgtgttttccagcttggttccattctccctgtcactttcaggtacaccaatcaaacgtaggtttggtcttttcacatagtctcatatttcttgggggctttattcgttccttttcattcttttttctctaatcttgtcttcatgcttatttcattaagttcatcttcaatgtctgatatcctttcttctgcttgattgatttggctattgatacttgtgtatgcttcacgaagttcttgtgctgtgtttttcagttccatcaggtcatttatgttcttttctaaactggttattctagttagcagttcctgtaaccttttatcaaggttcttagtttccttgcatttagttagaacatgcttctttagctcagaggagtttgttattacccaccttctgaagcctacttctgttaatttgtcaaactcattccccatccagctttgttcccttgcttgtgaggagttttgatcctttggaggagaagaggcattctggtttttggaattttcagcctttttgcttcggtttttcctcatcttcatggctttatctacctttggcctttgatgttggtgacctttggatggagcttttgcgtggacgtcctttttgttgatgttgatgctattgctttctgtttgttagctttccttctaacaggcccctcttctgcaggtctgctggagtttgctggaggtccactccagatcctgtttgcctgggtatcaccagtggagactgcagaacagcaaagattgctgcctgcttcttcctctggaagctttgtcccagaggggcacccgccagatgccagctggagcactcctgtataaggtgtctgtcaacccctgctgggaggtgtctccccgtcaggaggcacgggggtcagggatccgcttgaggatgcagtctgtcccttagcagagctcaagcactgtgctgggagaaccactgctctcttcagagagatttctctgtgatttcttcacttcagagctgtgaatcttcacttcagagctggcaggcaggaacgtttaagtctgttgaagctgcgcccacagttgccccttcccccaggttctctgtcccagggagatgggaattgtatctataagccgctgactggggctgctgcctttctttcagagatgccctgcccagagaggaggaatctagagaggcagtctggctacagtggcgatgccacgccgcagtgggttccgcatcgtttgaacttcccagtggctttatttacattataaggggaaaacaacctactcaagcctccttaatggcggacgcccctccccacaccaagctcagcatcgcaggtcgactttagagtgctgtgctggcagcgataatttcaagacagtgaatcttagcttgctggactccatgggggtggggtccacttagcacaatcactcggctccctgtcttcagccccctttccatgggagtgaacggttctatctctctggcattccaggcaccactggggtacgaaaaaaactcctgcagctagctcagtgtctgcccaaattgccacccatttttgtgcttgaaacccagggccctggtggtgtaggcacccgagggaatctcctggtcggtgggttgcgaagacaatgggaaaagcatagtatctgggctggatagcactgtccctcacggcacagttcctcacgacttcccttggctagggaagggggttccctgactccttgtgcttcccaggtaaggcgacgccccaccctgcttctgcttgccctctgtgggctgtacccactgtctaaccaggcccaatgagatgaggtgggtacctcagttggaaatgcagaagtcacccgtcttcttggtctcgctgggagctgcagatcagagctgttcctgtttggccatcttgccagccccacccctggcccccagctatttagatttaaactcattaaatgaagccaacctaaaaattgaattctgcagtcacacttgccacattttaagtgctcaatggccacctgggactagtgacaatcgtattggacagtgcaggtacagaaaattttcaccgatgcagaatattctcttagacatgttggtctagtggaggtggggtgtggagagtccagaaatagtcattaagtgaacaaacaaatatgtagctgggtgcagtggctcatgcctgtaatcccaacattttggaggccgaggcaggaagatcctttgagcccaggtctttgaggccagcctcagcaatacagtgagaccaccaccatctctacaaaaaaataaaaaaattagctgggcacctggtgtttcaggtcacacctggtgtttcagtatgatctgtagtcccagctacttgggaggctgaaaggggaggatcgcttgagcccaggaagtccaggctgcagaagtctgtgatcatgtcatttcactctagcctgggtgacagggcatgaccctctctctaaaaaaaaagaaaaaattacccactccccaccaaagtaggtaaataagataacttcaaatgtggtagccatatgaaaaaaaagaaacagggaaatgtgctggagtagtcgtttggttagggtggtctgggtgggcctgtgtgagaaggcgacgcaggagccaggacccggggaggatctgaatgaatagcaagtgctgggagcactgcagaaatataagaaggccaagcatggcccggagtagggagcaagagggagagaagcaagagatgggcttaggagcgaggcggatgcccaatcccgtgggctcatggggaggagcgtgcattcaactcttaagtgcgaggaggacatcgcaggctgcccacgggaaattattatgatctgattcacacgtgaaaagctcactcgggttccagggttgatcgcaaataggagggaggcacgatcagagacagagggaccagcagggagctctaaagctgttcaggtgggagaaattgaggccttgggatcacggagaaagggcagtagctaaccctagagggaggcagtattcgtgttgtagctcaattctgcatccgaaaatacagggggcaatgatagcacctggtatgtggtgccactgataagaggatgcagagagctagtgtctataaagtcgccagtattttcagtatgatggtacgtggcatcatcttgtctaacccatctttgtctctcaaaatattttctagctccttgtcttgcctgttctagtctggtttccacactgccactagagtcaccttcctcaaaggccaatctgatgtcagttcccttcagggctcctgggggaacccagatgaaactccgagcttgttaatacagcctaggaagcttctcacactccagcccatgtctctgtccagcatcacctctcccactctctgcctggcactctgctccagctataccaattgtccccttggctcatgcagttcccttagctgggaatactttccctcccctacttgggtgggttctctccagctgtttgtctttctaagctcagcttagaaattttcgcctccaagaaaccgcttctgtgtttccaagtctaggtcaagtgcccttacatgagatcccatgggaccctgtgcttctccataatgttgaattacaattgcctgtttaccagtctcttccattaaactgaggtcttcacaacagtaggaactatctctgtccagttcatgattgtgcatatctcaatgcctagactatatcgagtgcttaagatatattttgtttaggccaagtgtggtggcttatgcctataatcccagcactttgggagaccaaggcaggtggatcacaaggtcaggagttcgagaccagcctcaccaagatggtgaaaccccgtctctactaaaaatacaaaaattagccaggcgcggtcgtgggtgcctgtaatcccagctactcaggaggctgaggcaggagaattgcttgaacctaggaggcagaggttgcagtgagccaagatcatgctactgtgctccagcctggacgacagagtgagactgtctcaaaaaaaaaaaaaaaaaaaaaaaaaaggagctattttgtttaatgagtgagtaaatgaattcgtaaaaatcatctatttatagcatttggtagaccactctcttttcctatgcccttcttttgcacattgttattattatttttttcaaacaaccattatttaggcttcctaacctgaatgtgttagcttagggtgccataaagaaataccatatacttgggggcttaaaaatcagacatgtattttctcacagttctggagggtggaaatctgagattagggtgccagcatggtcaggttctggagcagtctcttttcctggctttcagatgaccatcttctcaatgtgtcctcatagggcagagagaaagagagagagttcgctttggtgtcttccttcaaagggcactaatcccatcataagggccccatcctcatgacctcatttaaccctaattacctcccacaaaaccatttccaaatagcatcacatcgagagtaagaatttcaacccatgaattttaaggggacacaagcattcaatccattgcataccccatgctttagaattaaaaaaatataaggtgtaaattattttgtgttgggctttcataggggcaatatataacacctttctttcccatttaggttctgaactaactgaggaatagataaagaatgtagacagatggagattttaacagatgcttatgtggcacttactgggtgccagctaacaacttgcccaaggtcacacagcttatcagtggtggagccagggtttaaactcagctctagaatctattcttgttattctgtttcttaaagtgtaagctttaagctagattgcaggacatggtaggtatgtgtccaccaggccagttaactctccatcaccgacttagactctcccaggcagttgcagaaccagaggtctcctccacaggggcagaatgcaggcggagctgaaaagagaagattaatgtgtgaacttagtctctctcaaattcaccaatcagctaagtcacttttcctcccctggggaggagtggatgagggatggggagtggatggctggaaatgtgcatcagactaaggtctcatcaagggaacaagcattccctcaaacccagtggaagccatgctgcaaatatcagctctagaaactgttcttgttactctgcttctcaaagtgtaagctttaagctagattgcaggacatggtttaggtgcatatccacagggccagctaactctccatcagggacctagactctcctaggcagttgcagagccagaggtctcctctacagtgggagatatttaaagcctttcctgtcatcactggaaatgagcaaactttgctagcaatgtagtcaagggcttgggtgtttgaagtctttacttctgttcttccagaattaggatctggggctcagctgtgaattgctgtcactgaagctgtccagtccttggacacacacgcagacatgtgggctgagtaatgggaatgttcttagaaagccagaggaccttggcagcattgcccagcagctccgtgacaggtcctgatggctgagagactgatttcccatcctttcctaaggaagcggggactggtgaacagagcatgtgtgaggcctgtgaggttcctgtgtgcattgcagggtctctcggtagagcctggtacctgggtggatgggagaacaaacaccagatgcagggtcaggtgacttgatttcttgcccagctctcccatttgttgtgagccatgggatgctgggaaagtcattcagcctccctgtgccttcatttgctcaactgtaaaatgggaaaaatataacctatctcaaaggactgtgtgaggatcatgatactaaatgagaagatgctttataagtatcaaggctggataatttcaagctattactccatcttccttctttcctgcattgttttcgttagcagacacacgttgactttgcccaacctcctctttctggaatagcaccctgatcctcctttgggagctcctggggctcacctcttggggccatgtggattgttcgggactgactccatcccaaagtgccagggcaagcccactctacaggcctggccaagcagaacacccctggctccagcgattggttcagggatagccaggggccccagcaggggccagctgaccattccaaaacttttgctggaactcctgggagagactttgccttccttgccaggattgccaacctgtgagaatgtaagcttgggggttttgggggccatctttgccatcttacagggagagcctgccaccatacagaggcagaatggagagcaggaggaagacacagtgtcctgtgggcattgttagagcccgtgtttccagtcatgcctgacttgtgttcattatgagtgaggtgggctaacatttcatgtgtatttccctttctgtgagctgctgtttatatctatatctttaattgacttttctactgggtggttggcattattctcatagatttgtggaaactttcttttcttttagtagttattctttgttgaggtcaaattcacataacataaaatttaccattttaaagtgtacaattcagtggcatttagcccattcacaatgttgtacaactgtcacctctgtctagttccaaaatctacctttctttcttcctttctttctctttctttttccttccttccttcccctttctttctttttctttttctttcccctttctttcttttctctttctttctttctttctttttctttctctctctctttcccctcccttccttccttcctttcttttctttctctctctctttctctctctctctttccttccctccctccctcccttcgttcctctctctctctctctttttctttctttctttttttcagagccttgctctgttgcccaggctggagtgcagtggtgcaattgcagtcacagctcactgcaccctccacctcttgggtgcaagtgattctcccacctcaacctcccaagtagctgggaccacaagcatggaccaccacgcttggctaatttttgtttattttttgtagagaagaggtctctctatgatgcctagactggtctcgaactcctgagctcaagcgatcctcctgcctttgccccacaaaatactgggattacaggcatgagccactgctcctgtcccaaaacattttaatgatcaccaaagaaacttggtacttcctattaagcagctactgcctgtcctcgctctttctagcccctgacaaccactcttctgtgaccatagagatggaatttcctatggatatatctattctggatatttcatataaatggactcatataatctgtgtatttctttgacttagcataatatttttaaggttcctccatactgtagcatgtattggtacttcatttctctttatggctgagtaatattccatcatatggatatgccattttttgtttatccattcattcaaacaacatttgggttgtttctatcttttggttgttgtgaattgggctcctacgaatattcatgtatgagtatttgtttgaattgatattagaaaaattattctttggcctatgataggtgttgcaactattgtttctgagcttgccattggtctttgactttgcttttgtcaagcagaattttgtaagtattgttctgtggttgaatttgtcagcttttccagctaatgggttttgtgacacagttggaaaggtcatccttataacttgaggttataaaacaactgtaccatcaaaacctctgcttatccacgtatttccttaccaatgaaacaggtattgaaaacagccctacttgccattccgtcccctcccagggttattgtgaggaccacatacgacaaatgatatgaaagagccttacaaaatataaagcaatatatacacattaggcatgttgtcatcatcactattaattctattaaaatctgccatcaactagctgagttctgcttgttgctttcattttgcagagcagggcttgaagggcagaattattcactgagctgcccaaggatgtatttgctggtagcaacgtggagaatgttacaaaattagtcatctcggcgagggggaggtgttcatattcgaccagaaaaataaaagtactttcaaccaaaaactattctggccacttttccttcagatgaagccttttttctttctaccaggaaaagaaaccggttcagtgagttttgcattgtttagctgttattgtaatttatgcctcactagtggtcacttgtgacatgttttccttatatttttaaccccaaattctttttttaaatggaaaactttacgttgaactccgtattgaaacaatgtaattatagggaatgaaaaaatgggttattacttgatagcaattattcctatgctgattcctccgggatagaatcgtgcactgtttaagtccttgggctccgctatgagccatacctgggcttcagtgcaattaagttactagctagctttgtgatcttgggtaacttgcttcactgctcttggcctccgtttacccaacttcaaaacaaggatgatttacatcactggactcatggggctgtagcaaaaaatcagtgataaaatctacatagagtgcttggccctgtgcttgtgtgcagggagaacttggtaaatactagctatcagtataatttaggaaaatctaaaagaattcaggagatgagccccaaggaaatggaataaacacttccaggggcttttctggtccttagtgggtggcatagatcaaatcacatggtagaggccctcccctcacacctaccacatttatttggagacaaatctggtttctgttactaccatgtgaagggtaaacattgggaatagcagttggttctcagacagcaaggaaaaagtgggctcacagaggaggagtcacaggagggcagcgggagggctggggtgggctgtggggaggactggaagggtgaggacctggtgctgggggcctgcccaggtcacacccacatcttcttggggatagaagattccagatgatgtgggtttattgtgtgtggtgatggatttttcaggggacacagaccttttcctcttttttttcctctcttccttttcccaatctgggtatctgtggagaccaagctctagtcctaggtctggcttggctgggccctgtattagtccattttgcattgctgtaaaggaatacctggggctgggtaattaaagaaaaaagttttatttggttgggtgtggtggctcactctgcaatcccagtacttcgggaggctgaggtgggagaattgcttgagaccagcctgcccaacatggtgagacccccatcttgagaaaaaaaaaagttttatttggctcatggttctgcaggctataccagcataacaccagcatctgcttggcttctgatgaggcctcaggaagcttccaatcatggtggaaggtgcaggcatatcacatggtgagtgaggaagcaaggaagaggagcgaggtcccagactcttcatcaaccagatctcttgtgaacccattaccgtggggtggacaccaagccattcctgagggatccatccccatgatccaaacactgcccaccagatcccacctccaacgttgaagaacacatttccacagctctaaaaaagaaattatgtctgtgagacttctgctctatgccaggcactttaaatccatgatcgtgttggatcctgtgccatgggtggatcactaccctatgacagatgaggaaaccaagactcagagaaggtgtattcctccatgagccccacacacagctggtgcacagcagagccagaaggtaaaccaccatctgacttactccaaaacccagcctctgccaggtgtcagctcagagcgctataccatctttggccttggttttgtatggctttttgtgacatttttgtgacatttccatggctcagcaccctacacataggtctcctagaactatttgtggatttaaaattttaataatggtgaaaatagctgacatttactgagttcctgccaccagtgggcacacaagcaggttgagccacttgctcaagttctcatgagctcaaggctcgtggcagagccaggagaggatccagtctgtcgtactccaaggtgtatggttttaactttcatttttcttgaagaatctagacttgcagcagggatgttaatctctgtgcccatctttctcaggtaacgtggggcttttgtgggtttgaactagttagaagaggacagcaaagggcctgaacatgtccaggggaggcgtgaggcagtggggtgatggcaagggctgcgggccagtggcatctatttctgaactggtgacctcctgcctccgggtacaaggctataataagccccatgattcaccagttggacttctccctgtcgttgctccaagcaggtcttgtgctttgccacctgtgggccccagctcatgctgtgtgctccaggagaacatcctgccccgcctcactccctttgccatacttgcctggggacgcccactgcagctgccatgtcctctaggaagccttgatggactagcatggataacctattcatttctgagtccaaacagaatcatttattatagactcagaaaaaggcaaatggaagactatacctattttgagaaatttgggaacatttatctcaggggacagtcaggggccaatacacattagtgacaatcttagcatatgaaattccagtgatcagcgactctttagtgcttgactcagtttttacagaatgaatcttattctaccttaattccacatgaaatgggtttggtctcccttgtagaatgcaggagactttgagcctgggttggaaggctggtgaccttgggtaagtcacttcccatatctgagcctctgctcctttgtctgtgaaagagtggtgcttatacctatgttgttaggttgttgggggatataaaagggtaataacagttgctactgtttattgagtgcttgctatgcaccagagactgtgctaagcttagctttgcatttttctttgatcttttcaagagctcctctcattcccgatgttccttaccctgcaatattttttcccatagcactttacattttgtatgatattatataatatacttactgtgcttatttttggtcttcctctcccagggcctcttgcctcgtacaactccagggggcaccattcacaatgctttctactccaggggtgctttttactaagaatattagcatgaatggtggaaactgctggagttgtgtgatgtggagccccgggagcttcagaaggtcagggatttttgtgtgtgccagttctgatcattgctgtatccctgtacccagaacggtgctagacctatagtaagcattcagtaaatatctgttgaaagaatgaataacatagcctccaaagagagctgattttactatctaggaaactgaggctcagtctgacttatgaatttgcccagagccccacaagccaatgacccacccagctgttctgcctccagtgtgcctgctctgcgtggctttgctaagctgcatgcctttaactcctcgcatcgtctctgccaccaagtaactgctcaacaaatattgatgcttttccctacatgggtcaggccctctgctagactatcccagtagagtgacaaaccatcatatagctgttgattccagaaactgaattaaattgcacagtgcaaaaaaagggaggatcttaagtttttggaagaaaaatccctaacccaagtgctaatgtttggagtttgcagaagcctctcaagacttaccaacccgattacttttcctgctgccttcccttttgtgagcgtttcttcccctttttgcttgcagtgagttctgctctcctgtaggctacaatgtgtcagttgttataaaatccgggaggcggagtctagtgacgtgagcagtgggggagagctcagccagccctgcagggcgagcagtccagccttgtgttcaccggagcttaagcgttgcagcaggaaaacttccatctcgctctcctggctttgatcctcactggacatcagaccagaggcaccgaagggagggaggatgcgagatgaccggccctttggcaacctgaccatcgacttagcagagccttcaaaagcaagccaggggctggctgcacgaccaaagaggcgccgcgcctctcgtggatgtgtgtgtgtgagtgatccagcgagtgtgtgtgcgtgtgagggtgtgtgtgtgtatgcctgtgtgcacagcacaactgtgtgcgtgtcccggtgagtgtgcctgtgcatgcgtgagtgtgtgtacgtgtgcatgtgtgtgtgagtgcgcttggttattactattattattatttttggaagaaaaatctttgaaaatctggggcaggttactgtgctcctagggtgattcttcttttgcaagaggagctgaccagggcaagctactagagccatttctcggcaagtaaagagatttttccttccagaaggagaaggatttttctccctgctctgcagccaagtgaaagagattagtccctaaacctgtgaaatcgaccagagctgtgtgattaccagggcttgagagaggactcgaaaagaaaaggagaaataaatcaaacagcctgtcagttcctttggccacgtcagaagatgtcatctcaaactaagttcaagaaagacaaagagatcattgctgaatatgaagcccaaataaaaggtgagatgcgggctgggagagttttccttctcctcccctttcgtttttctcttgttctggttcccatcccccgctgccccccgttttcctctctgccattatgaaatgttatgcatcaataatctttttgtgaggagtaacagtggcagccgcacaagtccggactggtttcaactgcagatagcgctggggctgggagtgtggattatggaatgggcagcagtctctgcattgcaggtgtgtgaggaggatcctatgcctgactttaggagtgtcgctgataccccatcatcttggcggtgacatgtcactctaaggccattttgatagtcactacctccaccccttccctgccatggtaaaagccctttaatattggggtatttttttaccatctgctctttttttcctccccctttttggtttctgttggtggtggtggttttgcctccgcctctttctctgggccggaattcacatgcatgtgcacagcgaggcagcatccctgggcggcacttctttgtcggtgtctctgggctggcctgggttgccatggattaactgttatggggcatattgatccagactaatgcaggcatttgggcataaaaagggagcttggtgcagaaaatgtattatctcgcagtgtgcagcccaatcactctgtgccctggcgtttaggttcatcagctttcattcaaagccaacacctcggcatgccgtttgggctggtcagcgctgcctggcttccggggttccaggagaagcctgccgggagggcgagatgacctctggctgctggttgcaccttctgtgccaccgggtgtatacttctttcagaagccgctccctaaatccacgctagccaggcgaaataggaaagggaacacaattgcatggctaaatgcgggcttgccgcatcctcattcaggccagactggggcttctcccacccctacacgttctaggctcagctttggcaaggaaaatctaaaagctccatccagcaggctcctcctttctctgaggatgtgccctgtgggaagcctgggctcgtgcctcttggcgtccgctttctttctggtcatggttctccttgctgcgacacagggtgtgttgtggcctctcctagaaagagtaaagacaaaatgcatcttcagcggaccttgaggcctatctttgaggttatgcacaggctgttgagcaagttgggtatttggggctcaagcaacctgaggttgccacacctgcttctgggcgctgctgcaactgaagacccaatgacccagggagctgggtggcctccttaaaagcagcgggaaggctgggcaccgcagctgccatacacgcttcagatgcttgggaaactttgggagtggagcagccacggggggagggatctgttttttttccagtctcaccaacagtctttttgccttttagtcctggtcaaaagcccagcgtgctcatcacctctgggcatatcctagggcaagaggagcagaaaaccctgctcttccctggtctcctgtctttggtttttcagttcaatgtggaaaacagtgacttacgatgtctcagccttgctgaaaatttagaaataagcgctttattggtcagagattttaattcacccaactgctcaatacaaaagcctagtttcaatctttgaatagactctttttagggagtttatgttttataaaatgaatttggccaattattattattttataaaaattaaggttgccatgaaaatgccttgagagagaaggggatgttgagttttggacagttcaggttttatgatattttcttggtaggaaatgtgcttatctcattttggaaggattgctactactgggccagtgaacttttcttcagggccagttaggcattaattgccctggctgatccttttgctttttacctttcatcttttattttaacaactaagcagcgagtaccctgagttttatcagaaatacaccaattaccaggcattcatcaggaaatgtgtccaaatgatcttgtctcttccaaatactaaatttccttgcattctggctaaaggagttacatcttattcctttagaattgacacccacaaggtcaggtcaggatatggctgtccctgaaaccctctggaatcttttcttttaaaattctgtgtgttaatcaccatcataattattgatgtgtgtctagggccctgcattttctatggctaactcccagacatcacttactcttggcccacacaatgtacagtagggttagtgtgaactcagtttcagagacaaggaaactgaggcccagttaatgttaaatgacttgcccaaggtcacaaggccgattttctcccaggcttgtgttccctgacacattgtttgcccgaagctgccccttgaaggattgatgtcagcagcagatggcagttttgtggggggactggcagcctcttgatggagttccattgtttaccctcttactttcatcccgttgcctttgttgcatgcctctgaagaacatttgaccagtcaccaaaaacagtgcccgaggccaattacctttctccctgggaatcatctggccagtgggatgcaaaaagtccacctagtcagacagattttgtgctttgtgaattttgtgaagggaacttttgatttttaaaaacagtgctgagttctttgttgacttgttcccttttatgtctttttcaagaatttatagacctaacacaaaggaatgttttagaacagtattttttctattgtaaaatagaaggattcatgccttctcttgcctcatcagatacttgaagccttttgattatgaagcagtagtaaaccatatgcttgcacatttctagtgatggggaactcactacctcccaagcccacgtagtctatcatctttggacagctctggctcttgtaagcattttttcttttttcttttgtgacagagtctctctgtgtcgtccaggctggaatgtagtgatgtcatcttgactcactgcaatctccgcctcttgggttcaagagattctcctccctcagcctcccgagtagctggcattacaggcacgtgccaccacatgtggccaatttttgtatttttagtagagacggggtttcaccatgttggccaggctgatctcaaactcctagcttcaagtgatccacccgccttggcctcccaaagtgctacgatcataggtgtgagccaccgtgcctgacccttgtaagcattttttcttatgttgcattgaatatgtctctcatctacttattggttctatagttcctttccctttggacttcacaaaataagacagatgtgtcttcccttggactgcccactgggtgtgtggagcctgggaatataacccctgacaatgattatcctcatataataggatggttcgctaccacttaccatctccactctcctctgtctctactgcatcctgggttgcaaacctcagtgtcattgggtgcttggcagatagaataaatggataaagttggccacgtgaaacaatttgtggcagctggcctaccacctcagtgcaggcagtagaagggtggtggtggtgattgtgacggacttcagagtacatgttctgtctaaatgggcagtcactacttaggttcaaccaattattgctgtttaggaatgtaggcccagacagatttttcaatttttcaacagatgccagaaatctggatgagagctttatgtttttaaagagattttgccaaaaggacctccaaaagattatattatcagtatcctatttcaagagtggcactgagttctaaatgtggttctctagatgtggccaaagacagaaaacaactatcacctcctttctgctgtctgcaatactactattaacatagcccaaggattgaattagcctttggtgctgctcaccccctcagtgcaccatgtatattaagtctgctgtgtttctccaatacactagcctaggagccttgtcagagagaagaaaatgaaatgcatttaacatgacttgttcttggtgaccccatgctggtgccaaatggacattacttcctgtcctaggtgctcataagtgtccttaacaaatctgtttaagaaccttgccgggagtgatatcatattatctagtctggaactggcaaaccataacatttttccccttttgaaaatcagaacatttgccaggctccagctttttggcacctatcctattctctacaattccctcaaagatcactgatgatatttggtgatcttatctgcaggctttctcagtatcctggggctctaattcatcttgctgccagacatgatggttagttctgcatctattcagagttcctatttccattgcaacctgatagaaaattgaaatagaaatgcaatgattgactttggtgcttttttttttgttacatattcatccatcttcttagtagcaaaagtctagaggtttgaggaagaagggcaggtatggaggatgaccacagaggggcatgtatttattcattcatttctgcactaattcaacaaaagttgattatctacattgtacctagtcttgtgctgagtgttgtgagagacacaaagtatatgatacattctttgctttctaagagttttcttggaatatggtgataaaaatgagagaaagaaataaaaaaatcccaaacacaaaaacttcgagagccagaacgaactgaatcttagagcgtatatcatgcagtgattagaagatcaccttaggaatgctcgctggtttcaacaggataaaatgaagaaagcaggctgggctgggcaaacagaggggagtagtgggggctgtggccaagtggggagttcctctagagaaggcagatgctgctccagcctgctcttcctaggcaggaatgtgagcccagaaaggtcagttccttcagtgtttcaagggaatctggatttttaagcaaaatctcttgatttttaaatggtggcttaaaaatttaaaaacactatgcttcctgaacaaacatgtcggtagaacagttttagcctgttgggccaccagtttgcaaaatctggtctacaagttgaagtccgcacgaagccttggtgaggggcctcagccaattttcctatttcatcttcagtcattttctctgtgataggcttgtgctcttataaacgcaaaaaaccagtcccttttctctctctctctctctctttttttttttttttaagacagagtctctctctgtcacccaggctggagtgcagtggcacaatcttggctcactataacctctgcctcccgagttcaagcaattcttgtgcctcagcctcccaagtagctgagattacaggcatgcgccactatgcctggctaatttttgtattttcagtagagacggggtttcaccatgttggccagactggtcttgaactcctgacctcaagtgatccgcctgcctcggcctcccaaaatgctgggattacagacgtgagccaccatgcctggcgaccaatcccttttctctaaatcctccatacccttcccctcctccaggtctttcccatttgtgcctttactctccttaccccctgcctcccactcctatttgcctcaaatacttctgatcgcccttcaatgtctactcaaatgatgccttcttccacgatgccttccaaactcttctaggcagaattagtggtcccctcatatctccccctctgttccaaaccttataatccttaattgaaattttatgtttaggtctttggccacgaactcttgagggcagagaggcttatggtcatctttgtttctccaaagtgcttggcatgtgattggttgaaggagtggctgataagttactaaaataagtttaggctgggctcagtggttcatgtctgtagtcccagcactttgggaggccaagatgggtggatcacttgagcccaggagtttgagactagcctgggcaacatggcaaaatcctgtctctacaaaaaatacaaaaattagccaggtgtggtgatacatgcctgtaatcccagctactcaggaagttgaggtgggaggattgcttgagcccaggagttcaaggctgcagtcagccatgatcataccactgtactccggcttgggtgacagaatgaggctgtctcaaaaaaagaaaaagttttaatcttataactcatagctcagtgtttttgttttgttttgttttgttttgtttagatggagtcttgctctgtcttccagcctggagtgcagtggcacgatcttggctcactgcaacctccaccttctgggttcaagcaattctcccgcctcagcctaccgagtagctgggactacaggcactcgccaccatgcccagctaatttttgtattttcggtagagatggagtttcaccatgttgcccaggctggtctcaaactcctaacctcaggtgatccacccgcctcggcctcccaaaatgctgggatttcaggcgtgagccgctgtgcggcttcagcttttttctttgatatccttcttagttggcttgggctgctataacaaaacaccatagcccggatggcttttatttacttctcagaattctggaggctgggaagtccaagatcaaggtgttggcaagttcagttcctggtgacggcctgcttcctggcttgtagacagctgcctttagccatgtgctcatctggcctttccttagtgtatgcttatggagagagagaaatctctccctttcgctccttcctcttttttttttttttttttttttgaattagggtgtcattctgtcagccaggctggagtgcagtggtgtgatctcagctcactgtaacctccaccccctgggctcaagtgatcctcccacctcagcctcccgagtagctgggactataggcgcacaccaccatgcctggctctttttttgtatttttggtagggatggggtctcaccatgttacccaggcttgtcttgaactcctgagctcaagcaatccacccgtcttggcctcccaaagagcattattacaggagtgagccactttgcctggttggctttcttcctcttcttataagggcactaataccatcaggagggacccatcttcatgatcttatctaaccttaatcacctccccaaggctccacctgcaaataccatcacactgggggttagggcttcaacatatgcatttttgggggacataaacattcaactcataataacatccacgcttcctattctattgaaagtagaggtttcactgggagaggaaatattcttaatggtttgctcgatttccttgcatttccttggtagatgagatgtttcttagtggagatttggtgaaggctgttatgttgacagccgtctcagtggggtgtggtctagggagcacttccttccaggcccctcccagtctggggaaattaatggatctgagagttcatattagccatttctggagtttttactactagagtttatatgttggagatgacatttcctttccagaaactcctattattcattcattcagtgactttgtaagccatgcttcaggctgtatagctttatttagcagtgggaggtaattcattttttttttagcttctatgtctcagtcatatatggagtatctaattttgtgatccctgtaactctgtgaggtagtcattattattttcattttatagattaaagtctgaagttcagagaaataaaacaaattgcactggattgcacagtgaacagtggcagagctaggtttaattcagcatcttcctcactttccggggtgcacgaaagcaacatgcatgccaaggcaacaaggggttccttcagtgggggaagtgtggggtgggtcttaacctttgacttccttcccttcctgacacttccacactcctgctaatccagcctctcctagtttgcacttgatgccaccgcggtgtgtcagatcccttcaatcccaccccaggaagtcacctttgggaaagtgtccactgcaaaactgcccgcacggctgtgatgcaggctgccagagctacctctcaccagccagcccagtccaccaccaacctggaaatacggaaccagaaattttaggtgtcttctagtccaactctatttgtttttcagatgtggaaattgatgattggagaggggctgtggctttcagattacttttagactgtctctccatgacggtggaaggtttatctgcttggttcattgctgtagcgtagtgcccaccatctagttggtgatcaatacatattactgagttgaattgttctggtgtgtgatggttgcctggggaggcagagctgagtagtaccttggaaagaaagatgaggcaagggtgtctagccgggtaaggattggtgaggtcaggagggggtgagtttgggctgcctcctgaaattgagtcctttccttcacagctattaggaagggacggggttgactttttaaaggtgctgagcttgagaacttctggcttaatacagggcccaggaagctgtcttgggcttgatttcacttggaaaatattcattcctgatggcttgttggtgttcataaaacatcttggctggcaaataatggcactttaactctattccctcagtttgttgaatcattatgctagtttatgtttgggataatgttccctaagagtattcctttaaattggttgtaaagaggtgttgggtgaaaaaaaagtagttgtgtgctctaatagattttggaagttctagaataaacagtgtgaaataggcctgcttcccccaggacttctgggaatcttgcttgtgttaagtgtgaatcgctcagtagggcccatggagtttcctcaaacttacttgattgtgtagatatttttcatggactgggtcacaagactctgttttctgagttacattttagaatatgtcaggctgcacaattcatggatcatctgggtgctttttctttttgcctctggctcagttccctaatgttttatacttgtctcagagagcagtttgaagagggaaagaagtaaaacaaatgcacatctagttgagctgagtgatatcaatgtagtgctttgagttcacctaggaaatgtggattttgacatttccaattacagagtgctcaaccattgatttaaatggtaatttggaaacagtgcagccctaatcaatatgcattgcgtgtgcccatctgtgcgtgatggtaatggggtgcacactgctgcagcagagtgttccaggttccttgaatggacctggctcttccccctgggattgcatagccagtgctaggtgataatggcacagatgaacacagagaagcccatgttcccttgtgcctcagagtgaacaaatctcagctacaaacccaggtgcacaagaaatatatttttctttctttcttggtgactcagtctccatttcacatctctatcttttgtttttttgagacagagtcttgctctgttgcccagactggaatgcagtggtgcaaccttggctcactgcaacctatgcctgttggatttaagtgattcttctgcctcagcctcccaagtagctgggattacaggtgccagccactacgtccagctaatttttgtatttttagtagagacagggtatcaccatgttggccaggctggtttagaactcctgacctcaagtgatcctcccaccttggcctcccaaaatgctgggattataggtgtgagccactgcggccggcctcacatctttattctgctgggggtgacagaaataagtataagtcaatttggggtttccctccagggttgtgctccaagatccagggggacttaggcagcaccaaggcccttgtgaggacatctgttgtggtttatcatcaatctactttggcagctactgggacatcctctttcttattgagtctttggtggttggtctgtgtcagcaatccttctttgttcctcatgtgtccccctctccttggttccttccatgcaatttgctggcaccagaggcgattctgctgctcacacaccacactgggccatgagggaccctggatatttgcctcaggcctgtcttggccacactcaacacttgcttctcccctggtgcctccctagggctctgcctggggaagggatccggcttctctccactcttagattctgtgaatctgtttggtggttgcctcatcatctccctccccgggcttgttcgggatgagttgggcagggtgcagatttttttcttatagatccctgtacctacatatactttgctttactgatttactctccactttggtctaggaaatctttacccatatgctcgtgtggtggggcggggaacaagggtggtatcctggctttgtcatcagacattctgtcaaagctgttttccataaatctcacgttctttctctcctccctaaggacttttgaaaaaatgccaagaattgactctttttctgcattatccctgaggcaatgaacacagaatgccctccctgactgaggagggaccaagggggtcaagaaaatttggagaaaagcattcaatatttcaaagtattaactacagtgaatttccttccttctccatctcctccatcctggcctagcctgccattacctcttgctgggaccagtgcaacccaaagtttctcagggtctcctgactcagagcttctcacccacagttggcattttgggctggatcatttgtggttgaaggtgctgttctgtataacataggatgtttagcagcattcctgacctgtacccactagatgccagtagcatccctgctcccagttgtgacaatcaaaaatgtctccagacatagccaaatgtcccctggggacaaaatcactcctagttgagaaccacagttctaagcggtctccctgcttcttttcttgtcccatagtctactctccccacagcagccagcagtaatctgtacaccatttaaatctggccatgtcacttccctgtttaaaacccttcagtagcatctcattgcatgagactagaatccaagcccctcaactgcacttagaaagccacgctgtgctcacctctttccctcccctggtcactctccccttgtcattctatccagtcatgctggcctgtactggtttctggacttctccaagcttgtacttgctttgggcctttgcacttagattttccatctttctggaatgctcttgccctggattgccacttgattggctccttcttggtattctgctttgaggttgcatgccacctgcagactaacccatcttaagtagccgaacagcaactctctattggatcagctgacctgaattcttagcagagcactaaaagctatatgatatttttcacgctttctttgtttcttctcttcaccaggactgaaactcaataagagctttgatttctcttgttcattagtgttttttggcacctagaacacagtgtaggatgtttagcagcattcctgacctgtactcactagatgccagtagcatccccgctcccagttgtgacaatcaaaaatgtctccagacatagccaaatgtcccctgggggcaatgggtgttctaggtgccaatggtcacaatttttgttgaacgaatgaatgattataggtgttcttgtgatggactttgcatacaagaacacatagatattacgttttggggtgcatactgaagcagatccagtctttccccaaaccctgattgagacgtaatgcaggaagatgaaaaatccagagatgggataattgtatccatgcagagccacccaatggatgacttagaaggaagtgaagtgaacaggtggccgattgcaggaatactgcagggaatctggcatatattctattaattgagttcctagtatgtgtctgagatggggacacaaaaatagtttcatagttttatgaaacttaagtcttatcaaagataagaatgggaactatatttcaccaatttttgcatccccatctcagacacatagttctatgaaaagacagtgttaatctcttctttcactgctataaagaaacacctgagactgggtactttataaagaaaagaggtttaattggctcacagttccacaggctgtacgggaagcatgatgctgacatctacttgggttctggggagacctcaggatacttacaatcatggcagaaggtgaaggggaagcaggcacatcttacatggcaggagtaggaagaagagggggggggaagtgccacacacttttaaacaaccagatctcctgagaactcactcaccatcatgagaacagcaccaaagtgatggtgctaaaccattcatgaaggatccatccccctgatccaatcacctcccaccagcccccacctccaacactggggattacaatttgacatgagatttgggcggggacacaaccaaactatcagaccgttataaaaataggttaataaattatgacacagtgtagtaagtactgggacagtggtagaaccaggcactgtggaaacttacaatgaagtttcaactttaccagggagagctggagaaactcttatagaagaaggatcttttaagcaggattttgaaggatgaatagaagctctccaggtggtgaaaggcattacctgaagagaagacagcatgtgcaaaggtatgggggtcacaaaagggtcagggtacttgagaaatggtgaggagtttgaggtggctaaaatcctgagtaggtggaacaaaatggtggtgggagatgaggctggaaaggagaagagcttgaagttcctgtctgatcatcagatcctgtaagtctttgaccttgaagatggtatggatgagagtcgtatttatttgttgtggtaaaatacacaaacacaaagtttaccgtcttacccatttttaattgtgcagcttagtggtattaaatgcattcacattaaatgccacccatcttcataacttttttcatcttgtgaaatgcaactctgtacccattaaacaatagctccttggccgggcgcggtggctcgtgcttgtaatcccagcactttgggaggctgaggcgggcagatcacggggtcaggagatcgagaccatcctggctaacacggtgaaacactgtctctactgaaaatacaaaaaaattagccagctgcagtggcgggcgcctgtagtcccagctaatcgggaggctgaggcaggagaatggcgtgaatccggcaggtggagcttgcagtgagccgagatcatgccactgcactccagcctgggtgacagagcgagactccatctcaaaaaaaaaaaaaaaaaagaaaaagaaaaaaaatagctactcgtttcctcctcgttcccaacccctggcagccaccatgctactctttgtgtgaatttgactcctttaaggaaaatataagaatctagaagcccctacctgaaataaccactataaacattcaatgtatttccttccagacttcacgtctctatcaatcacatttgttttatatctgtgtataataaaaatgggatcatagatctttaaggcagagttataaaaataaagctgataggaaaataatcataggcctataggctgaggacttgaaatagagtatggcctaaaaataaacagtttgtcaagtaagaacatcaatatgcgtgacctcctacgtccgttttaatggtcctttagggaggggacaccactctcttgtggcgcctggcttgtgttggtcacttctgtctcaggtctttgtgatttgggtaaaactggggggaactgagctaactcatcaagaacttccctcactgccacatttgtcccagccactttcagctagaatttcccccttcccatccctgacagtcttatttccctgttggtcctaggcagcagtttctgtctttggcagcaagtgctaaagggagaggcttgtctagggcaaaggattcatcttcagcagctggagaccctccctgctggtacctgttccctggtctacctttcctttcctccttgttgctctctgctggatttcctggccattgtgatactttttggattccggattgcttgtctgctcctggcagatgtagcctgccatccccttgcttccgattgctggtgagagcattttcaaaatacagttaatgtagatcagtaagttttccaaccatttgtcaaatagaaagacctggatttctgtaggcgggtagagttctcgctgagagattcaagcttggcaggatgagacagttccttaggggaccttctatagcttatagtgccttaagagggtcagagaaatgacatgagaagactcttaccaatgaaacatctcagccaccttcagggacacaaaagaatggatgtcatgtctgtgatttaatttgtactaaagaatgtgaactggccaagcgacatggctgttctccaactcagtgtctcggtaggacacttccaagcagagttggcagtcacaatgtctttactttgatcagtggcctctccagacaggatgttttgggtctcccaaagatctattaccttggggaaactgaggcagaacaacagtcactctctggcttctgacgtcttatagttgattactccttgacctcttgctccgatcttctggacccttgatcatttgcctggttgtggttgtttgaatttatttgtcccgtgaccctcagctaatctagggctccatccttggcctgatcctccaggttcaggccccaccctgagcatctctgtcttgctggatctcgtacttggcataatatcaccattgaaactctgctccaaaaatggcagaggctctactgctgtctgccagaaacatagaattatgttactgggaattgtgtgaaagaaatgctgagaatgtggtgggccagttcacatagatttagcttaacaaatatttattgagctcctactatgttccctgcccgcacagactttataattctgtggggaagacaaaggataatttgtaattacaaaagtgttgagtgttatggaaggagtggtgcagtgtgcatgggggaatctatagcaaatggatctaaagggctgaaaatgctgtgggtgatttactgatactgatttgtaaagctgagttgtattgactaagcttacctcaccatcattgtttcctgagctctttaggatctagacagaaccatctttccatttagagaagggtcagaagtcatcaaaatatttaaggggtcagaaagatcagtgcttctaagagaaacacacaactccaggtgtaaaagataaaagtggttccagaaaggggattttataatagctctattcaggatggtaaataccatcgtgggatgagtgcttttaaggtgaaattaaagccaggaatcagctgaagaagattgaaacccaccttctcttgatagaattaagctaaagtcacagagatagatgagacaagaaagtggaatgtaacgtggaaggaggcagctgtgatgccctgggtggagtcacccagaccggggttcaatcacggctcatggtgaatcagctgaatgaccttggatgaaagtcattaacttttctgagttccagtttcctcatgtgaaagagggacataataacacctcactgtgtgtgtgggtaattaattgaaataacataagtcagaatttccagcacagtgcttggcacacagtagcattaattaaacactagaaatgtcggctaagccagtaagtggggcaccagcattcagagtcctggacagtgattctgaaccaacagctgaagccattagtaagtgcacctggttgggaaggagagtaaggtggggcagtactaaaagacatcaggagacgtggagttggcagcatgggtagctgggaaaagaaaatactagtaagttgtagacaggcatgacactttctttgcctgttatgtgtgtgtttctcccagtgtggttcctggaccacctgcagcagaatcaccttggaggaacttgtaacaaattcaaggaacttgaattctaggaaccaccccagacctactgaatcagaatctctgttggggggcagtgggtggaccctgggaatctgcattttacaagtgcctcagatttcatgaacttaacataattggccctggtctatagtaaactcaccagtttggctgtgtatcttttttttgaaagcaaaagaacatttaataattaggtagactattgctgagtgaggtgggaaaaataacacccaaagtgtgtgtgtgtatgtgtgtctgtgtgtgtatgtattacagttttaaaaataaaaaccctatgtccttatatatttagatatgtataaaaagagtctttggtttttgacgattggtaatgaggtttacccttggggacgaggggtggaatagggtggtagtgtcaggggacaggggaaagaagaccttttcatctttatactgttcaattttgattggcttctgaaaaaaatgagcatgtattccttttctgatttaaaattccacgaagttgacagtaagtaaggactttgttggcaaaattcctgctagagaggatgctcagacatcagctgaactgtaaaagaaagaaagtgacacctgcaagagctatttaaattatgctgaacttactgtggtgctcattatgtagtgtaaggatgattgctgaaatgaaacgtaatattttaccgaattattcccccacgcagtgaggaagtttttccatactctttcaaaactttgaaatatgggtagaagagtggaaaagttcagcttaaccttttaatttaccgagtttcagtcaggagccatcgtgatgcagtggccagagtctggggtttagactcataagacccgattttccatctctggtctgtcttttgagcgagtcacgtctgcattcttcattctgcatcttggcttcctcatctgtgaaatgagggcattatcaaccttaaagggtggttgctgtgaggatcaaatgaggtggtgtgtgagaaagtaaactctcgagtgctgcggaaatgttcattatttctattttttgtcccactcctaccctggacatgctgctattacagtggggttgtttatgtgtctgtccctctgtgagctcattgagtgcagaagccttgttttattcattcccgaattcttgtgcttagggcctgccacacaggaggcattcaaagcaacttctggaatagctatcaaggagagaaaaatacacacacagttcggtgttggcctataaaaatattaagatagtcttccagaaaacattatcttccatttctatttaaaggaattaaaaaacatttatccaaatccacaacagaaattatattgctaggagaaaataaagaacttcattaaagaaaatttaattgcccagttttctaaagagacagaaccgcatccttccatcctcattactgccaaatgggtgacggccgtttccaagggaggcaagatgaatgacaagggattgtgagaaggcaaatcctgatactctaggagaaaagtctcccaagaaacgggaatgcccccccagatcaccagttacactattgtttgtcagagctgtggaagaagccttctctgagctccttggacaaaagccctttttggcttccaccccagaccttggccgataaaccacaaagtccctatttcccctggaagtgggaaaacttccagtggctcgacaaagctggaaggattatctgagattcaatttgggggctgtggtacctccaagaccctgataattatcatctgaatgggcagggggaggattgaagccaaatctagtaacagagccctggggtagacctgcagttagaagacaggggaccgatctcagctttggccccttttcatgtcctgctacgagtctgctcttttttcttttcttttcttttctttttttttttttttgagatagggtcttactcaggctggaatgcagtggcgccatcataactcaccgcagccttgaactgcttaagcaatcctgcctcagactcctgcgtagctgggactataggtgcatgccaccatgcctggctaattttaaaaaaaaattttgtagagacagcgtcttgctattttgcccaggctatcttaaactcctaggcacaagcgatcctcctgccttatccttccaaagtgctgcgattccaggcatgagccactgtgcctgcccaaatccatgctttctttttccctctcccacaccagttcccaagcacagaccaatcaggtagcaccattagatgagttcataactgtttgaagatgtgattctggcatgggggtacgattgtcatcctaggtgaagtctccagtggcatgccaaaaggctgtctcctgttcagtgttttaattacctggatgaggatgtgagcatgcccatccagtttgagaatgtcaggaaaccaaggaaggcaggcttagtaattgggaacacagttgttggtattgaactgaccagggtttgcaaccttttagccactttctagccgtgtgactttgggcaagtgttttcatctctttgagcctcactgtcatcatctgtaataataataatccaacctcaaacagttattgagccagttagatgagataatgtgtgtaaaacccttagcacagtgcctggcactcagtcagcgtcaccgattgttattaataaatcacaactgtaagagccgcgctgcaggctctggagtctgggtttaaattctagtgctgtcagtgaatgagttgcttaacttctctgaggctcagcttcttcctctgtaaaataaggacagtaatacttaccttgggagttgctgtaaataaagcattcaggccagaatagacacatagcagatactcaataaaccgaggttaccattcagagaaacagcgaatcctgtggcagagagaaccaggaagcagagcgcttagcaggaggggatgaggaattgactctaaaaatgcgaagtttaatagtatctttaagagaaaaaccacccactcattgaaagaagctacattgttttggatcttgagccctgagaagaatttatcctataaatagatagaaatatgaatggggtagggaccaactggcatttggttaggatgccagacctcaggccctgaccccatcctgtcccttgtccagtggcttttggcccctccccaagagattctagcgagatatgtgtgacacaggccgctggctaggaaatgaaatcttatctcaaagctgtggctgaacacagaattctggtgagctgttctccacgtggagaacgcctttggcctagggaggttgccatgccggcctctgtccgggcccacacctgaatctcagctctattgctccagggtagaggaagctgatctggagtgggtcagccttgggggacagctggagtatctgacccctttcctatagggaccagctagacgactgctcctgcttctctcccagatgtgaccaggcctacctagccacagaaagaagaatgtcaaaagtctggacccacccagactgaacctttgagcttcttagaagtgcaatgtctgggaattttggttcatgactgtatcgtagaacctagctagtccataatatcacctttccttccagtgggtggactactatgcccttaataataaccctgatttggggaggagtaagtagagttgacttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccatgttagccaggatggtctcgatctcctgacctcatgatccacccgcctcggcctcccaaagtgctgggattacaggcgtgagcccaccgcgcccggcctagagttgacttttagcttgctaggtgtcaacatcaccctccttcttctaccttgttgatctttcttctgttgcccccaagaacttagcagccaaacctatgatcaacttaggatgtggctgttagctgtctcctactgcagaagaaatcaatgaagtccaggctgcatccccagcacccctccatagggtgcctgccgtgcatccaggagctggctagtgtaacccccaaggatttaggaaggcctctctggcttccctcctcttctctggatgtttgaagcagttcaggactcaacaggagaaaaattcaacttacttttttttctggaccaaccctgagcactaggcaggaagtggtctggctgtgcatttgctagcattggccagtggtgcatttacttgagatgcacaacaaaattgggcaacttcatttaaatatctgcatttctgactttttaaaagcaaattgcatgatctggcggcactgggtgcctgttctcatgcagtaaccaatcagccagagctgactggcggctgccttttttagacaaggtatgtgctcttgagcccctacacctccctatcccagaagctcttgggtccccacgacacccttctcttacacctgctgctgcttgtcattggcctaacctgcctggtttctacatgtgtttgagtttgccacctttggattaggccaagaagttatgctttattttctgtctcaaactatgatcatcagattgggttgtacaatgagaattgcatgacagcataacaaaccattctatgtctgtgatggaaaactgcctccgacttaccatcatcctttcaaacttcaccatggagactccctgtcattacttccagtaaaacctttgtcatctccttaaggatgagtttgaagttttactcaagggcaggatactctcccccaacaagaagtgctgctgtatttgtctctgactgccccccaacccctgaggggaatgagggaggggcattcaggtgctagaggccactgaagacccagtgatgcattagatggtgtccttagtcattcctatcgtagccaccgtaatgcatttttagtagttaaaaacatcgcaatgtaatttgataattttaacaccaaagcacaattcacaagaagtaattctgcccaaacagtgtggtccaaggactctgcattggactgggaagccagacagatctaggactgaatcccaacattgtcacttactaattgcttgaccttgggcaaggcatctcccctctctatgcctcagtttcttcctctttcaaatgggcacccattggactcttgcaaggattaaatgacataacccatgcttacccaatgtctggaatgtgggccacactcaataagtgcgctctgttattactcttacccagattttgaggggtcgattcaatccaagagtgaaatttacaacattcatggcagaacggatggcttgcaggcaaagttagacccactagcatgttttgtttggcctttgcaggatttacaaaaatgaattcatcatttccaacacttaaaaatgaagagagttaaaaaaaatcaggggagttcatgtaaaaatccagacttctggcagctcttagaaaatgggaagatctaggaacactgggccctcattctcagaggcaaaaattggctgttcccttccaatgggacaggggctcggacttgtgccagtgcccacctggcccactttgctcatttctgttgcctgcttggctcctgtgggcaggtgggtttttttgacctggaggaatggatccaccttgagccaatcctccataaatatcatttcctgcagacggggtttggagaaggtgaatagcaggttgcatttcctggcaggtgctcatggtgccatctgtgttatcgatgaaatgaagagccatcagcttcaacaatttgaggggcagagatggggtcatggtcctctgaaaacaatctgagaaattaacagatttgtagctgtgaatggatggccatctcatcaccccatgtaggtgggctgaaatttaatgaggaaaaagtgtaaagtcttgcccttatgtctgaaaaccagtctgtagactggggagaggtgtgcttagcagcagcacttgtgaaaaagacttaaggttctcgttgacagtgagttttgctgtgagtcactgtgaggcagttgccaaaaaacctaatctgattctgggctgcgtttatagaagtctagtgtctggaagacctttctaacaattagagctgtcttgaaggaacaggcaggcagtctcctaagccttgatctcccaggcgtaggaggtgctcgaggctgggtgatgaatccctggaagagattgtcaagagtggggatttaggcatcagagggagatttgttctaggtgacttagaaggtctctgccaatctgagattttctgctttctgcagcccagtagaggaaaataatttccataacaaaagtaaaactctttctgatagaggaaagcaggactccctgaagaggctcaaaatggaaatgtaaacttccagttcttaccaagtaatgtgggcaaaagatatcactgcctctaccccacccctgaccccctgccttatttctcagagataggggtcgggggttggggttgcggggcaggatctgctctgcacattactggtaatttttttttaaagctgaacttttatgcagagcttgcagactgacagcacatgggcccgatccagcctcaggtgtgttttatttggcctgtactgtgtcttttaaaaatgtgagttagatgccaacttgtaaaaatgaggagattttgtataaaatatggacttcccagcagcttttataaaagtcagaaggtctggcagcgctgggcttttgttctggggatgagcaccgattgcccttctgtggcaggacttgagctctcccttggtcatggtcctaaactccctacctggcctgcgtcacctgtttacccggcctgcctggccccaataggtgttggagtttgccatccctggtgtcatggcttgttttaaaggccctgcgctgttgtgaccttaaggtgccattgtggactctgcttggtcatcccctagcagaagggcgggcagctgggagtttgccaggggatggggttggggtagagggagtgggagcagaaatgcttttatagctgcttttaaaaagtacctgtggctcacacacagtcagcctccaattctttcatctcagtaaacacccccagctgttctattgtatggctccaaggcccccagtggttttccttataatgacccaagtcttcaacctggtaacttccacactgtgggcctgttctggagctgttcaggacagtggcttcctcttcctcagcaaagcctgctagacatttgcagacagtagtctcctctctcctggaagctgctgaccatccttgccctgagaaggtggtgttgggtgcagagagaccagatggatttcctggaagtggctgagacagagctgctttcaggtgggtcctgagctgggcagtttctgcttggaagccctgagtgtcacgtgaagcactgttctctccaaaggcccctcactccaggctcagaacctctctgtcatctgctggtgagagacagagaactgaatctttttatgaagtttggggatttggtggtagaaactgcaggcactttacccagaagcaggaatcttcaaggactgttagctctaatctgttggctgctacgagttgaggggagtgaggcctgcctgtagacctcttgattgccctgctctgcaatagaatttgctagacttccacgctgtttgactctgtctctctgctttttggttctcaggctgaaattgtccatcctagaccttcacaacctataggacaccctccaacaccacttccctgcacagccagcccctccctgtgtggttctgcaggcttctcacttaggagatgccctgctgttctgagttatttctagtgtagacataggagcttgtctggccatccatggtacagccatctggtggcagtttcgtgttttcactgtggttgcctcagtgtattcttttattgagtcatcctttgagtttcccttttacttttcccttatctctctgtttaaggactcgccctttcttggggcctttctcccacagatatgaaggtatttgtgaattgtggcaattttgggaaggcggtatttcttgggaatggcagggtgctccacgattactcgacatttggaagatgctggagtctgcatggggggagaagatgggcaggcaccctctgacctgcctgaacagggttaagtgtgcagggtggaggaggggtgcgtggtgttcccacacgtccatctcccttcacactttcctccctctattcccttttccacaccacttgtaaatggcatgacatttcaacacgaatgtcatggctgctacctagtttggggtcctgaccggctcagccttccctgggggcttccagaggtctgagtcagaaacagccaagtctcatgtctaaatgagttgttctattaacttggcttgggtagcactcggtgacgaaacctgactgttgctgtaggtatcatgtggaagggctgcgggcatggtgtatgcatgtgtttgttgcaggcgtgtttggagaggagggtcaggccttctcttctgcaggggcgtctgttttccttcagagccccgtggcttgtgaaatggcattgcacaaggaaatgatctatctggagccgatttcactcctgtgtagtgctgggagctaattgaaacttcgagaggagaagtgcctgtcttccatccagaatcaagattaattgatgttctttaatggaaacaaatcgaatctcacagcaacccttcccattaaccttacagtcatgcacttttctatgaaggctgggatggttcttcagaatcagcaggttcttggaaacagttgatgccttgaagccatttgtgtctgtcctcataatggctggtgggaaacggggataaaatgcctttggaacacctgatgagtggctgggatgaaggggtgattcttgtttgccttgtggcttgcatggcacactcatgttgcattgcatttgatctccctagcaaccccgtgatgcaggtggagttggactgagtatctttaatgtatcatgaggaactcctcctgactttggagcaccagtccctcaagatgtgtgctgagcaaagggctctgtgttcaaataagtgtagaaaacattctactgcatccccttcctaaagattcatagctcacttctatgtattaaagactctgataagtcctgtagaaaaatctatttaattcattatttcctgaacttattaacctaggtactctttttctttacagtgtaattattggcatcttctagacctactgacatgtcctgtaaaaaccaggtgataaacattttaggctttgtgggccatatggtctttgttgtaaccaatcagccctccctttgtagtgcaaaaacatccacagacaatagagaaataagtggatgtggctatgttccaataacactttatttccaaacataggctgtaggccagatttgactcatgggctgtagtttgctgacctctgttctggaaaagcatcctgcggtatatctttttgggagatgattctttaagtgtccagtgagtctcacacaaggactgcactctcagcccctagcactggtggcatagtggcaatgtcttgtggagtgtggctcagaggctgaatatcttgctcagggtatgtgactgttaagtgctatcacagagatatcacccaagctgttgactataaaattgatttatttttcattattctcttctcttttggagtacaagaagcggaaggggcaaaatgctcttgggaagggggcaaaatgctctgagtgtctgctatgtagaatcacagtgatatgcatgctaggtgcacgtgggcatttatgtacaagttggtatcagtgcgaccatgatatttgtgttaggaaacacaaatgtggttgatggataagttagccagttagaggcctttgtttcaaagcacttaacagaagatgctaaaaagaagattcaaagtgcaatttgaattgagatctgtggtgataaatcattaatagaatcagcaacgtgcaggagtttactaaacacctaacatgttcccttgctttaatcagaactttgaattgtaagcaacagaaatcacctaaagctggtggtagtagaaatacatggattttattataaagatgcagggtgtcttgtggaatccaggtggggaaatgcagttggccccaggctggcctgggaccaggaaggagggccagggagccctggtttgttctacgaatcggtagtacacttcctctcattttgtcttctcactgcacatctgcttcatccttccttctcaggaagccagtcatttctggtacttcaactacatgacaggtacacagtggttgcccattgctcccagctgtgtgtttcaggtggaggtaaacatatggaaagactgttggctgtctctctcactcatattctctctctcatttgtctgtgatgcctcctccctaactctgaagggatcaacctaggccattcctgaaccagtcactgtggccagtgggatgggattgacaagagatctaggtcagccagaccctactcctgtggatggggcaggcggtttccaaaggagaggggctactacagtcctgccctggccaggcgctgagcaggcacagagttaagaagaatcctttgatcccccgacatttataaatgagttgggaaataaaaccaatacatagtagtaatgacaatgtcacatgtgctaagttgtttcattagacagtggaaaagatactaaataaggcgccagtttggctgcatagacgttgagcaccaaaagatggagtcaggagagggtgtgtggactgaccttgtcaggaagggctggctttctgcagcacatagacattctctgagggtgagtgggaagcagagttctgactgggagatcagcatggacagagccagaattgtaatgtaaatgcagtctgggtgggagtgttaaactgggaggctctttaccaagagcagggaaataactttatttaaaaaattttttcatattaaaattttgtctttaaaagatagggccttgctctgttgcccaggctggagtatggtggtgccctcatagctcactgcagtcttgaactccaagggtcaagcattcctcctgtctcagcctcctgagtagctgggactacaggcgtgcaccaccaccaggcctggctaacttttaaaaatgtttttgtagaaacagggtcgtgctctgctgcccaggttggtctcaaatacctggcctcaagtgatcctcctgcctcagcctcccaaagggctggaatgacaagcatgagcatgcctggccggagataactttagaaagcagtgggaaatgtgttgagggaaagcaggaagctttgctgaagacccagtccccagtggtctcttaattgtaccaggaggggctggaagttggaactgctgttcctgggggaaggggcagtgctggggaaagaccctcagctctacacaggcaagaggaagtccaggctggcagatgcatgtcctggccatggggctgggatactcaggaataagactcaggcactggggactaaggcagatgctgtcaccagcggggtgggacagaggtgggacctgagaggatgggaggtggggtctgccctgggctgtgaggcagcagcaggactagcaatgtggatggagttgctttgcctttcctcaagccatcctcttccctgtcctctcattaaaactttcctgtgtgtgtcccatttgcttgggacctcaaggccaatgatgagctaatcatctagggagccagtgatcaatgtggctttaggtgctacccaattttagtgacatttgcattgggacagatgccttaaatgccttgatccaaaagaatgatagtgcctgagatttggggacaaagacactaagcccaatgtcaaggatcccatctgtgtccctttgtggagagtactcttgtttggagatataatgatcaaacaagatgcctgctgtccagcagtatggaagctgagccctgtgcctgaaacttttggagcagcagctgttgggccattgcatgataatctgggcagcatttttagggaggaaagagcaggcagcagaggcacatctgaggacccaggagctgcagaggaggcttcatcttgatgtttgcagcctctcctggaggtgagtggactacatgcaggacttcgaatgatctggatatgaattcttttttaaaaaattgctttaattgatgcataataattgcacatgtttatggggtacatgtggtattctgatacatgcatacaatatggagtgatcaaatcaggatgttgaggattcctatgacgtcaaacttttataatttctttgtgttgggaacatttgaaatcttctctcctagctactatgaaatagccaatatcttgttttgaaccatagtcaccctattgtgcttttgaacaccagaacttactccttctatctaaatatatgtttgtacccattaaccaacctctcttcctccccgccccaccctaccttcccagcctctggtaatgatcagtctaccttctacctccatgagatcaacatttttagctcccacatatgaatgagaacatgtaatatttatctttttgtgcctggcttatttcacttaacataatgacctccagttccatccatgttgctgcaaatgacaggatttcattctttctttctttatttttttgtactctgtcgcccaggctggagttcagtggtgcgatcttggctcactgcaagctccacctcccgggttcacaccattctcctgcctcaacctcatgagtagctgggactacaggtgcccaccaccatgcctggctaatttttttgtgtttttagtagagacggggtttcaccatgctagccaggatgctcttgatctcctgaccccgtgatccacccgccttggcctcccaaagtgctgggatacaggtgtgagccactgcccctggccaggatttcattctttttaaatggttggatggtattccattctgtagataggaattcttgatcttctgcttcctcatggggtaaagttactcaagccccctcatctgtaaatagaggtgataacctgtgtgcctgttcctgccacatgttatggcttagtacatacctgattacactgaacctcaagaatcacagcatacgtcctaactctcacctgatgcagagtcctcgacaaccatgaggcttctgattggaacttcctgcagtaaggggctgaccacctcagaaatgagactatttgcattgttggaaagtcttgctaggaaagtctttcttgagtggaactgcaagatgcctctctcctttagaacaatacagactaaaatctaagctggctgcctcatggtagctgtttcgtcatttgaagacagcttttggccaggcatgatggttcacacctgtgatcccagcactttgggaggcctaggtgggaggaccacttgaggccaggaattcaagaccagcctggggaacatagtgagaccctgtctctatttaaataaaataaaataaaaataaaataagataagataaaataggctgggcgcagtggctcacgcctgtaatcccaacactttgggaggccgaggtgggtggatcacctgaggtcaggagtttgagaccagcctggccaacatggtgaaaccccatctctactaaaaatacaaaaattagccaggtgtggtggttcacacctgtattcccagctactagagaggctgaggtgggaggatcacttgaatccgggaggttgaggttgcagtgagccaagcagagattacaacactacactccagcctgggcaacagagtgagactccatctcaaaaagtaaataaataaataaaaataataaataataaaaagtaaaattaaaagataaaaaattcaataaaatgaaataaaataaagacagcttttatgtactcctaaatcagcggtgggaaatagtttctacctgatgtgccaactgtgctggattgcagtgacagctggcggtctgtgttgagaagtattctgaggctgtgtcagggtcagcaggagagtatcagatctgccctgggcttggggctgggcatggtgtatatggacggtgtgtttattttctctgctaagcgtttatgcttagattctgccatcatgctttaggtgacttattccctcattctctggtctctttttctggccacacttcagcttatcaacatttaaaaagccatctggctgccatctcttctccctaattcatttctagggtggatttgaccaatctggctggcccagctgtggtctctcctagagcattgtttcctgcaatatcttcccaaatagaggaggaccatttttggatctgcagtctgctaataaaccttccaaattattaacgggtctcttaaaatctggagcccaagctaagtaagcactgtctttcagaagtactctcaatggttcggaggctagcaggactaataatacatcccttgatcctgttaatgcggcttaaaggttgtgttagctttttccctgtgtttgtaaagccgaagctgtagtgtaccccctgctgcggatggtgagggcaggagagccagatgcagtgggggcaagatctcctcctgtcccctccctgcctctgtgactcttggtggcttggggggcctggggcctgcaggggtgacatatggccccaccgaggtccaaaggccacaggtctcattctgtcacaatgaagttgtctgccctaaaggtccctggatcactgtcagtcttgacactggagcaacctgaaaaaaataaggacaatgtagacattttctcataaacctaatggcacacaattcaagacctgctctttattacacaaatgatggtcttcatttcctgcgtgtggtgtggtgtggtgtgtgtgtatgtgtgtgtcagaaattatcctttcttaaacaattgaggtagttcttctccctgccccgaataccctttgaaaagttggccaccctctgtagatccccttccttttgcggggaggagggagtcttaccaggctgtgaaagctggtctaaaaaccccagccttgtccaaggtgaggcccatcagaatttgacgtgcccccttggagggtcttgaagaagcaatctggcatctcaatgaggcccctgtggcacaggattgggccattaatagttaaagtagttaaatttctcacagcccaatgtattggaaaggcagcaatgttttcatttagaccttagggctggggtataatttaaggagagtggattttgatttaggaactcagttaacgagtgccagccttgtcaatttttttttattgtgtcgaaaagcacatcacataaaatttactatcttaaccgttttaaatgcacagttcaatgacgttaaatacattgataatgttgtgcaaccgtcaccaccatccatctccagaacacttttcatcttgtaggactggaactgcacccagtgaacaggaactccctgttcctcccccattccctggcaatcaccagtctactttctgtttccgtggttttggctcctctaggcatctcgtgtgagcggactcatacaatatttgtcctctgtgtctgctgtagtttagttagcgtaatgcttcagggttcatccgtgttgaggcgtgtgtcagaattcccttcctttttaaggcggagtaatatcccattgtatgcgtagaggccgcatcacgttcatccgctcctctggggagggacacttgggtggcttccgtggtgtggctcatgtgctgcggtcttgtcagtttttagccatggctcgggaaagtgacttggcccctcagtacctccgtttcctcatccattacatcggagcctgtcctctacgtgggactgaagtaagaatcgttgtttgtgacagtgcgtaactgcaacagtccatcgagttgaagttatttctgagagcactgggctagcatttcttagggtatctgctctgtggccattcagctttgccagcctgaagtgtaggaggaaggtgggagacggttcagagaaacgatacggagaggaccgggctgtggctgctccacagggtgttttgggtggggcagttcttcactgtggggactgtcccttatattgcagatgcttagtaccttgacccctgcccgttaaatgctggtagtactctccagtcattgtgttgacttaaaacgtatgcccataattttgtattccccttgtgggggatggtcctgcctccaggtgagaggcagggcctgagtgttctagaagggtctgtggaagtaagaagatgaagcacagaagagggaaagcataagagaatgacctggtgggctgatacatctgcagtgtgcatactaacagttggtgctcaggccctctgagtgtgcattagtcaggggcctccagatagaaccagctggagagtatatatacatatatatatgtatacatgtgtgtatgtgtatgtgtgtatatgcctatctatctgtgtgtctatctgtctgaggggagttattagggggattggctcacatcataatggaggttgggaagtcccatgctaggccatctacaagctggagatccagggaatccaggagcgttggccagtgtaagtctgaaagtctcagaaccagagaagccaatggtgcagctttcagtctaaggccaaaggcctgaaaactgaggggaggccgctggttcaagtcctagagtccaaaggctgggggacctgagttctgatgtctaagggcaggagaagaaggatgccccagctccaggaaagagagagaagcagtgtgcctttcctctgcctttgtgttctattcagggcctcagctgattggctggtgccaacccacatgagtgatcttccttactgggtccactggttcacatgccagtgccttccagaagcaccctcacagacagacctagaaataatgctttaccagagatctgggtgtccctgattccagtcaagttgatacctaaaatgaagcatcagcattgagcagagaggagcttgggtcacagaaggaccacagctctgggagggaggcagaggtctgtgttcaaataccaagcttcctcctaactagtgagggaggcttgagaaaatctcccacctctgggccccatctgtaaagtgagggctttggaaaaggtggtctttttcaactctgtggctccaggatttgaaggccgaacagcgtagatttcagtgagccgaaagtaagggctgctcgcctttgggattgggtggaaaaaggtaaaatctaacaaggaggctggagtgggaagagctgacctgctgaaattgcttcctagaccttctcattctctttcttttgatcgtttgttgaaatacagttcatttttgaatatgtaaaatagacacacagtatcatattcaaaacataaaagatattataagtagagtaaaaagtaaatttccccctccaccacttagctctccttcctcaaaggccacctcactttatcctcccaggaatactggactctcattttctttgaaccaggactcagaagattgtttcaaatgcagcttgcttgttgtgcctttgactttctggtctgaagggtgagaaatttgatccatcctcctgtagcgtgtggttagtttcctacaatgaattttccttattagtcatagtttctttttgcaactcttggatagagatactgcctttttcatcactctttttatttctcttacccccaaattcctggtccttcatctgaatcaaaggatgccataagcacagatcaaaaccgagataggacatctggatgccttccagcttctccatccatggatttcagaggggctcattttacataattgtctatttcagtgatttctaaaatggtttcatagcttcctattttcttttgtcttggagtttaacttagtcctgcaagtaactgctttgctgtttatctggtgtttaaaagtttttgttcagtgactgggaagcactgttggatgttaacagtaaaccgagggaggaaccctggactcggaggcagaaagcctgggtttgtgcaaagcaggcttctttattactgtgtgaccttcggcaagctccttgggctttctgaatcactgcttcctcatctgtaaataagggttatgctacctgccccatatgactgtttctattgttaaataaggcaatgaatatgagtattctttgcaaactgttaagggtcttgcaattataattattgtaattccttcagaaaatatttattaagcttctgttgtgttctggttaccagtgatcgtgtgggaaatgagcttatattcttgtgtgtgtgtgtgcatgtgtgtgtgtgtgtgtgtgtgtgttggaggtgggtaggggtgacagaagacagggaggctgtcaataaaagggttaagtaacaaataggacggattcagataatggtaaccattacaaagaaaataaaacagagcaatgaaatagagaatgagtggaggggaatggttcctgatgagaaatcaggaaacgtctgtaagctgatattgaaatgtcatgtgaaaagcaggtaaagagaatccaggcctgggaagcagcaagtgcaaagtccctggggtgggaacaacaagcttagggaattggaaaagagaaagggcagaggaaactacaagaaagtatgtgcatcgggaatgaactgagaacgaggcagagaatgtcacaagaagtgggagaggttggccagatcatggtcatggagggccttgtgggccctgttaagagttcgtattttattctatgtgcaattggagattttaacagggaggtgatgggaccaattttctggtttagaaagatctctcctcctagagtgtggagaacagcttgttaggcaaggggaagcgtgaaaccagttgggggctattgcagtagcctaagcaagggaagatgcctgcacaccagaaacagcacagatgaaaccactcttagggcatgtggcgtgaagctcagggagctgcttttgtatgaaaagggcagtcttctggtgtaaaggaggatgccttgtgtttcccctttgctcttctggtttcttgctctgaggagtgtggagggagttgaggaagtgggcaggggcaaatgttgcattttttttttttcagatgatgcaggttttggactgcaggtgcctatgatgaatcaacaagcatttattgactagagaagggtttttataggcctttggtttccacttcagaccagtcttttctgtggacaaactgggcatccttccagaagcccaacagggaatagactccattatttgtgtctccagtgtgcacaggagcagccgtgatcccagagagggctacccgtgtggctatggaggttgtcccctacagaaggacaccaggtcgagaagtggggccccaaatccaggggaagtttttctcaccaagcaatttgccccggcatggagctgcatcagcagggggaaatgggaatcttttccagtgggctccaagtcaccatctgggctggcagtagcccttcccaggccctggagatttctgctttgtagcctggtttcccgggaggctctgtcttcacctactttattccagtcagtcaacatttattttagcaaatatttattgagtagccactgtatgcccagcagtggatttacactgatgaacaggaggacacacgttctgccctcatgaacttatagtctagcagaagtcattccagctttctttctttctttttttgagacggagtctctctctgtcaccaggtgggagtgcagtggcttgatcttggctcactgcaacctctgactccctggttcaagtgattctcctgccttagcctcccgagtagctgggattacaggcacccgccaccacacccagctaatttttgtatttttagtagaggtttcaccatgttggccaggatggtatcgatctcctgacctcgtgatccgcctgcctcagcctcccaaagtgctgggattacaggcatgagccactgtgcctggccccagcttgctttcttcatggcaactggagggagatgtctttctagggaagcctgagctgatctcagcccctgttctttgagacattagctattaccacctgacttgtgagcacctcttggggttgggaaacaatgaccatcatccactatgcacacatatacctttgtctagagtttaggggagctgggaccagcgtggtttatggactgttaatagcttaactccttcatcctctacttgggagcagcataaactcacacgcaaagtgacactgaggtttccattggaaaaggggaaaattaattattgtgccttgagtcttcataaaaaccctcctttaactaagtatacttttctgtatacctagttttctatattgcacttcaacaaaaagttaagaaaacaccacttaagtttgtcgaactgccagggtctgagctcagagaaattaagacagagctgaggccgggagtggtggctcacacctataatctcagcacttggggagactgaggtaggaaaatcacttgaggccaggagtttgagaccagccagggcaacatagcgagaccttatctctacaaagaataaaaaaattagctgggcatgttgatgagcacctgtagtcccagctactcaggatgctgatgtgagaggaaggcttaagcccaggaggttgaggctgtgaggctgcagtgagtcatgactgtgccactgcactccagcctgggtgacagagcaagaacttgtctcaaaaaaaaaaaaaaaaaaaagaaaagaaagatgggtcaggcacatccatcaggtcttcctgttgtctctgcatcttgatgggatcctcaggtccttggcctatttttcagcttaactgagtaatcagattattttatcagactttgaggaatccataagaaattgcattataaactgtgatgtccctagatacaacaaacactgaggttaacactgggggatatccctctctagggccctctttctccccagcttcaaggtggttggggaatagaattagtcatagcttgtttgggaagcttggaatgagagaaagaaagacagaacttggtggttttcagatgttttttttccaggctgcggtggagctgggagaatgagagattccatacatcttgtgaccagatgtggtatcttcagctgggactaggctgtatcaacaaaacagagtcaattttcaaccttccctctttatttacctgtttattttactattacattctgtgtgtgtatctttaattataaaaataatgcccacttctcccccctcaacaccttactaagaaaatgttcaaacgtgtagcaaaaatacctaattaagaaaatcagacctactggaagggaaccacaaagaaagtgaaagtttctgataaccctatcttctggagagaacattgtcattacttgtttgttatataatcctccggatttttttgtttttagtacgtactaatgtatactattatgattgctttaacaatcagatattatttatactattttgcttctttaaaaaaatttaacagtttatcctggacacctttgcatgtgagaatttatttattattatttttttgagacagagtctcgctctgtgacccaggctggagtgcagtggctccatctcggctcactgcaacctctacctcttgtgttcaagagattctcctggctctgcttcccaagtagttgggactataggcatgcgccaccacccctggctaatttattttttgtatttttagaagagatggggtttcaccatgttggccaggatggtctccagctcctgacctcatgtgatctgcccgcctcagcctcccaaagtgctgggattataggtgtcagccattgtgcccagcccatcatgtgagaatttattgatctacattattctattttttaaatttttattgttagagacagagtctcactgtgtcacctaggctggagtgcagtggtacgattatagctcactgcagcctcaaattcctcggctcaagcgatactccagccttggccttccaaatgctgggattgtaggcatgagccaccacacctggctattctatttttaaaagttgttctactgaaatgtgaattatgtaccacaaaattcacccattttaagtgtactgttcattgactttggtaaatattcagaattgtgcagctaacaccatagtccaattttagaacatctccatcacccctaaaagattccttctgctcatttgcagtcactccgtgttctcatccttatctctaggcaaccacagtctattttctgcctctatagatttgccttttatgggcattgcatataaatggaatcacacaacgtctgttttttttttttgtgtgtctagcttcttttaataagcataatgttttttgaagttcatctatgtggtaacatagatccatactttgttccttttcattgctgactaatattccattttaggatatagcacatttggtttatcgcacatttgtcagttggtagacatttggattgtttccagtttttggctattgtgaataatgctgctgtggacatttatgtgcaaatctctatgtgtacataggcttcattctttttgagtgcctagctacagttccagtgtatggctctaccattatgcatttagccaaactccattggtggcaatttacttggttttcaactttttgggatgatataaataatgctttatcagccatctttgtacatacatctttgtatatatgagggactgtttttgaaggatatgtatttagaagggaaggttctgcatcagtggctataaacctttgaaatttcaatagctagcatcaaagtggtcttctaagagaagttgcccctaatttatgccaccactgtcctcacacacttgtcaatatgggccggaattaatagtctaatctcataagtgaaaaatctctcatagtcatttgaatgggaatgtctctcattattagaaaggttattgaccatttgtaagtccttttcttaattttgtattgggttgttgatcttttcctatggctttgaaataactatattttaggaaattggctctttgcttataagatgtactgtgaatttttttatttgtcagtttatcttttattcctccaaaaccgtgttcatggctgttgtgctgtacagatgttttacatttttaagtaatcatatgtgttaggagagaaacccctgtgaacattttacagtatcacttagctatttataatatccccagaaggaggtgaggaaggtaaaatattggtggggagaaacctgaggaatgttatatgtgctccatctaccaaacatctggatgattaggagacattttttaacctcttatttagtcatttttgtgtcctataagcccagtctccatgtattagtgtgaaatctgagaagtgagtctggattttttggggccttctggccccttgctggtaataatactgacagacattgattgaatgcatgctgtaggccatttgctccagttaatgcttgcaataacgctggagataggcagttctttccccatggaaaatgacactggactttgacagcaacttgctcaacatcatacagcagatgctggagatgggattcaaactcacattagcctgacacccgagccctgtgctgaactaggactccctccatcctcccttcctgaagcattggatgagttggcctagcactgaccaataaggggatatttcaacagggctttagaaaaggacaagatccccagcaaggtacatgtatggtgagaaggccactgacttgagcatggctggcaagatctgtgggtcctagtcttacctgctgcccaaactcttttcttgtaatgagagacaaggcatgtgattgcaacagagtccggggagtgaaagcaggaaaagtggatgggttcctaagacctttgtgggttttctgtttgctacatggcaggaattagctgactcttggcagttggatctcggtctggtggagagacaactggggcagtgggagaagagaggggtttcaggctccagctccaaagtcaaagtggtttctagattcatattgctctgcctgcgatgttttgacactgggagatgctgtaggggggttggctagactgactaggactggagatatggaaggcctagaaaggatatggtcaaaacccataaacatctcgggggtctgggaaagggtggacatactcttgctcattcactgcttcctcaggaaggctacggtgcccagtgcaactgtgggagggggccacacaaagatgaatcatttgcgggccctgcactcaaaggactcactgtctggatagggagatgggatctgttcagacgttgctggaagtaaggttgaagtgataacacaagaggttcaggtaacagagcagaaggagctcagactccgcagtgagacaggcctggcctggaattatgttccataagagcaacaacaacaatatccctcatgtgttgcatggtgtggtggacacagagttccctcgtcaggattgaaggacatatccccaggtccgggaagttactgtgagatgatagctctcagccgcctgccctcttggagaattgcttctgctgaagagagctgcctcacccaagatcacatccccttcccaaaggcccggctacctcaccacaacctgggacaactccaaagggccaacctcagcttcagtgcttccccgtggagtctgctgaggcctttactggacctgtagtgtggcctggcttcttgctcagctcaatccttcttccttctcctccctcccgcgggttttgaaactaacagcacatcctaatacacttcctgtatggtagtctacatctccgagtttgcttcccagggagcccaatctataatacatagatgatcatgatagacctctgagttgggattacttgcttgattttgcagctaaagcacttgagatttaggactcaatggcttgcccagagtcagtggatagcagatctcaggttcaacccaaatctagttcttcccaaagcactctctttctttgttgccactgtctaggtgtgtgactctaaacagtagaaaccatggggttataaaaccggcttgcaggaactgaactcaaagttcatttggttacagctcctgttctttaatctctggatctgagtttcctcctctgcaaaatagggacaacggtacttaaagcaaggtgttagaaggatggagtgcccaactcatcctgatttgcctgggactttcctaatttccccactgaaaaccttatatcctaggaaccccctccatccctgagccttgatggttggtcaccctatgtgaagatcagctgaagttgatccattgagtcattcattcagcaaatctttactgagcatctactatgtgccaggtgccattttagggtctagggatactgcatgaacaaagcaaagtccctgccctcctggagttacctcaggagcgggaggcagactgtcatgaaatagacaaataaggacatactatgatgttaagcactgataggtgcgatgaaggagactgaagagactagggggatgcggtgtgctgggctggaggctggagagaatgtcctgttttagggagaggggacaaaggaggcctctggggtgaggggatctttgtgctaagacctgaatgaagggtgagctggccatgcagatctcagtggaagtgttttgcaggtgggagaaacagcatgtgccatggccctgggcatttttagcaggtttaagaaagattcaggaggctgctgtggcaggagcaccatcagccaagggagagaaatagaagatgaggtcagagaggcatcgaggggccataaccatgcaggacagtggcacagtcagggggatttgtgactgttgtgctgagaatagatgatgagtctatttgaggatcagagaagtttcatgtgggaagccatattgaaaacatgggctcgggaatcagactccctgagcttccgcaccagtcagctgtggaaccatgaattattcgcttactgtgtttaagccttggcttcctcagtagtaaagcagggataatacagtacctgttttatggagtaggtttgttgtgagggttaaatgcaataatgcacgtagaggttagcacagagcctgcattttttttacagcttttctttttgttgtgataaaatttacttcattttaaatatttatttacaatatactgaagataaaatgtacagttttcaccatttttaagtgtatgttcattgggattgagttcattcacattgtcatgcaaccgtcaccactattcatctcagaactttttcatcttccccaaatgaaactctgcacccattaaatactagttccccttctcctccccaaccccctagcaactcctattctacttctgtctttgtgaatctgactactctaggtaccccgtatgagtagaatcatacactgtttgacctttcgtgactggtttatttcacttgcataatgtcctcgaggttcatccacgttatagaatgtgtcagaatttcctttctttttaaggttgaataatatcctattgtatggctagaccacatttgtttatctgtttatctatgatgggcatttgggttgcttccatctcttggctatctgttgaataatgcacctgcattctgtaagcactggacttacttttgccatagtttttatcctggtttgcttgagcacagggaaatgataggcacataggaccaggaggcaggagatgtaggttctagatttgggtggggctgactcatttattgagtctcagctctgtcctctgtgtggtgatgcaaatgcttacttcaggaggcttgttttaaagaccaattagatatattctgtaaacgtgatagttgtaccatccaacatggtagccaccaagccacatgtggctattgagcatttgaaatgtggttagtcccgtgtgagacgtgctgcaagggcaaaatccacgatggattctgagaacttaatacaaataaaaagaatagaaaatatcttgttaataattttttatattgattacacgttaaagtaatactattttggacatattgtattaaagaaaatatatcttaacattaattttacccctttttaattttttagtgtggctactaggaaatttaaaattacacttgtgactttgtgttttgattggacagcgctggtgtagtgttcactgcgcattttcgaatcataatcagcaactttctgggtgccccttcctgggtctgggatccgaagggagattgtctctcccagagctccaggctgacaagtgatttacatcaccaaggtgctgtagtctaaatggtgatcaatgtttatggcccatggaagcttaaacaagccaagagtagaataggcctgggcattgctgccagtaacgtccagcctttaacgtgcagttcttggctgcctccacaaagggcggttttcagcgtcaccgctctgctgggatttgtgatttagctccgtgctccccagcgacaatagatttcttcatttcaaagcctaactcctacgaaggctggggctgggggtagggagggcctgtgattgcccggcttacgccttctgtgtatcgctaattgtattaccacagtttctttagggaaaaatcatgcattcacttaggacttaaaaaaaaaaaagaccttagggagagttggtacctcgtttgggtgtagaatgttttccccctctggggcagaggagaaaagaatttctgttttgcagctaggagaaagctgttgtgtacacaccctccctcctccattttatctcccaacggataagatctgcagggagctgagacagccagtgtttgtcacagaaacagagatcagttcagagcccaaggccgtgggggcaaaggcatgtctagcccaggcccaggagtgagcggggtggcagtcagggaggcctggggagtggcctggtgacctccgaactctcttcatgctctgtcaacgccactgcttcctggctaaggctctgtccagggctgtgtgtccaggccctgaggctgtcacttctgtggcctttctggcaggccctctgccttctccagcttttctgagggtcacacagggccctactcccttggaattttgtcacaagaagtattctaacttggggtctaagtagtttccaagatgggttcccggtgtttgatggtttcattcattcactgctgaggtgttggtccctgaataatggaagccacagggctaggggtggtggtggtggagacaagtgcttcctagggtgtcaaactgtagcggtaatatctacatcctcctctcatgttttggtggggcgtgggggaatgggccagagatgctgccttagcaggccagagaccaggccccatcagtgagtgaaccacttagggcagggaaaatggttcctgccctgcctactctacaaggttgttatgaggatcaaatgaaatcccgggtatgaaagccatttgcacgttgtaaagggctatgtgaacacagtattacctttgctttttctgtagcacctagctttattacttaattagttcccaaatagttttgaacctttaccatgttccaggctctgaggtgggcacaggggcatacaatattgaataaacacattccatccccttatagctcaggggccaatataagggaaagacaaaaagcagacaattgcaatttagagggtagcagctgcagtaagggtgtgggcagagggtgcaggagcacagaagagttctcgatctctcctttgagggctgtagagggcttcctggaggaagtgacatctaggctagggtctgagggatggaaacaaacatgtggtcggttctcagttaatatttgataaatgaacaagatagttgtaaatgtctgtgaactctcaggataactgtcccagtgtttagttatcaatgtatagataggaaattgattcagagaggttaagtggtttcccagggtgcccagcacctaagtggcagagttagcactagaatccaagttcaaggctcagggtgattctcctgagcttgggagagggggtgattgttttggtcatagtgacaagctgcagctgcagggacatagctggtgggggcatgggatatggtgccctccagtttgaagaggacaaaaatgtctttatgagacccgattcccgagaaacagactgggagtcagagacttctgtgcaataagttccctgaggattactctcaggatcggtgtctatggaggagggcagaggagaagatgaactgggctggaaagcctcagctgatcccacaagggttgctgaagctagggtgacttttggagttggcctggcttggggagaagtggctgaattttatgccctcccatcaaccagtcactgcagttggttttcccacaaaaggaaaggaaggaggcttacttcagcctagagcatgttctggagaggggctccgctgggagctgtcagccactgtgggcagctggggaaatggtcttgccctcctggcatggggcatggactccagcagggacaacactagaagcctcagctgcgaggcacagagtcccaggcctgcgggagattcaggcccagcatcagctcaggggttcccacagagtggacagagggtttccagggggtgagcagagatggggcaggaatccaggagggggctcgagggtggggcaggcaggcagtttccatgtggaggtctgtgccttggcagggaaacctctgctccagacaagagttcactttagagtgcaggtctttgctggagcagggcaggctagtgaacatcagagtggtatcctgtgcaggagctgccccaggagggttttcagctccctggagttggggcttagagggtgacgaaggcttagcttcatggaaagcttggtgtctggataggctgtgtcttgggagggggctgagctttcagctggtccagctatggggacagaagaggccaaggctggcagataacgtgggcactaataccactcttccttcatcaaggaagagtctccagagtccccagtccaactgcctcaagggcgagctaatttggctgctgctcccgccatagctgtttctatggatacatttcaagacttagtctggtcatcttcaaaagcatcaaaggcagcaaaccccatccatgcataatcttttgttatagccccacaaatagcttttgttataacccttcccccgcctcccttccccccatcctccaaaccaaagaaaccggcttcactgtggcacagtcctctagcaaaagaagcattcgacttttttctggaagttgaaaggcctgagtttgaagcctatccttgccattcgtaaaatgcaaatagtaacacccaacgcacagagttgttgtaaggattcaatgagatacatggatctgaaaatgcacagcacattgcctggcccatagtaggtcttcatgaaatgttggtgtctttcctttctctttatttatcagttaggcaacttaagaattacatccctccagtagcactcaagtctctgtaacgtgtctccttgagtgttacatgcacttgatacagaataagctctccttgatgtcagtgtactctccctgatgacaaacgccaagtcattggtgattggagcctcataaggcgtctcttgactgttcttcctgctgactccctagttaggaaggaaccggttatagggtcctgaaggcaagtggactggtcttttcctctcttgtcaaggccaagcctttgctgggagcaggcagaggcacacagggcggggacgctccttgcctctggagagtctgttccagcagatggctctgctgcagttctgcttaggaggttaatggacaccagatgtctcagcaggcaagttttcattttctcctggaaccacttaatttggctgaacatctgccttggcttccaggcttttctatcacctgggcttcaacactgggtcagtggccagtggatgtcggaggagcttacagtcccttttcctcacctgaggtcttgggggctgggggtgccagcctgatttgtgggttaaaggtggtggttgagagggcaagtgtggggcatggttggcttccgtcaccgtccttcatgtctggtctgttgtcaccgagccttcctattagaaaaccaatattaagccaacaaaatggtgtgtgcctgaatggggaatatatccatctggaccaggattggctgattgtcaagagcagagggaggcctctggaattggcttgagggaggtgccaacatgctgaccctcctctgctccagggcctccctcggtgcatttccaaaccactggcagctgatcatctctgggtagtcatgacttgagttttgtttggaaagtgccattctgttactggtactgctggtttttaaatgagagtgtgtgtcagcctggcctaaggaccttagtaagctgtagattgctgggccccaccacgggattcaatacgtctatggtggagcccgggaatctgcatttgaagcaagcaccccaggtaatattgatgtacgtggtctttggactgcgcagaacaattctgcctggaaccctgtctttttgggatctggaaatttcttctgctttctatcccagggaggcacacactccttcatggtcttccttctttgcctgggaaactactcatccagtaagacccaggtcaaaactggcttcagctgtgagaccttttcagcccacgcctttttgggggcagaattacttgctttctccttattgcttccataacattttgcaggtgcttttgtaggatggcactactcacatttactatggtcttttgtgtgttcctttttggctgggagcttgtctttttcatctttctatttgtgctagaatatagcaaaatagcatgtcataggcaccaacaaatacatattgagtgaatgaaagaatccttgtccaaccccctaaatattaataacatattcttactgtatataggttctttctaaagtttatacaaatgaaacaattttagttttgataatatagcttatttatcttaaaaacaaagtatattggtgacatataaaggacacatactttttctttttacagctcatggtatgagtcctcatgggacacagtttaccttcttggctgtagctatgctcccctccaagcacacaggcgatgccttgcatacagccaccatattgtcagcctctcctttaatcaacttgcatttaaatgccattttcctggttactagccaacctacggcctgacagtgtgacttgcaattcataaggcctttctgaaggcttgatttttttcttaagcatttatactggtttttcatttcttttttgtcattgttcctttatttaagagctcaatggtgtctgtctcaatggcacatttccaggggacagagaccatgtgtttgtaaatctttttggatggggcttggtatgtcgagaaagaatgaataattgtagagtgctcatatagtttataaagcactttcccatcagccatgctttgagttagagaatacgattgcttcccctttagggactcaataactaggaagagacacagccaaaaactgaatgcagttctttaaatcccatgctctcgaaaatgatcattgtagcactatttataataaaaaacaaacaaaagcagaacctatttaataatgttacaactctttgatggaatattatacagccattagaaatgaggcctctggaggtgatagagccacatggaaagtattgtcacagcagtcatataaagtgaacaaagaaaaaaacaaaggacattggaaaccatttgattggtggtgggaggtaaaatgccatggcttaaaaaaaaatctcagtcagcgttgctagcacattggtgtgattgaaaaacgggaaaacaaaaccgaaccctccaccctgacttctgccggtacacatttgcatttatgaatgcttctgaggtgctgatgaagtgagaagaactttcagctggagcagagaggtagcgcgtgtgagtgagtcgcgggagtgtgctctgatgcagatgattaagcccattgcaaatgcagaattaagtaactctgataacggagcccttgagcatccttcttggagattaaacctttcaggcttttagcagctgagaggtgctggggattggagatagctggcttaaaaaggatgggaagggggggcagatattggatggggacaggaaggaaaatgcgccacattcaggtcaggattctgttctgaaattggctgtcgctgcgagaagtgctggaaaatgtcccattatctggagagagaggacagtgtgtctgcttgctgcccgtcttttcttgcttgtctttctacaggctggggttttaattttctgtgctggccgattcctccagtttgtgtatgagttttcattcttgtttggtgcctgggcctgttttacatgtgaatgccctttagaagaaaggacagtcctagccccgtttgctggggagagaaaggacaaggcctctgggccctgcaacctcttccttgcacctattgacgtattcatcctgtgctagacacaatgccaggtgctgggagtagacagacatggtctttgccttcatggagcttacaattaaacagtggttgctcaggactggatacctaatttggagggccctgtacaaatgaaaaggtaaagccccttttcaaaaattaagagtttcaagacagtactggcacagcaccaaaccaagcactggctactgaatgctaggtagattgtaagtccaggaagctggccccgtggtttcttcccagaaccttgtataaggagagggagttattccttccttattaccccagtcttcctcatcactgcatgtgggaattgaacagcctctgaagaagaagatgtcttccttgactcagtgggcctatgtagagaaataataaaacacagataaaaggcacgacaaacattaaataaatactggttgcccgagacatgtagctaaggccatgtagacatataaagaatgttcaacttttttggaaacatctgaacataaatcagatgtaatgacagaaagccttgtcatccagtgttccttggagcaaataggctgtgaccagtctaattgttacagacttgaaagacagtctctatagaaaggcctgtgccctgtatgataacacagtttactagtttctataaagcaacagacaacctacctgcaagtcataatataatgaagaataactacaataggatagtttttgtatttcccaaatattctctggaatattatttttaagaaagagattctacctaaattgggtaatttgacaaataagttttggaaaggctcatattctattccctcttggagatacacaattcatattaaagtcccatggctgtgaaggaagccctttaaacttttaacacaatgttatttgattatgacacctcttttagaaagtaataactaataacaatgtagttagagaacagggattctgaagcatatgctttggaaaatgccggtgatgtacttctaaacttctgagatgcatgatctgggatcacaggatctgggtttcagagccactcacaactatagacaagttacatggtcttctggagtctgtcacccaatctgttaaataataatacccatatgacacagttgtgtggtttaaatgagacactacaaaatgagaagaaacattttgcaaactgtgaagttgtcaagcgtttagtgattatttaactgatattgaaataaacaggaactattatctctgtttgaaagtgggtaaaccgagacctggagcgattaagaaaggaggctggagatccacagccatttcatggcagagccaatctcccaattcacagttctcagcaggatgacttttaaaccaactttgcttgtagattttagtttggaaaacgggccacctctttgacaggcatgtcctgtggaacagctagaggcagaggctggcatgaaaatgccaacttttctttcctttctagcattgacatctgatgttagcagaatgatgaattcaggggtgacagatttctagaggatttgtgtcctctttaggccagtacaccctgtcatctatacgaatcccttttctaccctgaaaaccatcgttgaggctgatttaaaagggaaggtggcttttcttgtcgtgagtgaaaaagaacctggtatgttctctgttgtgcatctttgaatggggaggacgaaaactttggagaggtgtgttttagaaaagaatatgttgtttttcttccttctttaaaatggaaatcatgccagagtggaaaatgtagaaacgggaattagaagacctgggttttaatcctgtttctgcacctaactggctgcctgacctttggctgttcccttactttatctgggtgcaactttgctatcttaaaataagagtattggactagtttgcaaaatttagggtttttgtctcttatctttgcatttttccatgtttatgtcacctttattattttctgcatatttttcttgaaactgatccatctattctgtacaaattgttttggagggaaatgttacaaacttctgcaaataaaaagtcagcattgatgctgtatattggaggtaactctaagacaaaagataggctggttcagagggcacattttttgttatgtatattttgtctcaattaaaaaattaaaaacaaagaaaaagcaaaaataagagcaaagaaaacataaaacacaactattaaaacaaatatactgtatttactcttttacaactgaaagctttcatccatcagtggcagtaaatgatccaaagacgaccttctggctccaaaggttttggtacagatgatgtttctagtgcaaactagcacaccatactgcccttgccagagagccacacatctttcttaatcacaccgtagccatggaaacgccccctcctccaactttggcagtccttaatgggtggtccccagggctcatggcttgtctctaggaaaaccccgccccgctgggcagacggacttgtcaaatgcatggttgttggtttcacctggattaaactgctctctccgtctggagggttcctggctttcatttccaaatcaaaatcctacccactctttggatcccacctcctgcagaaagcttcctgggattcctccaaagccacaatgatcttttctaaattttctccctaaattttcactctgtacaagtattttcgattgggttcttttcttttttgttgttttttttggagacagggtcttgctctatcacccaggttggagtgcaatggtgtgatcatggctcactgtagcctcaaactcttgggctcaagtgatcctcctgcctcagcctcatgattagcgaggactgcaggcgcacaccagcactcctggctaatttttttattttttgtagagatggcgtcttgctgtgttgcttgggctggtcttgaactcctgggctcaagtgatcctcccaccttgaccttccaacgtgctgagattacaggtgtgagccagtgtgcatggcttaggttgagttttttagaaatagagcctgagacggggccttgggtgcatgctgtttattggtgtgcctttctggaaatacctgtaaggaggtggcaacagaaggatggggagggggaggagctgagggaggaagtggcttcaggtaatcctagtctgggcctgatccatgggagctctgctattaatcacaccacaagttgttcctcacccctagatgagatgaacagccagctttttgtatcctcatgtcatcagtcactggcctcaggctggcagggtgggagtgggggtaaaccagtgttgtgttggacctgacccttacgagcttgtggtggtcacgtttttaggaacgttgtgagccactattaacaattaaatcatgtaaagttataattaagtaaataatgctgaaacaatggaaatacatattcaaaagtcatcacttcctaattattttactacagttttaaaaatctgtgcacttgcagttatttttggttattggatctttatggtggaaacactatgtgatggagagctatgtgcatctctccacaactccaccttcggtgatgtcttgctgggagcttggagtcggccatggtgggaatatttacaccagggaaagtggcaaatactcaagccagggctcctcctaccccaccagaaagtggctgctaaacatttgccaacacagcactgggtataatctccctcatcagctgggtgtggggacggtgggggtggcaattctccagaggacagggcagctgtgagccactggtagccaccacccaaagcagccaagggatggtacatggcctgggaacagggatctggacagggcacagtgttctctatggcaagttatttgaaattttattcacgtcctgacttgtggcatcctgtcattaggtttttattggaggggaaagaacaatagaagcctggagccctgggttctagtgttgactttggcactatcttgctgttgactttgggagaaggttgttttacatctctgttttctcacccatgaaaataggggatcagatgacctctcaggaggctttcagccctgcacagcctcagactatcctctcagctgttgccacctaagttaggagcatgagtacagaaaccatgtctcactgtattacctgcagaacccagcatgtgaaactttcctccttaatctccagacttagagactcaatcgtaaaaatagataacatttattgagcacctactgaatagaagacattttagatcttagctcatctaatctgtttatcaacgttatgacataggtttttttttttctattttacagatgagaaaaatcgaggcccagaaatatgaaattacttgtccagtcacacagctagtaaatggcccatttgggattccagccccacttggcttgtgctttcaactattttccatattaccctattggaaaaggatttaaaagaggctcttgctacatcagggtccccatttgggatctagagattgcttggtttcatctccccttccacctattctctgtcttgctcagtctcagttctctttcttctgggtggaatgggttgtaagcccctttgcaactcaggcctttgtaactgttgaataggcaaatgaaggaggaaggctccgaggatggaagccagctgtgcacttcgctgatgatctgggatgcacagaggtgggatggggcgggtgagcaatggaaggctgctaatgagcgtttcccagtgttgcctccgagggcggctgcagcctctgcgctgctgtttggggttgttggagccatcacagcacagccaggatttgcccttaggcttggtgacaggttggatcaccttcactcagaaggcctggccactctttgccatgtctgatctgtggtgtggatgacggcagctgacatggactcctcgccacctggaaatgcataaagtgcagcttagccccaggccaaggggagacgttctgtgcagcccccagagcctttgtttctcatgatttccttcaaccctgcccccaactccaacccagtgtcacagggatcttagtcccacctccccagggtctggcccaggatccccatctcccgccagcacttggtgtttgaaacctcctcgcatagctgtggtttatttaggcccctgccacccacctgggcacctcctctgcatggctccccatttcacagaaggtgctgatgcctttcttgtgattctgccagcagagaaattgaggtcagggagatcagccaagcacacttttcggtggcttttaaggaggagcaatcagttagtgatcactgtgggcagagggctaaggggatggcttcaaggagagaaaaaagagcaatcggatggttcctgaattgtagaaatgaacacagtgaaagtaccaggctgggcttgggggtcagaacctccctcaagcccctgaacatcagcttccccactcaggatttctcacttcagtgactgacttcatcatccctccaattgcccaggccagaaatctgggagtcgtccttgacttgtctccctcaccccacagtctaattggctggcaagtcttgttgtatctattttctgtctcttgagtttagtcctttgccgtggccactgcccactaccaagggcccaccagctcttacctggactggttcagccatctctttccaggccatggtcttcctgcttcagctctcctccctcagctcccccatccattcccctctgcagtcggaagtcttctagaggtgtacatttgaccttatcatgtcagctccaggttagagcctggagttactataacgattacctccagggcgaagttcagactcattagccttccaggaaaagcagctcttcttgccctgcccctgtttgactctctgtgatgggggtcccaaaactaccttaggtttgataattcacttgagggactcacaaaaattagaaaagctgatatactcatggttatggttcattgcagcaaaaggagacaggttaaaatcatccaaggaaaaaggtgcataggtcggagtccaggaagacaccaggcataaatttccagttgtcctctcccgggggagtcacttggatagcactgaactctcccagcaatgatgtgtgacaaaacatagcagggaaacccaactgccccttggtgtccagggtttttgttaggagaagggagtcagtcacggaggtatgagtcacccacgtgactgaccttggctactcagtctctatgcaacccctgcatgcctggaatcaaaccgatacagcatgggctgggactccaggtaaacaaaaacaggcctttatcatgaattacactgttagcataaactatgtggggtggcccaaagccccagcgatacaaagatactctattccatcaggcacgatattccaagggctcagaggttatttcccgggggctggtcaagggccagttctttctttggaaggtgcagagtttgaggaccccaagctagtggagttaaccttttattgcatacctcacatccacgattctctccagtattaggccattcttgcattgctataaaggaatacctgagactgggtgatttataaagaaaagagatttaattcgctcatggttctgcaggctttacaggaaatgaggtgccaacatcttctggggaggcctcaggaaacttacgatcatggtggaacctgaaaggggagtaggcatatcacatggcaaaaacaggagtgagagaaagtgaggggggagatgctacacacttttaaataaccagaactcacaagaactcactgtggtgaaaacagtaccaagggggatggtgctaatcattcatgagaaatctgcccccatgatccagtcacctcttaccagggctcacctccaacactgtggattatcgttcaatgtgagatttgaacggggacacccatccaaatgatatcatctcccatatctcccacattccagccatattatttagcttgcacattcatgactctgcctttgaccatactgttccttctgccttgaattcccttctgcctcatcttccctagtctaactggagagctctcactcatcctgtcctgtgtggagccttccctgatgccccaggcaggctgagtttcctccttcccatgtacataggcactgtcaatgcgtgccgtaatttgtggattcttcagcatcctgtggatgggttcaggtctgttttccacacaataggaaacaccattagctcctttagcgtgagaaatgtgcagtccattaaaatgtttattttatgtttttccaatgataaaagcaatacttgctcatggtagagaaatttgggcagcatattccttttcagctttttctctccaatgttttccgtgtgtgaatcattataatccgggagaccatagtgcctgggcctgggcttgcctccacagggctgctgatgttgttccagtctctctaaagtggtgaatgagggcgactccacacctatgctctcccagtctccagagacttgtgggatgggctgggaactgaggacagagtgtggaggagggggacgagaaacttctttttttttctgtaggaagaagaggtggggtagggatggagtaagggaagacttcccaaagaagtcgacacttgggccagaacttgaaggaactttaggattttgctcagggatgggagggaagaactttgcaggccaaggtcgtggaacaaaggggtgactggctgagctcaaggcagtggggctcccctcccctaagggtccccagccctgggatgtgacataccacttgactttcctttgatcctacacaggagttgtttccagggggccacccttactgagctgctgaccccaagttctgttttagtcacagggcttcttttgtttgttttgtcatttggctctggatgtgtgtgaaatcctaattcaggccccagatagctgaccgactaaaacctaatgaaacaaaaagatggaggaaatgtgccctaaaacagttgttgagtaaccccaggtagcttcagtgcatgccagctttaagcctataaatacatcgatgggcgcctctttctcttctgaaacagcaagccccgaggattggagccagccagtgatattccgttatactacattttcagtttcagggaatcttttgagcaaaactggaccttttgggaccaacctgtcatactcgagaccatggcgaaacctatctgttcatgccaagagctcagcgtcctacctgagtcctgctgaattgcctgttctcatctcctgccttctaaatcactcactggtgcttcctgtcatggtaactaggactttccactccttattctgcagcctttgacatcaccagggctgaaaagatcactgggccttcatggggtatttttccaatgcgaattgactttgtatgtgttggtgtaattaccagaatcttccaccgattgtgtgaggatgtttctagacccagttctgttctattcttgccgtgtgtcaatccctactttgtcacttactggtcctgggatattggatgggttacttgaccactcttgtgtgtcaatttcacccgttaagcggggatgattatttctcagtgttctggcaggattaaatgcgaatatacatgaaaagcacttaggatagtacttggcacatagtaagcatttagaaatggttatagtattatgactgtactcttagatccatctcctgtcttaaactctggattataggaaaataagagattcagggagagctgggttctttttatcaatttactctgtgatgctgggtgtcagttcttcctttaaggccttaatttggccacagtgaaaatgacaggggtggactcaatcaggaatgacagagatgtgaaggacatgaaacttctggattttctcacccatttcctactgatcccagacatgctctcagactattctgaatatagccctcctggcagccattgtaaatggattagaaggcacttgagctgaaatctgttttctgtccctggattacaggaagtgtagggaatatggggtgcatgggagatgatacagtttggatgtgtgtccctgcccaaatcttgtattgatctaataatctatgatcttgaataaagggattggaggagtccaattttcaggctccacagatacttcatccccttcccatacagctctgcccattaaatatgacaatagataaaaactgacttccagaagggactcgggacaaacgatttgatggagaataagcaggggcttgccttaccagctgaaacatttcctaaccttcagtttgtccagttctctctgcataatattcaagacagttttacggaaggtctgaacacatctcatccccggctttggatttgtttttaatttgatttagccaaggagcagaaaggagacaagattgactggagctcagggtttgtaggataaaatcctgagtggacaggaccaaattatggtggctccttcttgactgtgatgatatgtcctcctctgaatggcagaaatctagacaagtgttttgtcttcagtggaacctacaaaaaaaggacaaagaccctgtagcagtcactggtctgattcttttagcttctgttctttctttctaccatccttcaatgaatccagtgctctgcttaggaataccaccctttctcaagtttactcaaattctttctttaataatgtaaagagaattcccaatgtggagagaatgggcaggggagcagggagcagtagttcttaggccaactttgcatctttccctatttgcatttattatcatgcactaattattcacagagagccttgccctttgtgggttcgcattaatttagattgcttttgaaaagcaatcaaggagggaatgaagtgatcacacatcaaagggaaaaagatatggcaccaaagagaggcaatatgctttgcacaactggccatgtcaggttgctctgagctttctccagcacaagaaatatcagaaagtccatctgagctctcctagccctggtgtggccccattcatctttcttcgtgtccattctgtcagtggataagaaggtggagaaggcatatgtggcagatgattgctgggtggagacaggactcttcctcactcagcctcagtttcctcatctagaaaatgaaaaggtggattagattatctttcatgcccttctctctaggtctacaactctctgccaaagttgttttgaagacctataattgtgtaacataacaaatggacacactaattacctgcttctaatccataaggttctccttgctcagtcttcccttgggtattattaggaacagaaaggtgaactaatatttctgtatctctctcctgcttcaattatccgtgctattaattttggtcatggatttttcagttgtcagccttttgttttatttgggttcttacaaaaatctgtgttattgaagtataatgtacacatagaaaaatgcacgtttggtaagggtacagctagatccttgctttttgtgatcactgtcttgtattctttctcccctcaccccctcatcctacttccttctaatttgggatgggcacagaaagggtctaggaccagagtcccattccaaatctattgttcccataggcttctggcagagggttgtttgctaaatgagtttgggggatttgttgtgaacctggtttctgtttctgtagtcactgtcaagggtgaatatgaaggattgcaggtgttctgagggcgtctctgacgggtataagtcacgtcgtacacggccttgcatgggacatccagtgagcgagcgttcggtgaaatgagatcgagcctgagggtaagaccctggtggattgaagaggttgtgagggaaaaaggaggcagggcaggagagagaggcagagcatgccctgtcagcaagaagcaacacagatgaagctgtggcagggtctagatttatataagccaagggggctggtggtgtgcacaaaggggcagccagtaagagacagtggctgacttcttaagctattcttcccgggggaagaggcccagggctgggtaagactgctcgatttgtgattaggaggttggtgaagactgtgcttccttgaagaggtgaaaggtgctgtgtggagagagaaaggatgtggagcactcagcacagcgtctgggcgtgggctggtacagttctccccgacttgccctcaatcactggacagcagtgatgaaataccactctgccccttcctcagttagtccactgactgtaccccctctctgcaacttttcaccttggaggcacattgccttttagaaagatcgccattaaaactttttgctgagggacaaactaacacaagaacagaaaaccaaacaccgcatgttctcactcataagagggagttgaacgatgagaacacatggacacagggaggggaacatcacacaccagggcctgtcggggggtggggggctgggggagggatagcattaggagaaatacctaatgtagatgacgggttgacgggtgcagcaacgcatcatggcacgtgtatacctatgtaacaaacctgcatgttctgcacatgtgtcccagaatttaaagtataataaaaaaaattttaaaaacaaaaaactttttgctgaaggaaaagtaagaacgtggggagacttcagtgcccactggctatagaaagggctaattaaccttgctttggtgctgctgaaatgacaagctgttcctctgtagaatagcagatgcccccgatgtttattcaagagcagcttattgattggtggactcaaattgagtagatttcaataactggaaataaacatccaccttagaccgcctaaggacacagcatgattattcctggggtcagtcgtacatggcagggtttggggagggcgggagttgacctgctcaagctggttcattccttcatctcacggttagctgaggttctctgaaggtcaggttccctatctacaagatgggcgaagtaatacttcactggtgaattacatgaggattaaacaagtttctgtttctcaagtacttatggtagtccttagcatgtggtaggtatttcataagagatgatattgataatactaccagcaagcatttattgagcgtcccaggtgctgttatagaataaataatacagaacccctattcttaaggagccgacaatgtaacaataaagaaagatttatattactcaggaagtagtcacaagacagtgtgataaatattgtaatagagagacactcagggtactatgagaacatagaacgtcagattctctttgggagagaaggacaaggcttccctggaggttaagttagatcttgaaggcagaagggcagagaaaagccttccaggcccacaagactccaggttcaaaggcgacaaggtttgagacaatgtggtgctctttaagctagcataactagtgtgatgtaccatgagcaaaaagggctttagcaagtatttataacagtttgtgggtttgaaggggtgacacggttggagaatgctgagttgctgggtttggttggaaagtggaactttcccaacacttagctaggttatccttgctaaccctgtgtgcctgcccactcctggccgctcaactgaatcctcctgggagcatttggggaacaatcaatcttggcatccaaagctcattacagtctgtttctaatctttctttcctctaatctcgtacatcaagacatctcaatcaggtgcagtggctcatgcctgtaatcacagcactttgggaagccgaggtgggaggatcacttacgcccaggagtttgagaccagcctgagcaacatagtaagaccctgtctcaaaaaaaaaattagtcaggccttagtgctacttgagtgacacacgcctatagtcccagctacttagggagctgaagaaggaggattgattgagtctgggagattgaggctgccatgtgctataatcttgccactgcactccagcctgggtgacagagtgagaccttgtctctaaaaaaaaaaagaaataaggaaggaaagaaaaaaacgacttctcaacatttatccagtgcagtgcccccccaccccaacaaaggggtgccattgatatgcctcccttccacagtcagcccagttcacagatggctccttcttcctctgaaacccctctttgaccactccagtcatgatcctccctgccccgtcttggtgctcagggtagctagtgtgaggggctggaatctggcctcgccaggtaggtaagggatagagaggctcagtgtggaagaggccttgcatggtgtccaagggcatgcagcctgtccatgggaggttggaatccaggcaggcaaagaggtcagtagtgattgtgaaaccacaaatgccccagtcagtggatggaatactgccaaggggactctagggcctatgacccttgggaatcatgtgggaagaccgaagactctaataatgtgggaagaccctaattttttatagttttagagatggggtttcaccatgttggccaggctggtcttgaactagtctggggagggaggatgggaagaacaaggtatactagggagatgaccaatacaacagccagcccagggcttgggaacaaggtgggatccttgctgttgcactgaggtttacattgtggaagccacagggtggggtccaagctgatttataccttctgagctgatttatacctgaaagggatggttctggagctgggggagggaggctcttgggaggaggggtgcaaggataaggagccaggctggactggataacctccctcttctcatctctcctgtaaagcacctagttcgttctttaccatttgtttgacccttagcctccgaatgccttttacactgtggccatgtcctcatggaacttccgagtggctctgcctaattcccattctaggctataaataccttgaaggcaggatctgtgtctgcatttctaataataataatgacattaacaacacccatttactgagcatttcctttggatgctaagagattacgtggatggttgattccatcctcctgttaaaaccttgaggtctacttatccctgttttaaaaccttgaggtctacttatccctgtttgacagatgaagaaactgacgctcaaaagaccttaacacctggtgttgaaggtcccacagctagtagctgtggcagttcagattcaaattcagtctgatgcaaagtctctatgtctaatccccttgctgtgctgtgaaacaaaatcattctaactcactgaagcaggttttgttaaaggtcatgactgtgccgggcagcaccatgctccttccttgccatggcctctggcttcaccttgcccaatattaattaattgattgaaatgggaggaagtcgagggtgtgggcaatgcagagacacctggcttggtgccctttgcttccttaagcccctttacagaggggactcctgagagcagatggaaatgtctgcagggagtatttttttcaaagggcccccgaaagcattctgcctagcaacaaagagcctttcagaatgcagctccaagaggaggcgaggagcttgcaagctgagaaccgggaagggctggagtcgctgctacaactggctccacaaaagaggcaagccgcagaggattgagtttcatctcggggtacagctgtgggggctgaggggccggggctgggggttaaggctagggagactgagaaggtctttaggtgaacattacagtgtgtgtgtgtgtgtgtgtgtgtgtgtgtgttagcaaatttgtgttttagtactatatataacacaaccatgtggaaggacatgttcaactagtttcctagggagccgtgtgttcttaattaagaatagttttaattataaaagcaatgcatgcttgttataaaattaaaatattctagaggtatgtaaagtaaaaattgaaagcctttgccatctgccccaagtaagcactgttaacattgtgctgtgtattctcccagacttgtgtgtgtgtgtacaatgttttatacgtacataattaaacatctgtataatagatatgcaattataatgactaggttttcttgaatgcttactatatgccaggctctctagtaagtaagtgccaggtattccatgttttcatgacctcatttaattcttgcatctctgtgaagttagatattgtatacatttataatctgctttcaagggagagggatgtgagactcagtaaggtgcaaagaggtagaagcagagtttgacccaggcgccgtggctgcactgtgcacactcttccctgccagcactgtgcctgctatttaaaacaatgtggcatcagttcagctgtttttgcaacttggccattttcctggtcccttcctgggcctcctcctctctcagattcccagttgatggctctttcctctgttcaatgggtctgagaatgccaaagcatcggggactgatagtcactgggtgagtttgggtgacagaagaatgtttccccagagatcctgtgaacctgtgaatgttatttcacacaacaaaaaggactttgcagatataattaaaatctttgggctggtcacggtggctctcgcctgtactcccagcactttgggaggctgaggtgggaggatcacttgaggccaggagttcaagaccagcctgggcaacacagtgagacctccatctctataaaattttttaaaaaaattaaccaggcatggtggcacatggctgtagtcccagctacttgggaggctgaggcaggagcatcacttgagcccaagagttcacggctgcagtgagctgtgattgtgccactgtactccagcctgggtgatagagcaagaccctgtctctataaaacaaacaaataaataaaaattaaaaaaattttaaaataaatatttgtattagtgtcccaggagtgctgtaacacagcatcaaaaactgggtggcttaacacccacagaaatgtattgtctcatggttttggagggtggatgtctgaaatcactctatcaggaaggcctcgctctccctgttggctctgggggaaaatccttcctggtcttttctggcttctggtgtgccttggcttgtagatgcctcgctttggttccatggctgtgtccccactgtgtatcttcccgtcaccttccctctgtgcctctgtccaaatttcccctttttacaaggatatcagtcatattggatcaggacatgccctgatgacctcattttaactctatgacctctataagagccttttcattttttattttatttaattaatttatgcccccaaattagtagatgcttttttgtgttttttttttttttttttttttttttgagacagagtcttgctctgtcatccaggctggagtacaatggcacaatcttgggtcactgcaacctctgcctcctgggttcaagtgattcttgtgcctcagcctcccgagtagatgggactagaggcatgtgccaccacatgcagctaattttttctatttttagtagagatgggatttcaccatgttggtcaggctggtcttgaactcctggcctcaagtaatccacccaccttggcctcccaaagtgttgggattacaggcgtgagccaccgtccccagcccatgtaagaccctttttaaaattaaggtcacatttcgagttattgggatgaggactccagtccacctctttggagagttagagttcaacctgtaacaattttaaaagatggagattatcctggattatctagcggtccctatctaatcacgtgggcctttaaaaaatgataactttctctggctggagccagaagagcgggggcaccagaagggaaaatcagaaggttatgatgcgttgtaccctccctggctctgagatgtttgggcccaggcacagagaccggagaggcctgaggagcagagggcatcccttgcgggcagctagccaggaaacctcagtcctacaactgcaaggaatttgattctgccacagccaccattcatgaagaagcagatttttccgagaatcttccaataagagctcagcctgataagactctaagcaaaaaaccccctgagtcaacctggacttctgagctacagaacggtgagataataaacttgtgttgtgttaagtagctaagtttgtggaaatttgtttcaccagcaagagaaaacgattaccattaccttcccatttggctggcccttcaatgccttaaaccaaagaaatggcctatgctggaaatttctttgggtctcaagtttaccttcttgagtctttgaataatgccacccacctgtgcagcacgtgacacttcccggtacatttcacacataatttcattcaattctctcagcagccctgagaagtataggtatattatgcttcttattttacaaaggaggaaactgaaatttaaagaagtgattttgcttgaggcttcacagaactggggttgcaagccaggtttcctgcttccaaatcacatgcacttttttgccactgcccccggctgcctccgtgtctccagacatctgttgtctgaacacagtttctcctatccagtgggctggactttctggtgagactgtgagcttcctgttgctgagaaatgactgagtgaagccggcggatggtgtacttgggatgctgaggagagactcgctggcatttgcaggaggtgctggcgggtgcctcctgatgccatgttcaactcaggatctacagtgggaactgggatctgctctcggggctgcattcagacagggtaaagctctctgggaattgccctggccaggagacagattcgcggagcagatgaggtctgagtgagggtttgaagaacacgtaggacttagagaggatgcttgtgtttgggtttctcgtgtgattgcagggtatggcttttgcccacgccttccactccagttgctttggtgaaacttgcctgtaggaactggaccagacttgaagtcagcctctgggcctgtcctccccgccctgctccccgagttcatcttggtggttgagggtacacgatgtggtcgcctgcttctgcagccaaaagaaaagtggtgggacaagagagggtaaggggaatacacaggctgagaataacttcctcctagcctcacttcctgtggcttcccgctcaccctgctgtaactcttattaactctccgtgtctttctgtgggtgggaaccaaacagcctgtcttgagggcagctgtctgcctactaaaagttccctagcaatggccacttgtccttcctgagccttgggtgttccctcctcaatcttgttccctgcactgccgaggtgactgacaatgtgtcctccccaggccacacctctcttggcagctgtgaaaggtggtagaagccattctgtccctccctttctcttgaatgtcttggagtgctgttcaattcaggagttccttctaacacatcatgtgttcctgcactgtgccgagtgcaatggggatgccccagaagtgttggcctcgcaggctgcagcctggaaggcagtgtggctctgtagagaaagagaacttgagtattgaccgggcatctggccctgtgctggacctcagggacacaacactgaacaggacagcccaaagtgggtgtgcaagccttgattctcccacttggtagctatgtggccttgggctagtcgcttgacctctacgtcttcacagtcaggtcttatgaaggccaacatggcaccttggaagtgtgttgcaaactgtaacactctgtggagatgacgttgttagttattatgccctcggttgattctctcagtttccttgtgacagaggcctggaagagctgttatacccattgtacagatgagaaagcaaagccttcaggagagtgaagagcaggagcaggaatgagaactaaatagttgacttcttgttgtgaccttactcttattttatcatgtggctatagccaccaggcatccattggtgatggcatctgatgacattttcaacatcagcagcatcaataactaacatttgccaggtgcttactaagtgccaagaactaagttaaaccttttgatgcctattattacctctactttccagatgaaaaaaatggagactcagcaaggataagtaacttgcccaaggttgcttttctaggaagaggcagagccaggcttcaaacttaggtatgcctgattccagagcctagactggtagccttgatggtacctgcgcatctcatccagttgtgcatctcgacctaacatattgaaacaactagaaattacacaaggcagtaggaaggggatacgctggcaggagtcagtcctcctcccaacccccagaggagtgatccaggcagctgggactgtgtgcatcaagaagagatggtgtcctgaagccttggtgtatggtgtcctgaagttactgggtggatggatcttgttcgatgggcaggatcggaaactcagaaggacagaggctggtatgaacaggggacatgggggagaatggggtcaggtaagatgggcagggcctcagagggctgtcagtacagcaaaggaggtgaagttggtttgggcaaccgttgcagctgtggcctgagggttagctgagctgcccacgtcctggccacagaaggaaattagtacccagagacatctccgggtctagggcggaacaaagatcctgccctatttgtttttctttctggggccttgaggttagaagaggggcacagcttctccctagggactgggaggaggaggtaggagaagggagggatccaggccatgggaggcattgggagcatccgtcatgccgtcagcctgctgcaggagcactggcctgggagtctacaggcccaggtgctgtgctgctgtctggctttgtgaagttggatgattgattcctctctggatctcagttttttaaactgtgactggagagatctatcagtgaaaactgttggttgcaagtgtcaaaaacacaattcagactggctggaatcaggcatttattggctcatgtgattggaaaatccagggagagttgtgattataggaaggcctaggtccagaggttcacacggtaccatcaggggtctgtctctttccatttctcagtgccagtttcctcagtgatgccttctgtcacaggtagcctcagtctttgaaatctcaaggtgactgccagctgccccaggcttatcttatttatttttatttttattttttttgagacagggtctggctcgttacccaggctggagtgcagtggcatgatctcagctcactgcaacctgtgcctcccaggctcaagtgatcctcccaccgcatcctccctagtagctgagactacaggcatgcgccaccatgccctgcttatttttgcatttttagtagagacagggtttcaccatgtttcctaggctgatctcgaactcctgggctcaagcaatctgcccatcttggcctcccaaagtgctaggattacaggtgtgagccaccacgcccagccccaggcttaccttcttcaggcatatcaacctgcagaaggaaagcagctcctagtagttcctgcagaggtcctggggcaggtgcttgctggtcctgcttggttgtgtgtccatctctgggtctatccctatggccaggagatgcccttcttctcttggccagaccagggtcacatggtcttccctagagtaggagttaaagttaattccacagaacccacaaggagtaagaatgggaggtggtgatttcccctaaagaaacactcaagtgttgatgccagaaaagagagagtaaatattgtacagacaaaaaccacagatgctgtccttggcacccagtggctggtctgactgtcttcaaatgaagccagggacttgggcccctgacagtggagctcctctcaactgtattaagatcatggagacctttgagtatacatgaaagccacggacctccttcctagaaaggcacatgggtcagactccgtggcatggtctctgaggggctgcaccatctctcctgcctcctccaggtcccccagccagttccaccggcctcctcgctgctccttgtactcaccattcctccttccaaagggccttgaacttgctgctccctctgacctagttaatgcctcctttacatatggtcaaattgcaccgtaaacctcttcatcgcaatttcaactgaagttgtaaatttcttataggattatttggtcagtatctgtctctctcaccagaatggagactccgtaacaggagggacctggctttgcttccttttgtgtccacatcacccagtagagtgtctggcacatagctggtgcccagtagttggtgagtgaatgtgtgcccttgaacacacgatttttcctgaagttttagttgcatacacttccctagagccagtctctgaacttcaggttaagaacctcaggatagaaaaaataggaaaatcaaggcattagcagcaaggtcatgcaaatgaggacctcccaggccagctctcctgataaccttgctgctattgacttaggtttctgtcttttaagtggagttgatacagtctggatatttgtccctgcccaaatctcatgttgaaatgtgatccccactgttggggtagggcctggtgggaggagtttgggtcagggtagaggaggaatccctcttgaatggcttagcccatctccttggtgatgagtgagtgagttcttgagagatacagctgtttaaaagtgtgtggttcctccccgccccccacttgcttctgcttttacagtgtgatgcacctgctcctactttgacttccaccatgattggaagcctcctgaggcctccccagaagcaggtgccaccatgcttcctgtacagcctgcagaaccatgagccaattaaacctcttttcttatatattacccaacctcagacatttctttatagcagtgcaataatggactaacacaggagtcccatggatgattacttgtgggtaaaatctgtggtcaaataaatctgaggaacactgtctaatctgtgctccttttggagagtcacaacatatactaataacagtaatatttatttcttatgatcattagtgtaactgccatttatgaagggcttcctacatggtaggtaccctatgaggcccttcatatgcattttcatgccatctcatcatagccttgtgtgacagatgccatcatcaccctgtgttacagaagagaaatgaacatgtggagggattaagaatcccaagctaggctggttgtggttgctcacgcctgtaatcccagcactttaggaggccgaggcgggtggattatgaggtctggagtttgagaccagcctggccaacataacgaaaccctatctctactaaaaatacaaaaattagccgggcatggtggcacgtgcctgtagtcccagctactctggaggctgaggtgggagaatcgcttgaacccaggaggcggagtttgcagtgagccgagactgcgccatcgcactccagcctgggtgacagagtgaggctccatatcaaaagaaaaaaagaatcccaagctaccttctaggaaacagaagatttggtgctcaacccctgccagtctgatatgtgtctatgcactttaatccctcaagaggtgggaaatcacctttgctgataacggagccctttttctctctaaacatgtagaagcatcccaaggaccacacctggtttgggacatgctggtaaagtgttgatttccgttgatggtctagaacagaaagaatgtagacctggcacaggctcaactccacaaatatttcctgtaccaggcgtggtgctaggagtgccaggaatgcggcacaaagctgcatcctcattgcctgggggtacccagagtcccagcttttccccatagcagaccagcctttccctgagctgccccaccttgagggctccccgtgctgggtccttctgggaccatccagctgtgtcttccctcaggggaatagggctctgtgtcatgttcatgatgagttcacagcaaaatgcacattcattctgtaaatgtttatccaggactttctgtggccctggcttgtgctaggaattggggatacagaggcaaacaaaatgctctcttttcgtaggacacccgtcgtctagtaggggagacagagcagtgcagaagaaaccataagaaaccaaagtataagacaggtgaagtgccctgttagagatagaaaccagcctgctgtgggagttctgagatatggatgagttctttctttctttttttaattaacggaattattttggcttgggatttaagctcatgcttaaatgatgttggaacatctggctgacaaacaaaccattgtcagcctcctaggtgtttggctgacagggcctgtgttcctaagcatcccggggagtttcggatgtagggggactgtgggaatgaggcccagcagtgcctgcatgcactgagtgctatcacccccactcctgcacacagtcctcccagtccacggaatgacgcctccctggtgtcttcctttgctgagctgctcccatttctcacatgggcctcagtcactcccatgagcctcaggaacaagcctacacttgctttctgctgccctcagtttcctcctctgtcagctgcgagtactgattcctcctcgggaggatcaaatgagatgaaaaacatggggagaactttgcaaatgggagtccccctggaggagaagtagcagattccagccccctcactcccgtctgggtgcgacttccctctggtgagaacgggcaaggtcaggcgaggctggaattctttcatgggtcctgaaaccttaggtgaactcccgcctgtgcgtctttgctggtacattcagtgagatgatcaatatgacgccttcagtgcagcacctgccatgaagtcggtgcttactaagtagtggtggtggtggtttttctcccttcattctgcccgcagtctcctgctctccttccctactccctccaccttgctttctccctccgtttcctttcttccttcctcccatcttcacttcctcatttactcatttgttaaacacttccaccctttaaaaattattttaattgtgataaaaaacacatagcagaaaatgtaccatcttaaccattttacaacgtacagttcagtggcattagatatatcacattgctgtgcagccatcaccaccatctgtctccagaactcttttcaacctgaaaaactgaaactgtacaaactaaacaataactcctcattccctccttcctctagtccctgtctgtgaatctgactcctctaggtacctcatataagtggattcttacacgatttgtccttttgtgactggcttatttcacttagcatactgtccccaaggtccatccattctcttccttttgaaggctgagttgtgccccactgtgtgcctagaccgcatctggttgacccatccatccgtcgatggacacattatgaatggtgctcctgtgaacactgtgtaccaataagtgctttttgagcatgatcacgtgcctggcattgtgctgggctgcagtgggaaatgaacttggttcccatgctctgggggtaatgttaagaagcaaacaccaatagatgtttactaagagactgcaatatgtcccgtgatgggaaagagcagtgttcggggagagaattatggcaggggtggaggtgggtggctgggacaatggtcaggtctcaggaagtggcctgaagaatggggaggagaggtgggcaggggtggggagggtccaggcagaagtaacaacatgtgtgaagccactggattgcgacagagttgcccgttggagggattgatgcttagatttctgcttcagtgtcttctccagcaagcatcctatcagcctccaggcccacctctccccatcatcttctcctctctgctcttattctagttcattcaaactgcctctttgctcagctatttctcccactgtccagtgagcggcttgagtgcaggaactgttttattttatgtttgcgccttcttttcatatcttagtaggtgtcagtgactctcaaacagatactctcctgaaggagggtagtgctttcactggcaatgacccaagaccatcatctggggcctgccagagtcaggcacagccccggcattagaactttgggctgtaagcctgtcctctgtgcttatgtgggtggtgcacaaagcacttgcaaacatctgtgtgcagtgctgctccattcggcctgctgaagctttcctgccctgttgccgctgaagcagggagtgtgggaagcgcccagctcagagctgggccagatgtggccatacctcccagcagtgcaagcagcatcactgcgccaggccagctgactcggctggccctggtgcacagtgcttaggggcttgtggccacgagccatgccccaccacctctcctgtttgccttggtagcttcccagcttcctctcacatgactgtttctgtttacttctccctctggccttcctgcctgcggcgtccctgtgccacctagagtctcatctaccgcactagacatagcctctgcaatggccccgcaccagggcctccttccagggcatatcccgtctctgtctcacccttctagtctgcgcttgcccttctcactccccagctctctctgttactgtcagtggagggtctgtgcactttgtcgttttgatcctatgacgttgtatctgtggctcttccttcaagtgcccaggagaggcccagctcctggggccagaaaggggttagtcttgaagtcttgggttggacatttcaccatggccagcccagagctcggctggaaacagatgagagacaacatgtgaggaggcagacaggagctggggatccaggctctgagcacctgagaggtttgggggaaggtattggtaatggattggattgtgtcccccaacaaaagattttcaagtcctaacccctgtacaggtgaatgtgaccttatttggaaatagcgtctttacagaggtaatcaagttaaaatgaggtcatttgggcaggtgcagtggttcatgcctgtaatcccagcactttaggaggctgaggtgggtagatcacttgagtccaggagttcaagaccagcctgggaaacatggtaagaccctgtctctacaaaaaatacaaaaaaattagccattagctgggcatggtggcatgtgcctgtagtcccagttactcaggaggccgaagtgggaggactgcttgagcccaggaggtggaggttgcagtgagtggagactgcaccactgcattccagcctaggcaacagagcgagaccctgtctcaaaaaaaaaaaaaaaaaagaaaagaaaaagtcatttggaaaggccctaatccattctaactaataaaaagggagaattgggacatagagacagacatacacaaggagaaggccatgggagcatgaatccagagatacggcaggagacgagaaatgccacattgcaggcagcccccagaagccaggacagaggcatagaacagattcaccctcacagccttggaaggaaccaaccccaccgacaagcaccgtgtcctcttccggcccccagaaccgaggcaatacatttcggctgcttaagtcactcagtccgagatgctattgggccagctcccagaaatgaatatagtatttggatcccatcagagcctctcacctctgagtatgggttggtgtactttagctatctggttccttcacatcatatttagtttgggcacacaggggctattttgaagcatccaggcaaagattttaataataataaaaaaacttttaataagactttaataagaattttaataaggttctgatgagaaactcttggatgtccttccaagtcatgtagaaccatgcgagggataataagactcataatcccacttatttttatagggcttcagttcacaaaaaaagtccttctcatttattatcccacttgaccctcagggcaatcctgtgctgttagcactgtgggcattcccattttggagaggagagaactgaggcgcacagatgttccagaattgtcttaagtggcagagtggggatttaaatgcagggctctgacccagcctcaccctcttcccatgcgctggaggctgcctctgaacttggagcagattggatgtttcgagggcagcttggcctctgcctggggcccaaggagtaacacgttgtcttaattcttttccagtagtgagggagaggggacctcaggtttccaggactttttcaggttctcatggggctctgtggaggctgctggggcctcaggggttcttgggtttctcttccacaatattctgttgtggggcccaggccctgaagggtcaggccatctatagcagggcacagctggcggaagctgactgcccaaggccaggatcagcactcctcagatgcgtgcgctgtcctgctgctgagggacagaacaggcctgaatcccatggccttgctctgccagcaggctggagcgtgaggacactgtgtgacccaggcctcttcatggctcccccagcgctgagacagtgctcattacacaccagcaagtgaagggcttgggggagaggagcagtgctgagctgtggcgtccgaggcctgagggcaggtatctgtggtgtgtgacctgggcatgtgccctcacctccttgggcctcagacccacgcttgtgaagtagctccataagagcatctgcctcgctgggcgaaggtgcagaggaaagggtatgctgggagtattttgcaatggttgatttcagcatcattcacaatcagaaccaccgggaatgtccatgagtcttcagggactgtgtgctaaaaccttctccccatttggagccatgaagaccatttgagtgcgacttcctaaaaagcagcccacctctgctcaggtcgcctctcttctgttgtgtgagagtgtgagtcacattcttttgctgctggagagtttctttcccctggaaccctcttgcccccaccccgctgctccccgcactactactccgaggctgtcatgtgagtgttttccacgtaaaaaaacacagaaagttcattcaagccaaatactaagacaatgttaccaagtctcaagtgtatggagttcattgcactgacgtgatgcagggcttcggcaggctcaaaaacttcccaagtgtcaaagagttttggtttgtagatttgagaggtgtgagactgggggcggtttcttctacggacattcacccacacatcccacacaccagcactgtctaaacggcagtgatcaaatcttctatcatttcatctgtgcttcctgtggggcggtgtcaggtgctttacatagattaaatcttcattttgtcctcttaacaaatgtcaacacaggcttgtctgactttaaagtccaggctgtaagcagttaggtgtactgtctcccagttggaagaaactccaacccagcccccttcattttacaggagaggaaactgaggctcaggaaaggggaccatgacttgcctagaaagtggggcaggaacccaggaaccctgacttccaaggcttttcccccctaacccatcctccccttcagaaagcactgatccccttccttctgtaccagagggaactccaatttagtgattctctagcaagcaataacattccaggtcctggagtaacctgagaaatgtggtattggttaattcaaagccattgtcaacttcacaaggtgttggcctaattgatgccaagtatggctactttgagtttcccaagtgttgagactcataagtttggcactggagggaattatttactcacttattgtgcatttcagcttagcagaaattcataattagtagttaatagtgtgggaacttctcactgttcctggaacatgcaatgacatgtaactcctctacctttgtacatactgttctcaaagccttgaatagtcttcctcccacgcccaccttttctttgctgcttgaattcctactcacccatcaagagcagttttctcactcatgtcctgctaccccacctccaaccctggacataaacagatataatgtttttacaatctgcctctcccaccagactgtcaactccacaagggcaggggctatgtctcatatataatgattataatcatacttacaaagtgcttctttgcagtcaggttctgtgctaagcacttcctgtgcattattttatttcatgctccccaatattgtaagatagatactattactatcctcatttcctagatgaacagatagatccacagagaggctcagaaacttgcccagggttacacaatagctgaacgagccgggattgaaatcagtgctaccatgtacagttgtgctggccatgcactgcacaagggtccacaagggtggaaggatcagttgagtctgaaatcttgctctcacctgggtgcagagctgtgactgttgggaggaagggacacctttctctaactcctggagaggcaccacagggtctggctccagggttcatgctcctaaccactgtaacatatcagaatataaatatgcatattcatgttgccactctgtgccagtctggctgagtaggggcccaaaaaatgaatgaatgagagattatgaatcaataggtttttcctttttctcccttctctctttcctcatatctgcaggaccagtttgttacttaacagcttacttggtttaagaaacacatcttttagttggcttgcctccaagcacgtacgaaaagatggctgaaaacccagaaagaggtctccatttggaatgtcttttattctaagtaatttcattctgccacctttgggcttttgaaagttgttaagcggatgttaaaaagcgcaggtgaatggaaacaaaggattcattctgaaaccagctgcaggaactgcacatcctgctcatgcgtgatgtgctgggccttggtttcagtgagggagggcacacgtgcactagattctcctgcagggcctcagctccagtcctgagcggggtggggttgcttctgaccaatcaggtgacttctgagcacacttggagcagttgctaacagcagagacgatggttgggctcctgccactggcaaaaatggggctttaggatgaaatgtctgagtttgtccagatccaagcaaaggactggagagggcctggggccaggctgtctttgatgggctattgggctaagtcaagactgcattttagacctcacttctgacttcgttgcactcctgttgacaaagacatgctgccacttgctagttatacccttggatgtgtctcttaacctctccgggtttccttttactgccctgcagaagtggggagagtgtcacctaccgcatagacttgtggtggggaatcaaggagctaatgtctgtgaaaaaagcactttgtgaattggaaatggctgtacaaatgctatagctaccattatttgtcattaggtggatttagttccctggaggtattttctgcttctgcatgcaccatggagtgcgcttggaggcagtcttgagggaggagtagggtgggaagaaaacagcgaggcatgctgaggactgaaagatatctaggctgggctcttgtgtagaagtagagaaaatagcttttgctttcaatctgaagtgggatgagttgatggccttcagcagatgctgcagagtagagtttaggagctggattctcctccttcctgaagttgcaccctggacatctggggatgtttcttaaaaccagcacatcccaaggacagagctggccaaaagctaggggcttgggaaaggaatgcggtcccaacttcctgctccccccctaggcgttgacagcagggaattcagctcccagaatttaggagcaaggtcagtggatgggccatggatgtgggcatgtcagcatgtgtgcaaagtgaggcataggcctggggagggttgctgcaggggaacataggtagagaagaggaagataaatgactcctgggaagcagcaaatgtcaaatgtgtaagtacagaagggaactagcaatggagaatgagagagagagtgaagaggcagtgaggggaaaccagcaggatgagtcagggcctctgtgtcttgatccaaattggaattgtggggagagtgagcagtcaaggcaaggctatagtgagggcaggtaggatggaggctgaaaaagccactgcaggaccaccctcagccctggaggatcaatcctccccctttctcctgcccaggagaattgctgtcacaggtgagcttctgctgatggtgggagagcatcatgtctctcaaggctgctggttcgcagaaggattaagagcccgaggactaggggtctccaggaggctgaagaacagggatagttgagtcaggtagaaacagagggatgagaagttgtagctagaaagagggggtttctagttgaggatttcagaggtagggcagttcctgggagttgacaaggtcagggtggggccatatgagtaagttctaagaagggatggaatggaagacagtttgattagtgaggatgaagaaatgaagtcagggtgataactggtcatcagcatggatatttctgtggccctggatgactgcaagagtggaagtcatgaggaaggctgtgtgctggcagccaagtttacatttgctgtggcttggaggtctgtaaataacgaggtgttagttagaatagagacaccccaaagtactatgcttgaataagatagaagtcaatttctctctggcttaagctgtcttggaggctctgctccatgaggtcattcagggtcctcgttccttctacattgttgctctgccattttctaggatgtttcattcatctgcatgttgaggctgggtcaccgtcacatccactcacattccactggaaaactcttagtcacatgggcatccttagttgcaagggaagctgggaaatttttttcctgggggcagtggtgagcccagctaaaattctatctttgtgaacaaagaggataaccaaatttgtgggaccatctagcagtgtggcccagatagctttaaagatgagaagtcattcattcaataaacattcacagaacacttctatgttaggtactggggttacagaggtgaaggaaatgggcatgatgcctgccttcctggagctcagacctagtggggaaggattaactgaaggatgtggtcttccaaggaggaagaaaggttatagactagacacatgagagcaggcagatggagattcttcacaggcaaaggctgtgatgggaatggtggtgtcagggaaggcttgggtttggggagtagggtagaagattcattcattcactactcactcattattgtgtattcaacaagtattgattgatggcgatacagtgataagtgaaaacagatacagtgccccctcacatggggttttcttcctcattaatcagataatcacatatataagatgtatgattacaacctgagataaggctctgaaggagcagaattcagatctgtgaaagcatttcacaaggcatctgacctagctgagggttcaaggaaggacaaatggtgatagggagctgaatgggtgttagccaggttaaaggagcgctgcagaccaaggcaaccgtgcatgcaaaggctctggggatggaaagactgaagaacacaggtgtggctgagcagggtggaggtggcaaggaggaggaggattgagaggtaatcgggacaagcatgcaggccttgtgggttctgctgaggattttggcatttatcctaagaactaagagaattcacagatgggttttaagcaggaggggtgacgtgatcagaaccctggaaagagctaagcctgtgaggcagtatctttgcagtagagcagaagaaacagaaagatcagaaaggaatcggaaagtctgagagaaccaggaggaaggaatgatgccttggtggggtttgtggctcacagggatgatgaaggagggggttaggagcagagaagagggacagggaagggactcatgcacttcaggtttctctccagagcaggacatgaggcttgtgctggggccttccctgggaagggccccatggctgcctgacttgctggccaacatggtgggcatctcgctccagcatggctctttcccagacccaggtagcatgaccctcccttcctggtaggagaagatggcaggaagataggcctccactggggggcccccttttttcctctgaatgtggcactggagactgccagcagacccaggccctggggcatcctcctggctcaaaggcctgaccttcgaccctagctaagcccagcctgcctctgcatcccccaaggggaaccacagggcaggtgctggctccaaaatgtatgggatcatgggactccactcacctggagacccagagacggagcagggaaacagactgggctggcactgggttggtagccacaggaaccttcctactggcttatttaccaagcatgactttacctgttttcttatctgtaaaaggaggatttctctgtggatcaaagggaagatcacctaacctcaaggtgtggtatgaacactgtagacgccgacagtagtagaggctatctgaagtactgagtggccatgatatttacctgaaatacctatattgtttggcaaggaagatgatatgtgttcaaccagcaaggagatgcttagcatgtgatatcagatgcctctgagctgtttttcagaaaaactgtgtgcatctgtgagtgtgtgtaaattttgtaaaatagtctgggtggggctgggtgcggtggctcacacctataatcccagcactttgggaggctgaggtgagtagatcacttgaggtcaggagttcgagaccagcctggcaaacatggtgaaaccctgtctctcccaaaagtacaaaaattagcgggacatggttgtacatgcctgtagtcccagctactctggaggctgaggcacaagaatcgcttgaacccaggaggtggagttgcagtgagctgagatcacaccattgcactcctgcctggggaatggagtgagactccatctcaaaataaataaataaataaataaataaataaaatagtctgggtgtcaggagatttggggtccaagctcagcatcagcagtagttgctgagtgacattgagcctgaccaacatggagaaaccccgtctatactgaaaatacagaattagccaggcgtggttgcacatgcctgtaatcccagctacttgggaggctgaggcaggagaattgcttgaacctgggaggcggaggttgcagtgagccgaaattgcgccattgcactccagcctgggcaacaagagtgaaactctgtctcaaaaaaaaaaaaaaaaaaaaaaaaaaaagaatagtagttgctgggagcattaaaggagatgctacatctgaggagcttcatacggtgcctggaatagtgggtgcgcattcaatggaaacaatgggtactaagtcccaacttcctcatctgcaaggagttgagctgagtctaccccagtggtgacaatgacaagggtttccactgggagtgtcagtgtttcctatagggatgtttcccaccggtgggatcccagggtctctgactcaccccagccctgactgtgcagaggccttatttctacaacctgttgcagctaggagtatggagcagagatccttgcagtggttcaggccaggccgatcccaacatctggaagccctttggggtctgccacctttttcctgtgtaccccacctcccctgccccctctgctttgacagcggcagccttctagctgggcctgagtggccgcatggcttaaatttagccccacttcagtgatgagccacaggccaagacctaggggaaggccaaggggcagccacattcaaaacgccttcggtcaataccaaaagccgagcaaatgtcaggccggtgaagggagccgcaccgtctgcttgtttttgagggaagactggaaaacagtcttatttccttcttttctgcttccttcgctggttgaaccgccctggaggaggccccaggccctgccgccttagcttggagccgcaggttggaagtgatctctcccacgagagtgggcgctgatgcctgtgttgggtttggcccggacagactggctcctctcatgtggctccatccctcttgatctcagccagggcagcctggacagactgaggcctgggccagatgatgttaacagcgattgttcatgtttattgaacactgactgtgtcccaggaattgttctacctgtatcagcccacatagtcttcataatcacctaagaagcaggtacggtgacctccctctttttatggatgcagaaagtgaagcacagacagggtaaataactttctcaaaatcacagagctgataagtggcagagctgagactgaaattcagcctgcctccaaatcccgaccttcatccactgccagacactgcctctgctgtactggcttgccccttttggagtcatttacactatttcaactaaacctcaaaacaccctacaaggtaagtactcccattgttgtttccatttcacagatgtggaagctgagactcagtgaggttaatcacttgcccagggtccagccatgctgctgggctctaagagctcatgctccttagccttgcccacccttggtgcttcacccatggccagctccccacgctgtgtgtgcccccacctgccaggtcatccttttccctgtgttggaggtgttgccctcactgtggtttatctggcggggcttaatcccaggggcctgcaagtggaccagaaggagcagggatcactcaggattcaaaattgttggcagcaagttccacaggcagatgttgctcccagagccccaaatattaggattgaaatcgcccatgtactcctcagggaggaggattctttgcagttatcttggggggaggtgtgtaaagggggcatcttaatatcccattccctatttttgcttcatctttgcatatactgaggttatttttatttgctgaattgtggcaaaatagacataacataaaatttggcattttaaccatttttaagtgtgtagttcagtggcattaagtacattcaaattcttgtgcaactgtcacctacatccatctccagaacttttttttcttccgcaactgaaacccactccccatttctctcagtccctggcacccagcactcctctctctgtctctatgaacttgacaactctaggtctctcatgtaagtagagtcatacagtatttgtcttttgtgactggcttatttcacttagcatgtcttcaagttcattcatgttgtggcatatgacaggatttcctgtctctgaaggatgaagactattccactatgtggatatagcacaccttgttcatccagtccatctacccatggacacttggattgcttctaccttttggctgttgtgaatgatgctacattgaggttttgacaaaggtttgcttgaaaaaaaatttggctgcttaaaagaagtttgaaagctactggcctggtctaaagttggggcagatggagacccagccagcatgagtgagatccctgtgcatgaggagcaaagctgaaactgcaacctttggattcgacatctagcacttttctccctcctattgttggtactgatatttatcaaaggaaaggagaatgcaactctgtcctgggcaactaccctggtttccgagaaacctcctggagctgcagaaaggactcaattcagcatttattgagtgcccaagggagccagtccaatgtggagatagagcagggtttatatcctatctctgcctcttccagcccacgtgaccttgggcaagttgtttcacttctcagagcttagaggcaatgtgaagatccaatgagatgacacgtgtcttgtgctttttggtgcagtgtctggcacacagcacccaggaaccaggagctgcccctgcatatgaaccactgttggggataaagcgatgagcaagagaggcactggcccatgggagttcttttcagtggagcatatcagcagtcatgtgatgttgatttgtcccattactggtgatactgacatttatcagttgattaaggtggtatctgccaggtttctccgttgcaaagttaattaacaagtattttgttctcattaattaattagtatttaataagcattttgtaggcactcctttgagactgcataaatattcaattcctcgtcaaacattcaccctctagttttagcatgttttgtcaaatggtgatttttataattccatcattccttctaccattatatttggaattctgctgcaagatagagcttttacctctcctttatgtgtttgtttattctttcatttattcatttatatcagcatggactcattattttctattttattcaatggtttatatccattacaatcattatttattttggtgctcaagttgtatttttctaaattttaaaatgtgtgataaacttggggaatagtacatagcctagtattattattataaaataatattaagcactttgtgtaagccagaaactgttccaagtctctattaaccctttacgtatatcaattcttcacatatgtaatatttattgctgtgaaataaattattccaaaatgtaccagtttaaaacaaacacttctcatatgacacagtttccatgggtcaagaatcaggaatggcttagttggatggttctggctcagggtttcccatgagcttacagtcaagatcttgctagtgctgcagtcagctaaaggcttaactgggactggaggatcagcttccacagtggccgactacatggctgttggctggaggcctgagttcctcgccacgtggacctctctatagggctgcttgagcatcctcagcatggcagctggcttccaggttgaatgctccctcagagaaaaaataaggaggagtccacaatgccttgtatgacctaggcttggaagtcatacaccatcaactctgccatattctattcatttggaagcaagtcactaaatatgtcccacacttagggggaggtgaaggatgctcttaggtctcttttaaagagagaaggtcaaagaatttatggtagtattataaaaccaccacaacatatattaactcttattcactctttaatctgcaccataaccctgtgaggtaggtattactctgagcaattaaatgacttgcccaaggccacaggtagccagtggtaacactgggatttgaacccaggcagcctggctccagagcttacattctcaaccactacctgatctgacagggccttgaatagttttttggaaagcatcctgaggcaggctggatgatgatgggagagatgagtgtccattccttctcaggtgggccttacaggcagactccctcttccttcttccatcttctgctttccatattctcattttgcagtgtatatcatcatttaaaaaaataacgggcagggtgacagtattggcctcttctggcaagcactggggaaaggctccatgtggcgcacttatagttgggggaggcaaagtgggacaagtgtgagatgtggttcttactctcaggggcatattgtctacttggaaggcaagaatataaacacaacattattatgattttaacttttattttaggatcaggggtatacgtgcaggtttgttatatgggtaaactgtgtgtcatgggataaacacaaaattgtttaaaacccaggttatgtgtctttaactgttgagtggttatgtagcccaggatcgtgtctttgttgcccttatctctctcactgatgtggcggcagggggccctgtcacgcttgctgattatttgttaagtgaaagacaaatagatccaatgatggtgtcctacagtggcccaggtggcagagataagaaggaggtgggtggtgaggccaggcgagctggccgggggaggtaagtgatttgaagcattggccccagaaggcaggtcccgtcaggacagtcagcagatgtgaaaagcgagaggacatatcatcagggatctacacagactgacaagcaccaagaaatgggccgaggctgggaatataccaacaggagtctggtgggatggtgggtggtggggagggttcttgggataggcaggtgttagcaccttggttctaggtgggcaggcaaagagagtgatggcccgaggaccccagtacagaacacgagttggaacctggaacagaggccctttgacctttggtgccctttgaccttgtttgggccagaactggtatcagaggagctccatctcaggcatgtgagcagcgcagagactagggtgagtaggggagactcttcctcctctggctgccgatgggctctgtcagagaggcttggagagtgggagggcatttcatttgggtcagcccacggctatgtttcctgcaggcagctgaggccttcccatgcctgagttgtgggtcatggtgcaggttagagtgagagcttacctgttgtcaagggatttgtagtgttgagtcccacaggagagactcagacctgcactgcaaatgggatctgaggaacggaacaactgcgttagtctgtctgagattctgtgctttccctactgtgcaaagagagagaatagcttcttaaatttctctgcagaggtggtttaagtgagtgatttgagccccagctttgccactttctgcctgtgggacctgcaggtgatatgggataatttcccacctggaacatggggataatgaatgaataccgggggtatttttgagaatcagttcaatcacacaatcgaacatgattgttcaaacagcaaagtgctatgtgaacctcagggaatatgactgtgaaataaactccactggtgacagctgaaaggccttaatattgacagtggacctatatgtctagtcacattaacagggggctgcatgtgaatgagcaactgcccttctctggcgtttgagcaaaacctcaaggagaacctggctaataagacctccaatctgactagaatccctccccaccccacctccttgtaaagaaccagcttctgtaatagtatcctacagaaccctcccaggtttgagcggacaggagagccggagagaagccctgatttggtcacatggtcctacctcagtaggaagcagctttgctcttttacaatttgttacaggcccgagcaggctcctggagcacagccttggggttgtcctgacagtcctggtgggctcagccaggggcagtacttcttgataatacctggaagggttattttaggtggactttcagagactacaaaaaggattaggtgaaaataacaacagctgttattcactgagtagtaaaagagaaacttgtgggtctgagtctccccttgaagaatcttccctcgagctgaaaacttttcctgtaggattacttcctgtgtcacatcattagttgtccccctgactgtagcagtttgtattttaacagtgtgacatatacatatgtgtgggttatagatgtataagttgtcctcaactgtttagcctgggtttcattttcctcttaggattctctttaattcctggtatcccccagcataatttagagaaggtcagtggtatagtggccaagagtagggactctggggacagactctatcattactctgccgttaccaactgtgggccttgggcaagctaccatttcctttccataaaataaggacaacagcatcctgttttaaggctaaaacttgctaatgtgtgtaaagtgcttagacagtacctagtgtatagtgaacactcaacaaatacatgttattgttattatctttaagttgctcttatggtatttgatatggtttggctctgtgtccccaccctaatctcacgtggaattgtaattcccagtgttggagggggacctggtgggaggtgattggatcatgggggtggatttcccccttgctgttcttgtgatagtgagttctcatgagatctgggatgtttggaagagtgtagcacatccccctttactctttctctgctgccaccatgtgaagacgtgcttgcttccccttcgcccttctgccgtgattataagtttctggaggcctcccagtcacgcctcctgtatagcctgtgcaactgcgagtcaattataaattttctttataaattacccagtctcaggttgttctttttagcggtgtgagaacagactaatacagtattcattatgctcaagaaacataccccactacaaatagaaacatcttgaaaggttcagatcaacccatggatctatacttggaatattaaagaaaactagggtgcttaggggcacagagtagggtcttaataaatatttttacttatttgggaatgaagggtacaggggatgcccctttgaggtctaggccctgctctgcttggctgcctcctgtctgttgaaatacacactcaggcttttcctcactgctgtcaccctcccagaactagtccaagtcccttgggaaatacgttactagatcttgcttccctgccagtgcagttcttccctactcctgggccaaagcctcaatgctttagtgacaagaccaaatgatagcttccctggaatacattaagggaaagcaaatgggtcttaaagtgccccttgacaggcagagtcccaaaccaggcttattacttgaaatttggggtgagacttgggctccctgacctgggaaaggaggttagaaagaaagcttctctggattgatgtctaaggctatggcagagtaatataccaacacatccttgtagacagtacctggctaagccacccagcagctcattgtcaagacctgcaatgtccccaatatcaccatgggatttaagcccggagctgccacagggtctggttctgcactgggaactctgctgggccaagacaagccaattgcaaaatggcagagggcaagagagcagagagtgagattgagagagaatgcaacaaacacaaaacaaacctcccattcaacagagcaagaccctgtctcaaaacaaacaaaacacacacaaaaaccctcctgacaccctcccaaactcacttctgatgataagaaataagcaaaagctaataatgacttcaaagcctgtatactgaggatcctgcaggggctgaagaaaggaatagcattggccaggcgtggtggctcacgcctgtaatcccagcactttgggaggccgaggcgggtggatcacgaggtcaggagatggagaccatcctggctaacatggtgaaaccccatctctactaaaaatacaaaaaattagcggggcgtggtggcgggtgcctgtagtcccagctactcgggaggctgaggcaggagaatggcgtgaacccgggaggtggagcttgcagtgagccaagatcgcaccactgcactccagcctgggcgacagagcgagactccgtctcaagaaaaagaaagcaatagcatctataaaaaagaataagtaataataaaataaaaagcaggcagaaaccaaacaagaacaccggatataaaaagaatcaactagaaatcaggaaatacagaatatagttttagatttattactaaaacctcaatagatgacattgacttgatactggacataattgaagaattagtgaattaaaagccagtgctgaggaattcatgagagacccaacccggggcaatgaataaaaattatgaaagattagttaagagacacaggaagtagatggaaagattccagtatatgccaagcagagttccagaagaagagaatggagggaatgaaggagaagcaatatttgctaagatattgaatgcagattttcccataattgaagaaagacatgagttctgggattgaaaaatcaccatgagtgacaaaaataaatccacacccagacagattgtagtgcaacttcaaaatgcaaacctccaaagagagactctcaaagcctccagagagaaaagacaaattacctacaaagggacaacggctagcctgacattcccatcagcaacagccagctgccaaaaggccattaggaagaatcctgaaaatgctgagggagtctaactgtcagccagaactccacgctcagctaaactagcactcgggagtgaggatgctataaaggcactttcaaatatacaaaaagaagacactttaatacacaccgaggcctgctgaaagaaatactaaaggatcaacttcatctagaagaaaagtgaatattgagattaaaaaacaggatgcaaaaaaaaaacaaaaaacaaaaaacataaaacaaaccacctctgagcctggagattgatgaaatatgttggttgcaaatttatataaccattgattataaagagaacaaagcaaaaaagcaaagctaaacctttgtgcaaaaaaaaaaaaaagttctagagagggcagtttctactccctttcattgttgcattgtgggaaggaagtttggtgtttctagatcactggttttttcaagataatccagaaagccagttttatgtggaatgtcctgacttttgagagcttgcaacaaaaaattttagcaccctgagctctgcaacacttgatatgttaaataaaacttcagttggccgctcagcccgcagttggtgatacttcatgttccttgggctctctggtttctatcacgtgaacaggaaagtcttcacggaggagttggtgcttatactgggaattgaaggaaggatggaatttaagtaactggagaggagtggggtggggccttgagacgtagaggtaggaatgaagctgcaatgtcttgggaaatggtgaacttgatggggggtggggctgagcagggggaggcgaggtggactggggctgagatatttgagtctcatcctgtatcctcaggccctctctcctgtaagagctggaagccagtctattttgagttacgttgtttagcgtcttacctcattccccaggggcggcggtggtgaagaaatgaacactgtttggtgatgagggtgagaatgccaatgaaaaaggcaaggaggagaaacccagggacatctgggagagtgtgtggtgtgatgggatgcttcccaaggagctacgtcatgtgtcagccagggctttaattagaaacagtgatctggaaagcggggctgcagtggggtaattcacgtggatttctcaagagcttgggtctcagctcttgaattttcctaaatggcagtgcttcagtgctcagagctggcttggttttgttgaactcaaaccagataaacaagtggaggggacgtgggtgggagtggtggggggaagctggatcgtgagtcaggagccccggactgctgccctgttcttgctgtcagcttcttcagaggcagatcccatcttacaggggtttcaattccaaagtcagcctgtcgggccacagtccctaaaattgcccttagaatataatgcacatgatttagtgcatacaacactatacgataacatatgtatatgtataatgtatacaataatatgtcataattagagtacatatagcaagatgtattatttaaaagatctttttgtcactctctttccctccatgtgtatattttgattatgtctgtgttaaatgttcctatgttaccactgcattgcatgactttgaacattaaattaaaaagtcatccctttgggtcttaacaaaataaaatgactaacctagatgaatacaggcccccatccagctcaaaatcattgactctttctttggcattgtagttgagtgtccttgttggaggagatggggtagaatgtgggtaaggatatgttgagtggattgggttttcataactgtgtgactctgagacggtatgcctcaggtttttttctctataaatctgtaaaatggagataatagtatttgcctctcaaggatgctgtgaggattaaatgatccttgtaaaatgctaggcaaatgcctagcacatagtatttgctcagtaaatgttacctattattattattgttattatttgcaaagcactgtagtaagtgctcttgggaaatgcaaaagaaggagtcattgcaattaaaatggattttgcaaaaactgtaccatcagtccaatcaagactcactcatactgggtgaggtaacaagagtttattgtaaggatataaaacgcaacgttacagctgtcacaggtggggttccatgctccctggaaggtgctaagatagaaatgagcatgtggggcatttactggagagtttgattgggatcaacgactgtggaagccaggcaaaggcagcaggactgggcagagcgagaagctgagctctgatatagtcctaatgaaggcctcagctgactccacggggcactgtgggacttggagaggcccttcagagttgtcccaagttataccctcatgttgatcagtcgtggatgtgggctgcctctggaaggcaatctttatagaaggctgacagccaaggacagtcttctagtacctgtcccagcaactgaggaataaggccttccttcctgaaggggaatctggtggcccatcacagagaccaccacaatgtccagggactgagaacaaagttcggcctctcctcctggtgatggaactggaagcttgggaatggaggccacactgctcgtctctcaggggctatgccaggtttgtctctgcttctgtctgctccactctccagcctctgtctctgcagactggcttcctccccctgctcactttgcacttggcccaaggtggccgtcagctgggcctgcgtggctttagggcttgtacctatcataactgccctcaactcttgtgtcttggttcaaatgttagagagacagagagagagagacacagagagagagagaaatattggctggctgaggccagcctatgagtggacaccctctcccatctccaccttggatcactatccattcctggtccagtcgctggagggagagggctggatcatgttatgccaacatggctggctacccatacttcccctttctagaggttgtggccaagtcaggcacatgtggatgggacatttaataaggatttaacaaggacatttaacaaggattgagcacctatgatgagccaggcaatgttctaggtacaggggatacagcagtgaatcaaacagacaatgatccctgccctcatggagagtacattctactcagggaggcccagctgtgcagaaataaataagacaccattaaggcagaggttggggatctagaacagcatttccataggacacatggatgatgtggggaggagcaggaggggctctgcccaggaacccggttctatccttgtcttctctctcccttgcagcttcgacagttcctttccaactggattcccgttgcctgcttctgcttatctctgaccctgtcctgggctctctgggctttcaaaggcagcaatacctttccttacttcggctctcccttgagctccttgctggccacccctagacaattcaaccctaccatgtctgacagccacttccctccaacctgctgaccctgttgctgggaacttcacagtcatccttgcagacttgaaatgttgggatgccccttggctctgctgtttccatccagccagttatccagttgtttagagtgtgttcctcacatctgtctcttcttctctgaccagttctggcaggtcttcttaattgctcctcttggcttcattctctcctttccaacccatctcgttagtcggccagattaatattcctaaaatgcatccctgatgtcacatcctctgactcatcattgtcttcaggacaaagttcaacctcttctctgggcatctcgggaccttcttggtctggctccaggctgcctctccagctgcccttccacgttctccacattgttgatggctgcatgccaaacatcccgaacgagcctccagtaagttctgggctccccacctccgtgcccttgggctgcttccttcccccgtatgctcttcccccattctcctcagtccttgactcatctttctagaagccttgcctgatgtgctcagccagatatggcccatcttgccttcttctggaccccctggactccatttgaatctctttgccaccccaccactagctgactgtactgcatggcattctgtaccctcacctcctcaagccatcccaggtaaagacataatctaagtggaaatagagtctcattcttctcaaccagcctcaagacaatttccctagtgtctgcttccaaaagattgccacctctaagctctgcttatgtagaaagtctggagttgacccagtttcttctagactggaaggtctttgaggaaaggactgaggttcagccatcattcagtcctccatagcatgtgatctggggcttgcaagatgtggtccattagggagttcttggctgaatgaatgaatggataaatgaatgaatgccacaacacacagcctccgttgagatgttctttttccctttttttttccttcatagaggcggagcatacttttgtttgcctctgatgggctgctgtagcccagggctgtagattttagtagtaaaccttcaattcctgtctcagtccctgtatgagaaacagcagagaacctgcagctttaggtgggtggcagatgttccttacagtggggcccactgtctagggcttctcttgctgccctcagaggctgtcctgggccctgcccttctgagtgtacactgaaagtgttctgtggcctttgccttcctttctccatctgtgcatggaagaagtttctatgatctcttccgggtttaacttggccttgaaaataaacatggaaaaagtgcctgggatgaagattgggtcttctcggtgctggcctctccaggctcccttttcctctcccaccttcttacttctgggctccagccagatggtcacttgcctcctccagcctttgcccagggtgtcttctgctggggacattctccctgaccctcctctcctcaccccatagctctttccctggcccactcctcttcagcctttagatttcagctgagatgccattactttcgggaccccctcttgatctccctggcaccccctcatctcattaggctcacctccctgtatccaccctgtgccctgcacttgccctatcccagtgttcatctcactggattacagttgcttgtcagtcctccttcgtggtctgtttactccatgaagaaaggggcaggtgtgttctttgcccaccactgtttccccagcacctgcacggtattggacacgtcgggggcactcaacaaacccatggtgaatgaatggatggagccatggctggctggatggggtgcatgaatagatgggggaaacaggtgctaggtggtttgagcctgttagctactgccgtagaattgtgcgtgacaaccatatcaccttggtgacatcagtaacaggtatttattgctcacatgtctggagttatctggaggtcagctaggcagttctgttgaacttggctgggattacttgcatgtctgaggttggctgtttggctaaggtgactagggcagtgcagcgccactgctttttccctcaccctcctgcaggccagcccagacatgtgctgctggtgatggcaggggtgcaagagcaaacagagacactcaaggcatcttggagcccgactgtagctggagtagcacattctactgggcaaagcaagtcacagggcagctctgtttcaaggagtggggaactagattttgcccctttagtgagaaaggaattgtagacacatggcaacgattatggatacaaggagagactgaagaagtggggctattaatgcaattaacctgcctcatgggacatcaaaagtcctgggtcatagcttaggattaggaaactgaggtgcagttaatgaacttggccagctctcaactaactgggacctaggggaagacacatgtgccagatgggctctctagcttcaggtttctttttttcttttcttttttttttttttttttgagacggagtcttgcactgtcacctgggctggagtgcagtggcgcgatctcggctcactgcaacctccgcctcccggcttcaagcgattctcctgcatcagcctcctgagtagctgggattacaggcgcctgccaccacgctcggctaattttttgtattttagtagagatggggttttactatgttggccaggctcgtctcgaactcccgaccttgtgatctgcctgcctcagcctcccaaagtgctggtattacaggagtgagcccccatacccagtctccagtttcattccctagaaataagggaatgatgttgatgctgctcaactcacataattccaaggaatccattctttcttcagcccactctcaggtttggggaaggattacaaactgtaaagtgctgtgtcatgggaagcagaattgctcttccagaagcacttggcccccagaactggggaggagcatggggtagtggagaaaggatggactatgagatgaggaacctgtctgtaggccccatgtcccaggccccacgtcccaggcttctgatatctcaggttctccattgtaaattggaggccccgtggggtcaaataaataatggatgcaaatggatttcaaaaaaatatcaaacactctgtggttgtaaggtattattggaaatgggggtaccctgtttcaaataattgccaaagtagctatttgacaagtctggcttcaccccatggcacttcctctgtctccccagatgagatggttgggagtaaactgttctgaaaagatgcttccagagtccaagaaaatgacaaacaagacttcctagatgttcttttcctgcatgacaccatgaggcactgcccccaaaattgctggtgcttgtagcacacattcctctgcttgttttctgcctagcacagagaaatgctggggttgatggtttttctagggcgttttcttcttccagtccctgaaataaaagccggcgtttctggaggagaggcaggcatctccgccctcatccctttatcctcctcctcctcctgctcctccttctccctccctgaagttgatgcccttggtgattagcgttgtcctccctgagatgctaatggaggttctcttggacacttaagctaaactggatccgtgggtatttctctcactggctttggaggaagaaaaccaacaaaacagcccctccctggctctggagacaatctcaggcgtgggaggtgaggcttaatgccttttattcccaaactttgcagaggggcttctgaaagatgggagggagaggccagagtgtggtgacaccatctgagggtctgggccccatcacagccctggtggaccctggcctgcccatgtcatctgctttagtggctctggcacaggctgcattcctttctcctggaggcttcacctctctccagaggccaccactctggacggctgtgtggaaacacctgggccagaatgcatccaattcccgcagagcaaaaggaagcgcttggatgcttcttgctgcgagcacattgttatttttctttcctctctcatgaatcattctgcctggaatcttccctggaagggctcatctggctaatgattctgtgcccagaatcagggattttgatgcactgatgagtgacaagctgaggtggctgagatttaggggcagggagccttcagtctgggctcacctagtccggggctcaggttgtggctacagcacctgacagccgagttcattaactcaaccaccgtttcccagtcctaggctgctgtaggtttgtggtcagtgttaaatgagatcaggtgtgtgaaactgcctcgcacagatgggttttgaatctgactggagtatgatcaacccttgagcctactgaccccttaccccacttctctggtggctgccacaaccccatattcttgtcctctacagtagaagaaatcaaggtgggggcctggcaggctctgacttccagaaagcattcctcttgttttgtgtttacttctgcaaaagtaagaagtaaaaatgggggtgtgtccttgggcaagttatttaatctccctgaacttcagcctcctcatcttgacaatgggaatggtattgtctgtgttgtagggaaagttttagaagtaacagatgtagagttgggtatagattcagtacttggtaagtgctagctggattaatttcacatcccacacgtctctggtcttaccaaactgcaggtgtgcgtggagggggtccatttctgccactcatagcctacattgcatcacagcaggctgccaccgctgggcgtcaggtctccagaggcatctcacgtgtacatgaacaattctgctcatgctgtggttgacctctgcttcctgccaagcacccaagagggacgcatcgtcctcgcgccctgcagggtgtaccttgtggggttcccgctcctcttctagcacctggtcctggtgctctctgtctgcataccttcagatgcccctgtgttcccatcagtctgtgttgctctagaaccatccctgtgctaagccaaggtgtggaagaagcccttcccttaactctgccaagctttctcatgaaatctcatcatctcccatgagacatctgaattgggccttgaagtatgagtaggagttcaccaggtgaggggtaaatgtaaacttatatttcacttagaggccacttcttctcccagactggcttccttttcattaatttttgaaatcagttatagaaattgatgctggggttacctgtctgcacctctggtttcgcttggggctataaagtccctgctattatagcagcagcttcacatcactgccactcttatcaccaactacaggtggagcgggactctaaactgggcagtctaagggaaatgctgtgtgtgaactctactacaagaacctttgcatttgagatgggccctgtggcactccacgcatggggttcttgtacaagttagcaaaccaggatttgtcagtcaacacgtggaatacctgcttgatggaaggagctcgattgataagtcttagttgagtctccctgtccctaattgtagtatggcagtagccttctaactagtctcttctaccgattcacttgcctctatgctgccaccaggttttctgtaacattgactgtggggtaaggcctaagcccctgaacatggccttcaaggctattcaccatatggctacaaggagccctttctgcctgagcttcttccatgccctgctaaacttcttaacttttagccttgttgaacccctcgccagtccctgaacaggtcacatacttccagacctcagggcctttgcccactcaccatatccctcatgccttctctctcctcacctggtgaactcctatccaacctttgaggccaggcatgcatgcccagtgaaacctccctggcccttttagttcctaccatctcccctacttcctgagttcctttccttcttgatgttcttcttttgtgtgtacccctgttttagctcattgtaatgttgtgattttttgtatttgttagtgtctgccgaattcctcaagggaagctcctgagtctctcccagggttgtacattcttttcctagcacagagcctggcagatgctaataaatgttgtatgaatctgtaaatgaatgattgaatatggaaatagggagttcaatatgaactaggttagccatgtcttaggaggaaaggggattttgagtatttgagtcaaacataaaaacttatattaaaaacttacataaaacagagagaaaggaaagagaaagagaaagccaggcgcagtggctcgtgcctataatcccagcactttgggaggccaaggtaagtggaccacctgaggtcaggagttcgagaacagcctggccaacatggcgaaaccccgtctctaccacaactacaaaaattagctgggcatggtggcatgcgcctgtaatcccagctacttgggaggctgaggtaggagaatcgcttgaacctgggaggtggaggttgcagtgagccaagatcacgccactgcactccatcctggatgacggagtgagaccttgtctgaaaataaataaataaataaataaacaacagagagaaaggaaagtatccctgagattttacttgctagagtagaagataaagttactaacttagagaaaagagagagaaagattatatgggcatgaataacaatgaattttcagatttaaacatttataatgcacatgtaaccttcattgaatactcaggcactgtgccaagcactttacatgcattatctcatttaatgctcttagcaaaaccatagggtagttactcaatttccccaaacgtgagtataccacagttgagataaataggagttagacaggtgtattagtctgttttcacgctgctgaaaagacatacctgagactgggaagaaaaagatgtttgattgaacttacagttccacatggctggggaggcctcagaatcatggtgggaggtgaaaggcacttcttacatggtggcggcaagagaaaatgaggaagaagcaaaaagcagaaaaccctgataaacccatcagacctcatgggactcacgtaccattacgagaacagcatgggaaagataggcccccatgattcaactacctcctcctgggtccctcccacaacatgtgggaattctgggagatacaatctaagttgagatttgggtggagacacagccaaaccatatcaataggagaggggctgaggtggagaggagaagggcattccaggcagaggaatctgcatcagtacaaaggccctgaggcagaaaagaacttggtatgttgaaggggaagagagaaggctaggggactgaaagatagggcacaaagagcaaatgggacaagatggagctatggagagaggtggagaccacaccacgtaggtcttacaggccacataaaggacttgatctgttatcctaaaagcacattaaggttttggtctttatcctaaaagcaaccatgatccattgaagaggtttaggctagaggtagagagggaggagaataggaacttgctagtggtagcatgaatttgatttttgcgttctaaagaagaattgatctgaaaatattggaaggggggaaaagtgatgtgggggctagtttaggaggaggctgttgtggttgttcaagtcagagacaatgaggatttttaactaggatgatggcagtggagatggagaggaatttgtgaatttagaagaagtgttgggctggtagaacggataggacacagtgatggggagggatggagcatgggggaaggcaaggtcagggtgatggccagtttctagcttgaatagcaggaaaatcaaggtgttgtctcctcagggaaaactggggcagtggtggagtttcaccgtgggaatgggggtaactcatggggacagggctctgtagaagcctgccatcatgtacacttcctatgggggagggtgctgtgggctcacaccttgtcatgatcatggttttgacagtgcaccccaacctttcaaacacagacaatgaaaggaatcagcatcactggcatttgtgcctctcttatattccttgttgatatttttatatattctattatggagtactttcaggatccaaaaggcttggtcctggaaactgcaatgcaaaattcagtggcattttatccatttgtttccctgataagccaatctacatcagcctccttcattcagaagggagaacataagagagtcaaagcgaagggaacaggcagtgcagtggaagttagaatctgttaagttgtgttcttgccagagcagactgcactaggcaacccactttggtgctggggagaaatgtctggaggttgagggaagaggaatgcggaaggcctgaaggctggagttcatctccctgtgatctggataggtagtgggcaccttggcccagaggtgattcctatgggactgttgagcatataacctgatttttggcaaaacagggaacagaggtatgttagattaagctattgaggctaagcatggtggctcatgactgtaatcccagcagtttgggagactgaggcaggaggatcgcttgagccctggagttctcgaccagcctgggccacatagtgagactgcatctctaccaaaaaatgaacaaaattagccgggtgtggtggtgcatgcctatagtcccagctacttgaaaggctgaagtgggaggatcacttgagcctgaaaggtcaaggctgcagtgagccgagatcacgccactatactccaggctgggtgacagagagagaccctgtcttatcaaaaaaaaaaaaaaaaaaaaaaaggaaattgcccaccaacttggttgacacgcagtaggctcttagtcctggaatggacctcgatccaactaccttgctttctgcagaatttaagtcccagggcttggcccatagtgggaccacaaaggcaatccactgaccgactgacctagagtagtgaagagacttgccccacgtctcacaaagaattattgccagagcagggaacagaaagaacccactacattatgctgccaagtgacaagctaataaacatgaggtgtttttcctctttggtaacaggacccaagacatgaaatatgagcttggcagagagtttcacattgcattaaaaggacaaatagatttatataggggtagtaagtgctcactctgagccgaagtgtgaatgattggattccagcctgactattgaaatttgctacgacattgggagatgtgtctacaaagggagatataagctttttcatgtttggttgatcttgtgtgaatattacagttagtgaatgtgtgagcaagattttttgctaattctcaggcagcagagtcttatatagtaataataatcataccaaggaaaaaaatcatgcccatttgcgtaactttttactgcttacagagctctttcatatgtatgtattaatattacctaatttgaatttaccacaattcttaggtaggttccattaatcccagtttacgaatgaggaaacagatgaggttaatgccttgaggcagggctggaactaacccagaactcgttttttcaagttggaatttgagtatgaaatagccttactggatcgagggtatgtgcatattccaacattatctgctttcaggcttgcaatccattattaagccattaggcaacgataatgattttgtatttttttctgaggcttttcctaaaagtttgctggactcagcatttgagaaggtacttggctggagcccttttcttatgtcttgccagcctccatctatcctcaaaggcagagagggtctcctgaagagtttatttggaaacttgaccagctgacaacaggaattgatagtgatgaccgaaaggggttgcttgatgtgcaccataaaaatgaagctcattcaaacaaccaggccctgctggctgacctcctggaaaatctaatctcagtccctgttgtggaatggattgaaatttgctttgaaaatctttgcagagtcttacaaggttaaaaagaaaagaacacacacacacacacacacacacacacacacacacacacacacacacacccctgaagtcagatccttcttgtttctttctctcttttccaaaaatcaattggcaagaatttgcaaagttgccaggatgaggtcatgggtaataacttacgtggttttcagaaacataaatcactcagcctgatgtagtggctttccatcccatgcagtagccgcaatgtgcataaaatatttgggcggcatggtggccttagatattcttccatgtggcattctcatcagaaggtcaagggaattcatcctgcaccctattaatgtcaggtgaatgcacacatggccagaggcaccctctcaatgaagattagtggctctgtccctggctggtcatttcagtgtgagttaatggggtcaaagtggagacagctatggcagagtgggggctggcctgctctgggtttgaatccagcagggccagcagtaactaaagtgagattttctgggaaggtttccagagtcataagctggaggcgatatggttattatttagtattaacatgaaaaaatgaatctggatatattttgtcagatcttgtgttcttcatattgttttacactgggtctctaatcacatttttgcaaccttcctatgcctgcctaacccctggggagaaatgggattgccacaactagaggacatctcactgtggtatgatccaataattactttcccagggccaatagatattgagtgtcttaaaaaagtttactgcctctccccttattagaggagtaatgcctattatgtagagtatttggaaaatatagaaaaacacagtgattacttagtagaggagttggcaacctatggcccacaggccaacctagcccattacctgtttttgtaaagttttattggaacagttgtgtgcattcctctgtatatgtattctatgactactcttgttgggtaacgatagggttgagtagttgtaatagagatgatatggcctgcaaatgctaaaatatttactatctggccccttgtggaaaaagtctgctaagccttggcttagcacataggtgttcagtggatatttactgatgaaattaatttatctgtaatcctaccacctcaaaataaccatgattaacattttggtgtatattcttctatcttttctctgtgtgtaggtagctataattatgttttgggaggactaaaccctacatcctatttttgtaacctacttttgtcatttaacaatatattatgggcattttccaaggctatttgtatgcaacgtgaatcttacaccacataggagtttattgcgtgaatgtgccagaattatttaaccaatcctctgctgctccatagttatgccgtatccaagttttcacttctatagacaatgctgtgataagtctccctgcacatacatttgtgtatgtatgtgtgtgtgtgtgtgtgtgtgtgtgtgtatgcctctgagcctagaaggagaattattccatttcatactgctaattattttttcacttaagcatgccgtaccattgcactacattgggatttccttgagggaaagtatgctgttgcatatgtatttttatcactcttgctgccctctaacacagacatagtaggtgatcattaaatgcttgatgtggtggtgtatgatagaatacccctgtccttctctctgctggtctagatcatgcaaatcttgcttcatgaggcctcagctgactcctctacaacacattgtccttccttcttctggtcatcttatattcaataccattccccttttagacgatactctatattcttcagagctttagactgtactctgtaattcttcagagatttcagagtggcgcaatgcacattatactagtttccgatagctgctgtagcaaattgccacatacttgctgacttaaaacaacacgcatttattctctcacagttctggaagcaaggagtctgcaatcagcttcaccaatccaaaatcaaggtgtggccagagccacactccctccagcggctctaggggagaacctgtcccttgtctcttccagtttctggtggctaccagcattccttggcttgtggttgcatcactgcaatctctgcctctatggtcacactgcctcctcctcttctgtgacaaatcttcttttttttcccctctctctcctgtaaggacacttgtaattgcattagggtccacccagatgatccaggataatctcctcaagatccttaattttaatcacatctgcaacgtccttttttgccattgaaggtaacattcccaggttccagggattaggaactggatgtctcttgggggtcattattcagcctaacacatacaacatttcatttattcatttaaaaagatttgtgaggaaccaacttggtggcaggcactggtgctgtgctagctgccttttgtaacaacagggcagaaaggatttgcaaatgaagaactatggacaaaagggttgagcactggccaagcagctgggagacacaggtgctggtacagctttggggtgtgggtctctgttcctcagtttctcctcttgtgaattaagaggttgggccaatcactgtttcttgaagatgaggcatgagcactactgttggtacaggttgagtattccttatctgaaatgcttgggaccagaagtgtttcaaattttggagtttttggattttgtaatatttgcccattcataataagacatcttggagatggggcccaagtctaaacatgaaattcatttgtttcatatacaccttttacacatagcctgaaggtaatttcatgcaatcttttaaataaactgtgcgttgtgtatctaagttttgaccgtgacctgtcctgtgaggtcacgtgtgggattttccacttgtggcatcatgtgagtgctcaaaaagtttggattttggatttcagattttcggatcagggatgttcaatctgtatatatacaggatgattttaggtggtccgcagagacagaactaagtaacataactcatgacaacagatagttattttctttttagtcctccttcaacccttcctgccttcaacctttttgattacctcaatgagaaagttgctcttaggtgctagcatgtcttcaacccttgcttgaatacttacttgctaaactccttttatattaaaaaatcaggtctcagactacagaatctaggtataatttaataacattattttgtgttcattgtgtttatttttatagttacattccattagtggcacattttttgtgtggggggggttccatttatggtggtaccataaagcatcccaggtaaaaagtaagatgatttaaagaaatatattagacaaatatacagcaggtagtttttagaaggggcacattgtaaagatggctgtgaagtttgggaaagatttagatgtttccagcaggcccccagttctctgacttctattttagctctgggaggaaagtatgattaaaaacataaagataaacatcatcagtcagaggacgcagctggaaattcagcattaatgaatcctgatctcttctcatttaaatggatctgattcttcagggaccattgggcagcaaaaccgtgaatattaatctcgtgttgaaattgatcacacccagccagctttaactcagtctctggtaggaggaggcgtggcctcactctggctgttctttgcatttcactgaacatctggaaggtgtggaggcagcttctgtctgacttcttcatgggaaggaatggctattatttggacacagcacagatgctatgggaaaaccctctctccctcccattctgctttctgctgcctgcttcctattcaggggcactggtttagcactctaggtaggggtggtcagggggctgcagagctggatttctgctttcagaccactgtgggaagtgggactcctttctttaatttcttcagccgtgcatgtatatccaatgctaattccctagtgtgttggggaccttatcatttcctcttacatagaagaaaattttcctggttgatagcatcatcattattaaataactcttatttttttcaaagtactagccaatatactgtgcttcctttttggaggagctggtagtggtgagaatcagtgtgggagatgccagtcacttcacccagcactgccttcccagcatatgtgttcccccatcccctagaaagctgcaagcagataaaatttgcttcagggaagccttcggagttgatatgctttgattctctgttctaagcctggcctttactaccctgaataatcgtgaggtggcgaaagacagagcgtaaaaacctggctcacttggtatagtacatatggcaggcactcatctctctggcaacgtggtataagatttggggccaacagatttcttaatatttacatgaaattaggcatgtcatttcacctctctgtggctcagtctcctcctctgcaaaacgggataatagtagtaacttcctcctaaggctgtagcataggttcaaggagacaattcggggaagcacacagctccaaaatgtctgctcttacttcctccatcctgcagatgggaaaaccaaggcccagagaggttgactgacttgctgaaggtcacacagctagccagcgtcaaggtcaggctctgaactcagccaagtctgatcccagatccagcttttggcactgcagaacccaaaaggcctattgatgaggggcagactccgcaggaaccgtggggatcagggatagacccaggaagctcctggcggagtctccggtggactctggcatcaggcaggcccaggttccaatcctgtgattcaggcagcccctttcccttctcttgggcctcaatttcctcatctgtaaaagggcgggacacccactgcctcctctaacgtggtattatttaataattgaggatggccgctgaccggcctggcttgataaaggttaataaagaatggcctgatgtcggtcgttggccgaatacaggaaggggagagggagagactacagggtgccaggagcttgctcgcgtctgcgaagaaggaatccgaagagatggcttaggagcccgctttcagccaccccggctgctgcacgtggcgcgcggggcggggcggggcggtcggggggggggggggtcccagcgacggttgccgtggcaacggcgcgcggcggctgaccccggcccggcatctgctgcctccagccccggcgctgggcgcacggatcctgcggaccctcggggccgtcccggaagccgcctctcggtgtacaggaggctaggagaagggcggcaatggggagcccgtgtccgggcagcgcacgagtcttttgtgcagggcctagagaaggagcgaaacgtgggccaggcctgcgaggagggcgggcggggaaggggaaccagcacagagaggctggaagaaggtggctggtgacacagccctccttgtgggactgtggacgcggggcgcgagatggcgcctgggaaacacttagctcggtgcccagcgtgcctggtgctcacggtccatgactacagcagccgccatggctcatttcttgcgtccctgcagtgccccaggcaccacgcgcataccacccctcacccttttaacaaccccaggggggaaggtattattccctattttacagatgagaaaacagagaccaggctgaagccacttccccaaagtggagaaaaccagatttggagcctaggctgactgtcctcagaacttgtgagcttgtgagtgcatgcccttccgctgcgccatgccacctctgtatagatgctattcgccgagggtccaccaggtgcctggcacatcatgtgcattatttccagtctgatcctggcaacaaccctgcaagataagaatacttacttgccttttacaaatccgaagacagctcagagaagatactgagttgactgcccaaggcttcacagtgcagatccggcagagacaataatcaaccctgtgagagtggctccagagtccaggctctgctgggtctatccactgggccacatcatctccgctagggctggagttggagggcaagggaccccaccaggatgctgggttttgggctgggagcaaggagagtgagtctccatcatcatgttttcttgaggggagggtttggaagactccattacactgctcttgttggagaggtcgtgcgcaaattcggagtaataaaacatagtgccatccctgcctttcaggaccatattttccatttaaggagatgagaaatggccacagaaagaagttataataaatgataatcatagcttaactttataaagcctctgacgcagtgctgtccaatggaagtttctgcaatgatggaaatattctgcactgtccaggatggtttaacacgtgaaatgtggcaagtgcaacagaggaatgagttttttattttaattaaatgcaaatagccacatgtggctagtggcgactgtgttggacaatatggtaccaatatatggaaagcactatgccaggaacttcctttgcattaacacataccattctcacaacaatatgaggtagagattattatcatccccatttgacagaggaaactgagtctcaggttgcccacctgagcatgtggcagggccaggatttgaaccaccgggcaggtgaacccagagcccgctacattgtgctatgaagctgagatttctctcctcagaggagggcctgaggtcagggtcaggatgcactgggatgcatataatgacagccagactggtgctctgtgtggatggcacaaagatgaccactgagagtggagacaggaggtacaacaggacatgatccttgaaagaggaggcagcaggactgccacagaaagttccctgacctgggcattgggtgatgttagttcctgtctgccctttactctcggtttcagccctggctttgccactttcttggtggtcttgggcaagccatttcccctccctgaatctcaattgcttcatccgtagaagaggagtggcaatactaccagcctcataggatgtcatgataatcagatgtgattgtgcgtagatgtgatgagatgttgttggctgtaacataccaggtggttcatctttatcggctcctaaaaatttacactgggaaggtaccagctgcccctgtggagcagagggggcaagtgctcccttgatcttggttttcaggatgtatgcagactgtgagtggtgcctctccatcccaggaggtgccagaacagttactgtgttttcaggacagggtccaaagattggaattgggtggggtctgggaagctacatttaaaattgctctttgctgtcatactctggcccctcttactaacccaggaaagccatctgcaggcaaggggcagaggcctccaagggtgcaggcaaggggcagaggcctccaagggcaagttgctggcgttcctaatgggtcagacctgttaaccagaggtgcaggatttgcattggctttatctgctttttctcccttttttatgatgaaaaatttcaaacattccaaaagtagagagaatagtataataagccccttcctgatacctagcgctaaactaaactttaatgattaactcaaggccagtcttattttacttaaaaccctaccactccccgtctccaaacctaaggctattttggagcaaatcccagcatgtctgcttctaaatagttcctgctttgtcctaaagttttcatcgtagtataaactggtaaaatttcaggagagggcagtttagcagtcttgatatccttatgtgatgttgctttaagaacttattatatagatgatattcctgcacatgtgcagaatgaagcctgtgtatgattattcattccagcattgttgatgatagtaaaagattataaacaacctaaatgttcagcaaaagagactggctaaaaaaaacttacagtggaattctagtgtgctgtaaaaggaatgaggaagttctttatataatgatttggactgatctccatgatgtattattattacttttttttagatagagtcttgctctgttgcccaggctggagtgcagtggcacaatctcagctcactgcaacctccacctcccagattcaagcaattctcccgcttcagcctaacagttagctgggattacaggtgtgcgccaccatgcccagataagtttttgtattttctagtagagacagggtatcgctgtgttggccaggctggtctcaaactcctgacctcaagtgatccacctgcttcggcctcccaaagtgttgggattacaggcatgagccactgtgcccggcctccaggatgtattattaaaagaaaaagataaggtacagaacactgtgaatgatatgctctaacatgtataaaaacagaggaaataatatatttaacattctatatatgtaaattctatatatagatattctctcttatatatagatctatataatatatcatataatataaataatatgatctatataacatatatgttttatatatatgccattatttctggaatgatgcacacgatcatggtagtttggttgttttgcgagaggggaactaggtggttgatagaggtgggagtaaaactttatataccctttctaccttttcagttgtgtatgtaatattaaaaaaaaccctatatttcctatttaaaaatgtaattcctttttttcagtaagcctaaaactgctataaaaataaagtctattgatttcaaaaaggatatttacccaaatgagttgaaaacatgtccacacaaaaacctgcatacagatgttcataacagctttattcataattagcaaccaacatgtctttaaataggggaatgaataaacagtctgtcaacattattccgtagcacagaatattatttggtgataaaaaggagctacaaagccacaaaaagacatggaagaaccctacatgcatattgctaggtgaaagaagccactctaaaaagtctatatactttatgattccagctgtataacatgctgggaaaggcaaaactatagagacagtaagaagattagggtttgccaagggttggggtaagtgagagggaagaataaggggcgaaataggtggagcacgaggatttttagggtggcaacactattctgtatgatactgtaatggtggacacatgacattagacgtttgtcaaaacccagagaatgtacaacacaaagggtgagccgtaatgtaagtgacagactttggtgtgtcagtattggctcttcaattgcaataaatgcacgatggaatgcaagatgttaataatcggagaaactgtgcagtggagaggggatatatgggaactctctgtactttctggtcaattttttggtaaacctaaaatggctctaaaaatagcccattaattaaaaaaaaagactgatctgaagaatcttcctactattgctggtgaggttgtggttgtgaggagcagtggggagtatgaggaatcttgctctccatacggtgggtcacacgggctgtttgccataggtggcagcctgggtgcatgcaaagtgatctttagtaagactgttgcttggagagtgagcaggagtgttatggggatgggtaggcaggctgtgcattcttggactttgaatgtcagaggagtttggctttgatcctataagcaatggggaaccatggagaattttatcaggagggtgacacagggagattggtgctttaggagacctggattgaagaattagttcttacggccgggtgcagtggcttatgcctgtaatcccagcactttgggaggccgaggcgggtggattacttgaggtcaggggttcaagaccatcctggccaacatggtgaaaccccgtttctactaaaaatacaaaaatattagctgggcgtggtggtgtgcacctgtagtccccagctacttgggaagctgaggtgggagaatcacttgaactgggaaggcagaggttgcagtgagctgagatcgcaccactgcactccagcctgggtgacagagtgagactccatctcaaaaaaaaaaaaaaaaaaaaaaagaattagatcttccccttctctgggcctcatgcccctgtctataaaaccaagagactgcaccatgcagtgaggtcatcttcagctttcaggtgttgagttcaaagcctgtccctctttccaacccctttccctccttgccacatcccccttttaatttttctgccactcagctctgtgttatggctggaactgtcccccgggggggaaacgtctgctgaatgaagtctgtgccttgggaacaattctgttttattttattttatttttctctctttgaaatcttcaaggagaaaacccaaatctgtgccagctcgtaggctcctagcagcaacttggatgggaattagaaataatgagatgggtaatcaaatgccctcagggttccagatcagggcaggctgcagaggatgctctgccagggccatttcctgcaagaaggacttgattttgagcccggcaaactgctggagggttccatgcacagcccagcctgggaggctccagctggttgtgtgaactgggggaggttgctctgctctttccaaatcgtctgctgtcatcacgatgtgatttatgagcttttcctctaaaatatgagaatgtcatctcctgataatgctctgtaatgaggaaggctgtggctgcagcttttctaataaataatatctctttagatcaccatcttgctacaaaaagaatgcaagaggttgaatacagagggattaaaagtgtcttttgtgtttgttttgttttaatatggaaaacaaggataattcatggaatgcagaccaagaagttcctgtaggggcctcggtctagcatcatgtcaagggcattatggtaagcttctgagggacctgggtttgattgctggctctgctctgaaccagctgttaggagcacaggctagcgacttcctcctgagctgctacttccttgtctatggggaaaaagtggagaaacactagtagcactcactgcatagttatatttttatgactgtgtgttgatatgacaaggtttggtcttgtgggagtgaggcacctcaatacagttcagttcaacaggtagaccatctaagaggggacctgtgtagtttgttagagttcagagaacgacgtgtgaccttggatgagtccctgatcttggtttacgtaaagccttggtttcttcattattatacatccacgttgaatgtatgtatgtgtggggggtgagtggtgttgtgtgtggtatgtgttgtgtgttttgtatgtatttgtggcgtgaatgtgtgtgccatatgtttgtttgtgtgtgtgtgagctgaggcttccataatcacaacacttaatgtacttggtaaaaagcgcttgctaaagggaaatagtaggctgggcgtggtggctcatgcttgtaatcccagcactttgggaggccgaggtgggcagatcacctgaggtcgggagttcgacaccagcctggctaacatggtaaaaccctgtctctactaaaaatacaaaaattattcaggtgtggtggccggtgcctataatcccagctacttgggaggctgaagaaggacaatcccttgaacctgggagatggaggttgcagtgagttgagatggcgccactgcactccagcctgggcgacagagcaagactctgtctcaaaaaaaaaaaagggaaatagtaatttgctatacagatattgatatcctgatgacctattatgtgctgggagaatctgccctcagagcttaaatttcatttgaggagatgaggcagagatggcatgcatgaaagaatgaaaactaacaaacaaaaaaacccaaacagcgctaggcaatctgagatttgctgtacgtgccatgggagttcaaaagagggtcaccaggctggcagcccaggccttcctgggaggagcagtgctttatgtgggctctgaagcagtggttttcaactttttttttttttttttttgcttacctaccctctacatgaactttggaaagaaaaatatctcttctgcttcacacattttaagttgacatctaaaatgtctcattctttaatttgcactaaataaaataaaatattttattctaagtttgattagttacaaaggatataattttggccatgttttaaatattcacattttagagtaacattatgtataataccactctcttaaaactgtatcaaaatgttgtggggagggatgggtggggtggcttacctctttagtcccagctacttagaaggccaaggcaggaggattgcttgagcccaagagttgaagaccagcctgggtaacataaagaggcctgtctctacaaaaaatttttaaaaatgtgtcaaatagaaactaacatagcaattttaaattttgtctttttattgaagcctcactttgatgtagtagaatgcacagatcttaagtgagcagctcagttaatttttatcagtgtcccttccaccctcaccaaggtgtggaacatctccagtattcagaagccatgcttgttccctctctccatcaatacccgtcaaacgtgaccacttttccgacctctatcaccataaactagttttgcacaacctcattcgttctggcttctttcaataaacacaagatctgtggatttcaaacatgttgctgttgggagcagtagcattcctttttcattattgtatatcattccactcaatgaatatctcacattcaaaaaatccattctattcttactagacattttgggttatttctaatatttggctataaagatactaaaagtattcttgtatatattttttggtgatcataagcactgatttcttttgtgtatgtatccatcagtgaaattgcccggtcataggataaataccataatacattggtttctacaatcatccatcaaagttacctgaacaagtcaaatgttttacactgctcctttctttaccttcttgaactcctaattccctttcacttgcttcataaaatttaatcttaacatattttatgcttgaaagttttttaagattatcatcttttttaaaactctacttatgtaagctgaaatggacattttaattttttcctttgaactctaaggatcttccttttatattgatttatgtatcattgcagtgatcagtaatacacaatttatcaaaataacattattttacacatttgataaatcattaaagcataactttgtatgggaaatgcttctcataatgagatgggcgggatggttgatggcagtgcttatcaaactttaaggtgtacaagggccaccttgggagatcttgataaaatgcagattctgatttggatggtatgggctggggcctgagactttattctgaattttttttttttagcttttttaaggtataattgaaatgccccaaaaatgagcacatttaatttatgcatcttgatgagtttggatgattctgtatttcttctccttcccctcccctcccctcccctcctctctcctcacctgttcttttcttttcttttcttttcattacaggagttccctctaagcatcatggtatggtcatggctcactgaagctttgaactcctgggctaaagcaatcctcccacctcagcctcccaagtagctgggactagaggcatgtgccaccatgcccagctaattactttttaaaatttttactaggccgggtgcagtggctcacacctgtaatcccagcactttgggaggccaaggcgggtggatcacgaggtcaagagatcaagaccatcctggccaacataatgaaacctcgtctctactaaaaatacaaaaaactagctgggtgtggtggtgcgcacctgtcgtcccagctactctagagaccgaggcaggaggatcgcttgaacccaggaggcggaggttgcagtgagtggagatcgggccgctgcactccagcctggcgacagagcgagactccgtctcaaaacacaaaacaaacaataaaattttactaggcatgaggtcttgttatattgcctaggcctctgtatttctaacaagcccattggtggtgctgatgctgctggtctgtggaccacattttaatgtttttgagacagagtcttgctttgtcatataggctggagtgcagtttcacaatcatagctcactgcagcctggacctcctgggctcaagcaatacttctgcctcagcctcctgagtagctgggaacacaagcccatgccaccacacctggctaatttaaaactttttttttttttaagtttttatggagacgaggtctccctatgtttcccaggctggtcttgagcccctggcctcaagtgattctcctgcctcagcctctcaaagtgctgtgatgacagacgtggtctcatggaccacactttgagtagcaagggtttgtgatcccttgattagaggaagatttccaaatatcaactttttaaaaacactttttattatttgaagagaatataactttgtacatgtatttatttacgtataaatttatggagtacaagtgtaattttgttacatgcatagattgtgtggtggtgaagccagggcttcttgggtacccatgacacaaataatgtacattacacccattaagtaatttctcattatccacctccctcccaccccctcacccttctgagtctctgttctctagcattccacactgtacatccaagtgcacacattatttaggtcccacttataactgagaacatgtgtaacatgaacattttacattatttatttatttatttatttagttagttagttagttagttagttagtttttgagacagggtcttgctctgtcgcccaggctggagtgcaatggcgtgcaacctccaccttctgggttcaagtgattctcctgccccagcctccagagtagctgggactccaggcgcctgccactatgcctggctaatttttgtatttttagtagagacagggtttcactgtgtcagccaggatggtctccacctcctgacctcgtgatccacccgcctcggcctcccaaagtgctgggattaaaggcatgagccaccatgcctggccaacatgaacattttaaatggtctatttttccttttgacacccagatgtctcgacattttgggacactgcatcatagattctggacgagtgagcagttgctctttttcctgtaaagagagaacaggaccattgtgaggaggggaggtaggaaaggagaggggccgtgcatctagactgaggcacgttgtcaggcagtgggaatggatgtggaggatctcaggttgattcccttctacctcagcttgcataccctgtggggtgtctttgtgtaccccagagtagttctgccccagtttgaagtccacttctctgaaggatgctgaaatgacgctggccaccatttcagacggggcacacatttaggcaggtgagatctgatattccaaggactggcttgaatggtttggagagtccattggggtaaagtcctgagaaatgaaatttgggactgcttggtggatggtcttgaatgtcatgctgaggagttggacctaatactcaggcagaggggagccgtggggtatttctgagcacgttgctggtgtgagcagagtgctttggaggctgatctgttgagcagctcttgggatggcctggaaagaatctatgcctgggggcagtggcggtgacaaccctacaggcttgaagacaagaatggatgtggttattggcattcagctgtgatttttaactccagcttccagcttttgaattgttgccctggttgcgtagatctggtttgagcaatcagtattttctgaagtgtgatatctgagaggttcatacatggaattcaaggtgatttaaagcaggacacagatgtggccttaaataacactgaaacccacgagggaaaagcatgcccttctcagccctctctcagtcctgactacacatggagaaagtcacactgccgttttcctttggttgataaagagccagcagcttaggcttagagcctttggtaaacaattgtctctagatagaattttacaatacttttgttttcattgaattatttcctacgtcccaggctgcaaggggtcctagtgtttcactttactgtattgatagaaacctttgcattttaagcaagatcatctccgtaagaaaggtgagtcaatttactagatcatgtggaagaaataagaatgcttggggcctgtgaatatggcaaaaatcgtggtggtgacatgcagtgattcaagttttggaaacttttggttagatcaatggcaaaaacgagcaagagagaaatctttgtgccaatgctctgccaagcaaggtctgagctctggctgggctcagagaggctctggatggtgttaggagggagctgcctgaattgcagggcccaggccagcagcagagcgggccccagtgcccccgtccccaccaccagtctcatgctcctacccttgtgtgcccgcagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagtaagaagttgggtatgggtgcacagagatgggaggcagcactggggtgggcggacagttggtggcaaagcagaaaggaggccagccagcttcattggaggcagagggtgtgccttcagggccctggctctgcaggttacttacacctccaagcctcagtcttcctcatgtgtaaagggaagctagaaagagttcctctgcagaagtttcctgaagggaataaatgaacaacccaagaagagtgtttgtcacagacaataggtgctcaatcaattgttgctgttattattatgctaccaagcaccggcactgagctagcctccatttgtgccctggtgagacccctacctcccttcaggacatcctgtcccgatccagttgtcctttatttgggtgtcagccagccttcttctgaattttgttagctcagtgaatttcttctccatggaattgatgctcaaacattcctcttccttgctctcctggaggacctcagtgccccggctctttccctgccttatttacttattttcgatgcacaaactgtcatgtgtcctgatttctcatatcccaagctctgagatcatggaggctccatctgcttgggcattgacttggcaggtcctgaatcctccagctacaaaaccttctgtgcttagaactccctggcttcagctcattaaatacaggcaggcaggaagcagcaaatctcacttggactgtgtcaaccatgcagggctccacttggcaggtcccccggccagcactgtctctccttcagccatgcttcctggactctcccttctccttgggtcatctctccagctggtggccctcaacaccaggagatcagcgacttgctttatctcacctgacctgatcctgatcccccttcccctgggtcctgtcctgtttctctctctctctctctctctctgtgtatacacacacatacatatatacacacatacacacacacacacacacacacatatatacatatatatatatatatattttgagacagagtctcactctgtcacccaggttggagtgcagtggcatgatctcagctcactgcaatctccaactcccgggttcaagagattctcctgcctcagcctcctgagtagctgagattccacgtgcaccaccacgcccaactaatctttgtatttttagtagagatggggtttcaccatgttggccaggctggtcttgaactcctgacatcaagtgatccacctgcttcagcctcccaaagtgctgggattacagatgtgagccaccatacccggcctctccatgtatgtgtatgtatgtgtattgtgtatgtatatatatatatatattttttaattgtgacaaagcacacataatataaaatttaccattttcatcatttttaaatgaacagttcagtggcactaaacacattcacaatgttatgcaaccatcgccaccatccaactccagtgctttttacatcttcctccactgaaattctatccccattaaacactaactccccattccctgccacgccttccagctgccggcaactaccattctactttatgtctttatgaattcgactgctgtagatatgtcatataagtgcaattatacaatatttgtctctttgtgactggctagtttcacttagcataatgcctcaaagttcatccctgtggtagcatgtgtcagaatgttcttcctttttcaggctgaataatatggtgcagatagaccacattttgtttgtttggtcatctgttggtggacacttgggtcgcgtccaccttcctgtccacattttttgcattccactctggccagggagctctctgcctttaaactcctctaaacacttccttgagtctgtgccacagcatttgaacactcacttatgtgccttctcttggcatttggggataagaaattggtgcattacacatttgcaaataccgtgcttctttttctaccctatcttctcccttttttttttttttttttgagacggagtcttgctctgccacccaggctggaatgcagtggtgcgatctcggctcactgcaagctccgcctcccaggttcaagcaattctcctgcctcagcctcccaagtagctgggactacaggtgcccgccacgatgcccagctaattttttgtatttttagtagagacggggtttcaccatgttagccaggatggtctccatctcctgacctcatgatccgcccgcctcggcctcccaaagtgctgggattaaaggtgtgagccaccgcgcccagccacccagtctcttctcttcaaacttctgctgcaggaggaagcctctattaataacattcactcaggcacagtctagaccctttcacacatataatctcatatttttttggagaaaaattgtgttttttcaaacaacaaaggtaaaatgctcattgtatacaatttagaaagtacagaaaagagaaaaatatcattcatagtcccactgctcacaaccactgctcacattttggaatcatttctcccttgtcttttaagaataaaaacaaagataatgtatcgaaccgagcacttactttggtgccaggtgggtattactaccccatcgtaaagatgaggatggtgaagctctgagaaagcagcttgtccaaacatgtctgtgaacccgcaattggaaagagacagaattgaacctttgtctcttctctgcctccttggcctgggataagaaagggcctaggtgcagcttgagagtagccatgacatctggaccctccctggaaccacaggcacagcagacataggctcagaaccccacaactctggctgaatggccactggagccagcaagtcttgggctctccctagctgcagacagggccatgtggtagggctggagcatctctcctgtccgctccttccccttgattaggaatcagctctcttcccattctcagtgtgcacatagggagaggagaaaggcagggattgtggatatgggggggcaccctattcccttgtatcacctataatgagctcggccagcccctcatgggttcattaactgaggccaccagacggaacgggagccccagctggcagcccggccatgcaggctgcctgacgcactatgaaagtctaattagggtgccggcccaggccagtgcagctggagggggccctctgcacgatgctaatgtgatggcagagccgtctccgcttctggaagtggagtctctaggggcaggctggactcaccctttgaccccagggcactgactggcctcgggctgcctattccttggagcccagcacacaggacctgtgttgctctctgctcccttcatctgggctgttccgagaagccttgtctcaccgtcgtaaagattcttggtttaataatgtccatctacctgccaagtagcccctcagtgccttaagggcagagcccaggacttgtcattttattcccattgcagtgggtcaggtgcttggcagagctggggtgcgtgtgcatgggtgggagggaggaaggagggaagaagacaggaaggaaggaagggagaggattgacttggtctatctagtccactttggctgagagatttgcctcagagatggaactgatttgcccaagattttacagtaaattaggagcagaactgggatggagactcagttcccttggctccgagtctattgctcctccttgtgctccatgggccgtgtctccctaaggccccagccattccctccccacctgggcaattgaagaatgtgctgctgcccaggaatacgcactgtgctgtgttcagggctagactcacctgggctgagttccctgtgacacgtgatccaaagaaaggcccacgtgatggttctgaaggtttccctgggacaggttaacatttagagaaaaatatcatcatatttcttttctacaacacatatccaattctaacaaacctctttcaaagcactctgacatccttgctctcttataaacctgatgacaacccagggaagtggagagggaatcagtggttttatgtcaagcaaactgagcaacagaaaagctgagctgcttactttaacgaggacccaatgagctgtcgagcatgaaaacccagggttcttgacttccaactcaggcttctctctccaagaagccatgtgggacttcatttgtttgaaatgtgtgcattgaagacctcatattttcctggactgtgctcagtgccgaagacacaaagataaatgaggtgcgatttctgctgccagatactgagagacaagaacatggcttggggaggcctggtagttggtatggctgaggaggccccaatcccatggctgtgccctttgagccctgcacctgcgtgccatcagcctgcagcactgagatgtcacttctattgaaaagcttccttgattcccacctggtgcctccctctgtgtgcccgtcgtactctgatgtacttatttgcttattccaccaatatttattgagcacctaccatgtgccagaccctgggtttacagtggtgaacaagatagacttggttcctgctgtggtgaaatttaccatgaagaataaaacattaaaaagcagctaaaagaaagaccagctataatccaatgattgctatgatggaaataaatacactatggagtattctgattatctctcccgtataactgcaatgcccccaaagttagtgtaccttgtgatttaatggatcaaagatttggacagggctcagctgggtgatttttctgctgtatgtggcattgatggctcagtgatattcagctagcagagggcctggtctggacagtcccagagagctttactcgcatgcctggttcctccatggggacggctagtaggccgggccctgctgggctgtctccctctccatgtagtgtcagggcctcctgcttcagccgggcatcagacttctgacagtagctcggggcttctagagagcaggacagcagctgcagtcctcttaactgctaggcctggagctggaatagcatcactccccacccagatgctatttgccaaagctgtctcagccctagctcagcttcaggaaaggggaaataaagccctcctatcattggaggagtgtcaaagggttggcagcccacaccaagctaggaccacgatcaggaaggtgtctggaggaagcgtggtttaagctgaggcctgagaaatgagaaggagcaacgtgcagcagtggagggggatggaagccaagtggctggaactggtgagtgtgggagtgggaagaagggagttgcatgatgtgatttatatgtttaaaagaccacctgggttggagggtggagccgaggagcccactcatgggcatgtgggtatagctctccaggcagggacagtgatggcctgggtgggaacagagcagatgagagaagccatcagatgccaggaaacctctcagagaggaatggaggaaaagagaggcaacaaggatgtctcctgtttctgccttgagatgggaaggacttggggaagagggtgaggtaagagctacagccctgtattgtcatcgtctgtttacttgtctgtcctcctttggacaaccactgggctgcaagctccgagatggcagagagggtgactcttgacccggggtccctagcacctctcacagggctggcacctggttgttactgaatgtcattgattaatgaactaatgaatgaaaggcaagtgataattagatttgcatagggaggacagggaaagggggcatgtttgtcttctggctgccttagctcagtgaggccatctgggtgaagtgtcactcgctcatgtgcctgtcacgggtcctgtattgctgaaaggacagagtgtggactgtgccatggtctccctgtttggggaatgggagcagcggcattggcatcacatgaggacctgctagaaatgcaagatctggggtatttcctgagacctgctggatcagaacttcttggggggggggcctggcaatctgcatttaacaagccccctgggggagtctgttggcagttcactttgaagagccagtctgatgtttttctggggaataaatggttttcaactcacttttgggctgtgctggccttccctcctcttcaccagcgtcaaatccataatccactgccctctccaagctaggcctaacctgagtttggcttttcctttggaaggcctggagctgagcccttcctgagcaggactctggtgtagcaggcagcacatatggggcccccaaacctgcctcttggggtaggtggatggtcttgtccaaatgaatttggcagctccatgaacacagatgtttcctgggaatgagactttttcttcctccaggaaaatgtctctaaaacaccaatactttgagatgtttgaatgggagagagagagaggaagaggaggaggagaaggaggatacgaaagactgatttttgtaataattaagcctgttgacttctttctgaaagctatttgaccacaggattccctctccctatttatttatttacatatttacttatttttgagacagagtctcaccctgtcgcccaagctggaatgtagtggtgtgatcacagctcactgcagtctcaaacttctgggctcaagtgatcctcctgcctcagcctcccaagtaaccgggactacaggtacatgccaccacatctgaaatttaaaaaaaaaaatgaattatttttttgtagaggcaggggtcttgctatgttgtccaggctggacttaaacttctggactcaagcaattctcttaccttagccacccaaaacactgcgattataggcagaaccaccgcacctggctctccccatgatatttactagtatttcacaaactagcacttcttgagacctagtttgaaaatctctgttctagacaaatgctggggttaccctctgtagtagtgacactccatgcaagtagtgccctgtgtttggggtgacagagtccccttctattctagctttctcagtttttgatacccctcaccttccaggagctgtacctgatgaaaatgctccatgcagagggttaagtgctggttgctgctagtttaactgctgtgaaaaaaagcagcagggagttctatttaaatatgatttaaacatttgggaaaagccagaatttgggaagtgctgggaggcacttggctagttagggaataatattctatgcagatatcctgtgcaaaggaggtttggagcatctttcagcttcacagagcagttgggagagaggattcctgtgaacaactaacttcatttccaagaaaacacttcttagcggggataaagcatcacaggatttttttcacagatgtagcaattctctaaagagatgctataatttagacttagccttccaggctattcctaaacagagaatcacttttgtagcatataaattgagcatataaatgtgaaaaggagtcagaattaaaatgtttgcttagaatgagatggagatggagaaagccctccagtagggcttgtgtctccattcacagctattactattactgcgattggtatcaagctagtaatggctttctggggtcctactttccagacctgctgttctctcagcaccgtgtgccagctggatctttcctgattgtttggtgcctgtgctgtgcaggtcgtttactcttccaagcaccccacacatccacatcaccgtggaccaagtgctgtactggatgtctgataggcatcatctcattgcaccttcatgggaaatgtggtctgtgaagaaggggctgtctttatctttctaggtgaagacactgagttttcgagaaattaagtaatttgcccagagggacatagctagcacaggtgagtggcagagctaggattccaatctttgtttacctgactccaaaatgcaaaactgcatctagctgctgactttgttccctcatctttctgggctggctttgagcttcttgagaattacccatgcatgtcgaccatatcctccttggatgagcatcaggggtttgctattatcctcctggtcaactcctacacagaggccagcttagggcttgccttcttggtgaagcccctgctgttggttgatcccaagtctacagtcagctgctcctctcgcctcccatgtgagttgtgtggggcttgcatcagattatcaaggagtgatccagttcctatatctggttctctcacttcagtcggccagctgcctgaaggcaagggaccatttctagtctccctctctctggtatataattgatgctttatcaaagttttttcagtgaatggctgaattaaccaagacactaccaaatgctttctttaaatatatttaacaaatagacttattttgtgtggctgcgaaaggagataaatgatgtccgaggatagcattttcagagaagcaaacttcaattcaaccttaaggacgttccagtagccacagctgtccatcagtgaaagggctgcctggggaggtagtgagttctcaatgcacagaggtatacacacaaaggctgggtattttaagggtgtcatttcggtaatatggatgatcaaaatgaaaggggattcttgataacacaggaaccataaatattgaattatcttctcaattctctttcaaggtttctggtagcctggaggagaaagtctcagtttggtcctagtgtattgttaatgtcctccaatctcctttttagcaaatagagaacagacctcaagattgaatatactgtttggtttttgttgaatttagttttttggttaccttctatttataacaaaccatcctgttttttttaaagctgaaactagggaagttctttgtaaataaatttaagttaaaaaaagacatcaacagggagatattaagtgtggtggtgtgcaggaatggcaaaaatcctgaagccagcatcaaatcactctaagtcccattccagtttctcctgcaaagtgagcatctttcatctttaccttctttatcctccacaattttttttttaaatgaggggaaaggattttaacataggaggctcagcctgaagagtggattttgcaatggctgtagctcctttatctctttccaatgtttccatctggctctttcccaggtcccacaccaaattccctggaatcctcagagactctaatcagcaactaccaaagcattaactaggacgtgatttctttatgcatgcatatactttgatatgcatatatacatttctatcatttaatttttatactagaaatgaaaaatagatgtaaaaattagattttcacaaacagtaatatgtacgggtttagttttgatgctattctattaggcaaataggataataataaccttcaaagactatatagcaccttacactttgcaaactccttcctcagcccttagctgcttaaatcctcccaagaaccctggtgagagttgaaggagtcaaggaaggtgttgtcatccccaactgataggcaagggaccaactgataggcaaggcagggtgaaccctaacttcagacccacagctgacccgtgaaagaactgacccagttttgcattttggagtcaggtaaacccagattggaatgctagtctgccacttacctgtgctagccgtgtccatctgggcaaatgacttaatttcttgaaaactcagtgtcttcacctagaaagataaagacagccccttcttcacagaccacatttcccatgaaggtgcaatgagatgatgcctatcagacatccagtagagcacttggttcacggtgatgtggatgtgtggggtgcttagaagattaaatgacctgcacagcacaggcaccaaacaatcaggaagccatggatcggggtcttttcctctgcctagtgctacacatgccacacggtgccacccattctgtgggcagataaaccaaggcaaaggggcttgcaaggaaagagttgaggttgaccaggcattgcctatgaggcagagttttttgctctgataccaagaatccatccagaaagtcaaaggggagctcagaggtgctgctggacaccagacaccaacgtgtaccctcatgctgcagtgtgaggaatgggatcacagaggaagcagtgagcccgtgaatcattctgccctgggatgaagggggagtcacagggacatttgcactgagcattgaagttcacataacagtctgcagaaggagaaagtagtaatggaggagaaaaaccaatagttttagaacacttatcataggctgtttgtctatgtacatcaggccttagatcttcccaacaacttattgaggtgctagtggtaataatggtaatgacaataaaaagtactattatgtgcagggtttgacaccaagagaatagcatgggttgtgtcatttagtcctccaggcaccactatgaggtagtcgtcacttcgtttcacagataaggaaagagaaggtttaactataataactttccaagttcactttgttggtgagggacagaattggcatttgaaccccagcctcttgactcaatagcaccccaactgataagcaaagcctgctttggccaggggactcaatggatggaattagtccccttcaggatgactctgtctccgggctgccaaatagtgccagagctaggccctgaactgcgctctctggctcccagcatggcagcctcacactcctcgggggactcctggtgggtgggggataataaagtaaatatttataaagtaatttataaagaaaaggggtttaatggactcacaatttcgcatggctggggaggcctcaggaaacttacaatcatgatgggaggcacctcttcacagggcagcaggggagagaaagagtgcccagtgaagggggaacccccttataaaaccatcagatcttgtgagaactcattcactatcatgagaacagcatgggggaaccgtcccccatgattcagttatctccacctggtcccacccatgacacgtggggattatactacaattcaagatgagatttgggtggggacacagccaaaccatatcagggtggaactgtgtcccctcaaaattcctatgctgatgtcctaaactccagtacctcaaaatgtgaccttatttggaaacagggtctttatagaagtaatcagataaaaatgaggtcattgggaagggccctaatccgacatgactggtgtgtatctttacaaaaaaaggaactttgggcacagagaccaacacacagggagaatgccttggaaaggtgaaggcaaagattggggtgctgtgtctacaccaaggacaccaaagatctccagcaacctaccaggagccaggagagaggcctgggacagatcctccttcacagtccttggaaggaaccaaccctgccgacaccttgatctcggacttccagcctccaggactgtgagacaacacatacctgttgtctgagccactctatggtcctgtgtgacagcacctacaaaactagtacgcagccccatgcacgtcttgtccttcagggccctggctgtgctacatgttcagtcttgtctgaccctcatccagtccctgtctgccctctggccacactcactttctgtcagttctagatgatgcccgtgcccatgagggcttcatgcttatttctgggaatgctcttctttatcactgtgctgtgttaaaacctacccatccttctagtctgagctcagggggcacttttcacctactcacaaatattttctgagagtgcctgtgtgcccaggttggcctgggcaccagagaagcactgatgagtaggacagacataagctagagaggggacaaagaccagaagcaaaaaggaaaagaacacaacaagcatcaggtgtggagtgctgtaatgacaatgacatagtgtgacatagggtgtgtgggtggccagggaggcatccaggaggagaaatagctcagctcaggtctcagtgatgagaaggaccccagggtcccctgatgctccctcccctccgccttccccaggagagggcagccccctgttaaagactctccaggctccatgtatttctccttcagagcccttcttcccgctgccattttctattgatttttgtgattatctgattgttatctgagacccccactagactgtaagctccacgaagtgggaagtgtggctcattttgcttaccattgcctggcacagaacaggcacacacttactattggctgaattaatgattcatgctacaagcaagtgcaatgaatgctgaatcctgcttggggcagcttaggtagcaggaggttaaatgcacctttctggccacagaactgattgagttagcatttctcggacgcaagcccagtgtgaggcctgagaaggtcctggaacggggcaggaagcccaagcaggagcttgccttcctcccagagggaccctgatcccagggcagtggctttggattcatctggaacatgggactctgcaagcttggaaatgggttttgtttgctaagcggaattttccggccctcagccgagaagctggagaaactggctcactgctaatttcattttcccaactcactagcttggcaaggcctggctcccctagctgcagtctcctggaacctcatatccagatcccctagccaaagaaagaaagctgtgactcaccagaaatgttcattgctattttctggccataaaaaaagaaaatagatacatacatatgcaaaatttctaacgtgatgtcttagttcagcagcttctgcttgctgggtcgacgcttgcatgaaagattggagaagcggaagggtcactctgagtgccttggccgagggcactggccctcattcattctgatgtcttccaaaaatgaggctgcagaagacaaaagtggctgctggcacagagagctggatctcaggtcaaaggggttccactttccaaaggggcaaacaaccccaggaacagggaaggcagaggctcaagttttctgcagcctggcgtctggctctgcggtctgcggccctcgtgcttcctccctcctgcagtcccattgtgagccagatgggggcaggatggagtgtgtgagaccctgcaggcccctccagcctcactcttcaccctcttcctcctctgccttgcctcccactccagccaggctgttctttacttagttccttaaatgcaccaggctctccgccctgaggcgcctttgcccattctgttccctctgcctagagccttctcccgccagcccacctgcccagcccctttcactagcgccctccaactcttcctttggagcacagcttaatgacctcttccttggggacactttagtgacccacaaatcaggccagcccccttattacaggcactcatggcacaggctcccctctgttccagcacattctgcacttctaactctacccacattcgtgggctcatggtaggtgtctgtctcttcaccagactgtctgctccatgaaggcaggaactgtgtctgttgggctcaaggttgtgtccctggggtctgatctatacaaaatattcaacaaaaatgtatggaatgcatgaactgctgaagaatgactgcagagctctcttctggcatttaagcccagagtgactccatggtgtgagtggccaggctacagggaataggtggcctgcccggagtccacagctagcatggcagacgccggtgaacacccatgcccacgtccaggtggctttctgttctctactgctgtgctgagtcccacctgtgggccttcttctttcagatgtggtagagcctgcctggtaccattgtggccaaggccacacatgctagctttctacagagcagctcttgaccctggctgtggacagttcaccccagccttttagactacaaatgacctgccccacaggagggagccagggctgggagaaggtgggggtgcagacccagcagtttcccatgctgggatggacctagagaatgggccgctgatcggacggcaggcctgggacagcatctcagaggaggccaggctgcacattgccccatcttgccctcttttagggaagcaggaggggaggcgccaccgcggcttggccctgccccagccctccggccacagccttgccatgcttcccggggattgacctcttctgccatgtggccacagcatttgtaaagccttccttgttgttctgtggttttaaatagcatccaactccttgctgctggcttccatgtttgtctctccagcccagatagctccatctggatgccccacagccttttagactcgtcgtgttcgactcgaactcatcatcctccctccccgccccacccttgacctgctcctcttcatctccacagaggctccttctactcccccaggtgcccaaaccaaaaactggagagtcatcctggacatcttttgctctctctcaacttccagccctaactccatcccgtcaatctccctgtccagtcaatttcctacctaagcctttcttgaatccctcagtttctctcccggcccctggctctgtacagcagccagagtgagagtttgaaagtgcagttttaccctttcactccccttctgtaaacccttcaaggtctgcctgctgacctcaggacggagcttgaactctaatgagagttaaaggccctttcccaagtggcccctgcctcagtctccatgttcacctgctgtcctcactctcctaccccaaaacaccatgcttgggccccctccctacctgctcctccctctcctgctcctccctgggcctttgctcatcacatttctcccctttgaaggctcctccctgtgaaactccagtccggcttttagttctcagtctagaaagcgtttcctccaggaagccatgcatgaccaacctcaccaccagatctggggaaggaggctcctctctgctccatagcctccttcccatgactgcactgatgaggctgcctcatcactttctgttccttgtgaatctccttactcaagtggaagacttgcagggcagggtcttgcagccttggttgctcctgcactcgcagcacctagtcctgcccagcacagacacacaaacgcaaggagtgaacgagggctggaaggaatcttcacagcagctgctcacttcaacttgagtctttggctgctttcgggtaacatcctcctccttgccttggctcgctctgcctcctgcaattctgtcttataccgcactgcctcctggcttgcagcttctgataaggacagcgctgtgctctctgcccttcctctcatctcatctctctggctagatgacctagttaatggtccccaaactgtcccagcaattccccatcagttccagatcagttgtctttttccttccctctgaaactcaccttctggctgtggcttccataattttgcacaatttaattccctggtgctgttcacttcttgcctcccaggttcagctaagcccctgaagtaatttaggtaacagctcaattatctcatctctcctttaatctttccatttccatcaccacctaggaagcagtgaaaatgagataagcaatgcattttctgtccaaacctactgctccccttgcagttcttatctcagttcatgtcatcagcatctacccagtcgcctaagatctgagcctcggaatcactgtctgctccttcctcctctttctgctgttttccaggaagtttccaagaggatctgctctcctgttgagaaatctctcaagtccatccttcgctggctacaagaccacacccaggcctcactatttctcttttgaactaagattacctcctgcctggtcctcttaccaaaagccccatatccctgctcatccacccacccacctacccatccatcccttcatcctccaatctgccttccatgatcatgccaaaacacatgttggttatatcctacctctgctgaaataacttccatgactccccactgcccatagcagacattcttatttattttagaaactgggtcttgcctattactcaggctggagtgcagtggcatgatcatagctcactgcagcttccacctcccgggctccagtgatcctcccacctcagtctcccaagtaactaggactacgggtgtgtgccactatgcccagctaatttttaaattttttgtagagacggagtcttgctatgttgcccaggctggtcttgaactcctggactcaagtgatcctcctacctcagcctcccaaagccctgggactcaggcacgagccactgcacccggcctaaagcaggcattcttaaccctggctgcacattagaatcttctagagagtataaaaatatgagtaccacgcgctacccccagagattctgattttgtcttggatgggtcctgggtcttggtgtttttttaaaagctccccagttgattctagtgtacaggacaggttgagaactatgtggtctagaagataaggggtcccacccccttagtctggcagtctcccccaacattgggcctttaatctgtatccccagcctcatgtcctacagtcctccactaacacactcagaattccagctcttctgagctacttcactatatttgtacccactggtccttctacccacaattccatcctctctctgacttctgaccatttggaaaactcctacccatccttcaagacccagcacaaatgcagtcttttttcatgggtctctcttccatagcatctgctacatggcaggcacattgctgggtgctggacgtgatgacacaatagaagtgatccctgctctcaaagagctcacagtagggtgagggggagggatggaaactccttaaggtagaagttctgtaacttgagtatgcatccaaatcaccttgagagtttgttaaaacacagattctgggcccagccctagggcttctgagtacacgtagtctggggctgccctgagaacttgtattttcaagttcctaagtgatgctgctgctgctggttcaggggccacactgagaaccactgccttagcgtgtggtcaacggggtgttctctagggaggtatcatctaagctgaacctacagtaatagaaacaggcattcatgagaagagcagggactgtggtattccaggcagagggaaaagcgtccaggccccagtgggaatagaagaggccgcgtgcctggtacccagaacacactggaggagaacgatgccttctgcagcttctccagcagaactgatgctctgcgtatgtctctgttatagactggaaccaccttcctctctaattctttttttctgatgcagccactcagcagtgagcccctccaaggcagagtgtgcatcacggccacctttgggtgcccagaacccacccaagacctgacacagtagatgctgagggattctagttggggtctaattgtagtgtcctggcttttactctaggctataagccaaggagaaatctggttgtttcacagcagtgttgtaaatgcttcatcatcctcccttttccttagatagttcccatcctttatctaaatctaattatcttctcacaaatttctgctgcctagatagatttttagcacatttggtgagagaaagaaaaattccttgaagtcaaggtagccctgccccacctaccttcccaagccccaggagatagggagaggtggggtggtgggggtggggtggggacagcagttcaggggtccttctgcttggctttggggaggtggatgtggtcatagtgggagtcagcagaattgctgtattagtccattttcacactgctgataaacacatacccaagagtgggaagaaaaagaagtttaattggactcactgtcccacatggctagggaagcctcagaatcatggtgggaggtgaaaggcacttcttatatggtggtggcaagagaaaatgaggaggaagcaaaagcagaaacccctgataagcccatcagatcttatgaaacgtattcactatcacgagaatagcacgggaaagactggcccccaagaccattcccacaacatgtgggaattctgggagatacaattcaagttgagatttgggtggggacaaaaccaaactatatcaattgccttcctcaaaaaacgctaatagtgggaggctgtgttttctaagaacagaaccttggccagctcctggaggtggtccacactcaggacaggggtgggacaaggcaggcctgggggaaccctggagctgccacctcaggtggtggaagggcctctcccctcacatcctgcctttccaacatctctctccacactggaaaggagtcagggagataccctgggtcagagggcaagagctttagcataggtgccctgcgtggcaggaaagggttattggtttggttttgcttttgaattgacctttctcttccttcctggataacagggtgtatccaccctttcctgaggctcacagaggggtctttggcaaatacagatggtccttaatttaactatgggttgacttataattttgagaatttacagtgttgtgaaagtgatacacattcagtataaaccgtatttcaagtacacataaaaccattctgtttttcactttcaggatagcattcaactaattacatgagatattcaacagtttattagaaaataggctttgtgtgcaatgattttgcccatccgtaggctaatgtgttctgagcacgtttaaggtagggtaggctaaactatgatgttccgtagtttgggcttactaaatgcattttcaacttaggatatcttcaacttgtgaggggtttattgggatgtagccctgtagtaagttgaggagcatctgcagagccaagagacagattttctctggtctcattagcatcctgagctttgggaaacaatagtataaggatctgtggttctcagacttgagtgagtatccgaatcccctggagggcttggtaaagcccagattgcaggcccacccccagagtgtgtgactcagcaggtctggagtgggactggagagtctgcatttctaaccagtccccaggtcatgctcttgctgctggtctgggagcacactttaagaacccctgcttcagcatcacacccagctagagagtgctaataacctatcagtcattgcaggacaaagggttatttgtcttgtaggtacttgcattttccttaacccttcctcctgaacacagaatctgagccctcctagcccctttcccaacagctccgtggaggggcaaaggcatgtgtttccaagaggccaagagacagaagccaatccctggggaagaacaaagaagttaagagcccaagaaaattacaggggttgaggcaggcagaatgggggagtggaagtatctactttttgttctttctattgcatagttccagaaatcatacaagtataatatttaaaaaacaattggtttagtatttcttagccccaggggaggtagcttcttcccagaaggtagaggtacctggagcaagcaccacattcagtgctagagtagaaccgcataggcgtcaaagacctgggttctggccccagtgctggtctgtgaccttggaggatcccttcagctgttgtagcctgtttccccaactgtataaggtgtaacaacaagactgaccttgaaggggcaccgtggaggttaaaagagctgaagtgggtgacagcataaaccactgttggatgacagttccaatgtagccaacctgagctttcttggtttccacaggaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaaggtaggcaagtgggctgctctacgtgtcccaggtctttgccccaagctggcccatggtaacagtataccagccagggtgggatgtggtttggagacaagggaccaggaggggcaggtgcattgaaggatgcaagtggctgagggctggacttgggaccccagcccatttgaaccctggatgtgccttttaaagagtgtgtagtcttagccactttagcaaccactgccacaaaaatgaaaacctttgcatggctaggtaagtagtacatattcattgtagaaaattttaaagaatgacgatgagcacacacacaaaaattaaaatcacctgaaatggcattgtttggagataatcactttgatatcctaggaatttctcgtgtacaaacgcaaatgcattttctgagagtgcttagatttgtatattttctagtgtacacatgcattttttctaaatcagatcataatgcatatatgattttactacctgcttatgtcacctaacaaattacgtaacactctattacattttcccacatcaatagtatatttctataacattttgaatgattacacagtatttcattatatagatgtactctatttaatctcttattgttgagcacttagtttatttctgttattttactcttataaataacactgccgtgagcttctttgtcacattcgctgttactttcttaggatcagtttctgcagtgggaattttagagtcgaaagtatgctcatttttaatgcttttgacagtgtaccttattgccttcagaaaggttttacccatataaacatccagaagctgagtgtggaaggagcactgaggtctctgtatcccacgttccttgcacagtgcctggcatgtacaaggtgctgtgcaaatgtttgtagaactaaactcacttttgtgaatttcagtttccttgtctgtaaaatgggtaagttatttagcctctgtgaaactcatcctctttgtctatcctgcagggttaagatcagctacttcccaggagggtgagcgttaaacaaatggtgtgcggggagagtggcattattgcaaagtggtttgggatgtggcctctgggtccagaattcttaaattcttgggttcataatcctggttccatgatttattagctgtgtatcttcgggcttgttacttcaatgctctgtgcctcagtttcctcatttgtgaaatggtgatggagataaatacccatgggcagatggaaggattaacaggcttgttgttcctgtgtacagcatggagagcatcacttggcacttagtaggtgctcatgaaagctgactattattatgcgaatttaagagactattattaccaaaagaatctagctcatctcttcttgccaggtgccagtttcaggggtttggtgatctgagattgctagaagcacaaagaaggggacaagttgattgaaaatataatcatctctccatggtctgtgtttggattgtccactttgaggattacttctatagcaaaagtgtaatcgcaggctaattttctcctgccacacaatatgcttctggtctccttctggggttgtgtttatgaaatgtgggctaagtttcatattgcataagcaaacacaattaggaaggtaaatacggtgcaaagaaaaaaaaattacacagtgctttgcaaagccaaactgaagtgatccagacgtctgcaagtttggactgttggtcccattcccagcccccgcctgctgctgctgtcacatcttttttccttggtgggagtgactcacagagaaagggtcatcaaggcctttaggaaatgaagggtcttttttcctgagctgagccctgggacaagtgagataaatcttttcagttctcatttaggctgacagcagcctgacttgtgatggaggttaacagggtggaaaataatgaaaaaaatgtctacagctgagctcctggctgccttgttaccaggcctgtgcctgtggaacaaaggaaacaacccagcccacaggggctttggagagaggcgcggacggagcctggctggctgactttgcacagcacggcccctttgtgttgcatcagttacacctaatttcggaatggaggccggcactctttacataataatagttcccgcagacctcaaagcaactatggaggctgctctctggtcagactggggatcctcactcacctcattttacaggtgaggaagtaaagcgttgggaggctgcaaggagaacccagacttggttgctttgggccccttgtcattaccagcaggaggcggagtggctgggcttttggagtttgtctcagaactgcctatcactgcaccctgggcaagtctctctgagtctcagttttgtcatctgggaaatggagctggtaacaatgccaacttcacagggggccgctttaatatgcagaggtgagccaagtgtccagcccaggcctggtatccagtaggtgcttattaaatggtagcttgccagtgatccctaagaatagaaaccactccccatgtctgagctggggtcctagggctctaccaagccacagtctggcagtgaggctgcgggagatgggagcggcttctaggccaggtgtctgtcctgtgcctatcttctggcttgggcctgggcagctgccctgcctgccagcttctcactgatgcgggaggtggtttgacttaataacttaccttttcatgattctccatttccccttttgcagtggagtctgttcttatgactagaggagcacttcaaattccagaagcccctgcacgtggcccttgctttaagtgtgagatgtggatcagccctagcaaaattaaactgaatgagatccaggaggccatcgttagtgatcaggactcttatggtggcagacagcagaaatgcagcttgcccctctttaagagaaaaagggaccttactagttataagcctggcttcgggcatgcggggcttcagaggaacaaaggatgttactagaactctgtctttctgcaactctttcggcaactctgctccagttttctctgtttcccgttttttgtggggaggcgaggggctcttttacagtcagccccacccgctggccgtgtgataaccagagggcccctggcatctccagacctacatcctctctgcttcaagtcccttttcccagaatgggatattttggtctgtgattggtccagcacgggtcacgtgagcacaccgggtgctgcgtctgtggctggggcgctgcagggctctgcctcgccaggccgggacacatacccatccctgaagccagatgcacactcagttccacctgacccatgggactgagaatgggtgaggggtggttccccaagaaaagtaggggtgcctttacaagaagaagggagaaataaaacaggagatggccactggactctcttttccagcccttttatcatcctctacagcagctgtacgcctctgctagatgtccctcaataaagaacgctccttacctctcaggatagctcattccatgtgggaacatccgtgatcaatagaaaattctcccgaatgccgaaatggaatcttgtagtgttttcactcacaggtcctgatcatccctagagggccaaacagatcaaacctgtcacatggaaacctgtcagttgcttgaaggcagaaatcgtgaccatccactggtccttcctgcctatgggcagatgtcccaggttccttccatcgtcctcctggaatttggctttgtgtttctgtccccatatcagtcgccctgcctgggtcatgcttcaggtcttctctgacctacagaagttactattcagaaccagtcggaatactctaggaaggtctgagcagctcagggcagagcagggctgtccagacactttatttctcataagacccgtgatggtgtttgccgctttgatgattgttttaccacatgattgacacagtgaactctcagtcagcaaaaagtcccttgtatttttgtaccaattgttttttaatgcagcctttgacttctgcttttgtgtttcttcatatttacccttctaaaacttcattttgttagattctggtcaaatgggatcggtgtccttatttgagtgatttttcaagcagcaggagggtaactgccaagaggtcctaattcctcctctgtgggaaaaggctgttttgtaacttctccatgtcttcctcctcggtgtcaccttctgtgtgtcaattctttggcctcctgtttgcttcttctctgtcttcttagtgagaggtggaaagtggggcaaagagttgagaataaattcacagtggaagtgcccctggagttgggtgttgacggatgaataagagcctgctgaatggggaaaggaggttgggagttcagggtctggagaaaggtaagagccagtgggtagagtttatggtgatggaggtcgaaggaaaaaactcagaacagaggctgaaaaatggcagtgcacaactgagtttggctctgacgtataatcttcttggcccttactatgttaagaaagattaagttgacatttaaacatttaaagatttctcccaaaatcacgattttgtgtttctcttgcaaaatcagaagctttgactataccagccccacatggactcacacgtggcatcagctagcggtagctgagtggctgccagccccgtcagcctaggcacgctgtctctgccactccactgaccctgctggcgtattttaccttacttggctccttgattttgcctctctggccctttgtgcatttgagtatttggccttgtctttaaacattacctcactgcggttcttaaaatctagcatgcatcaggatcacctggaggctttattaaatgcagactgctgggccccagccccacagtttccgattcagtaggtttaaggtggggcctgagaacctgcatttctagcatattcccaggtgatactcatgcttctggtctggggaccatacatggagaatgactcctagtccaacctcctcatttcacagatgaggaaactgaggctcatgtttggcaaatgcagagtctggctccaaactcaggttttcacctccagctccaggactaaagccactatcccatgtgctgcaccaggtgggagggtcagtctgcatcccacttgctctcctgctccccgctaaccgtttctgaaactgggtattgaagcccattccatttccagcctcattctgttttcttcagcttccttaacaatagccatccattattctatgctctgatgcctgtggaatttaattacttgccccggccgtgatgtgaatttgatggttggaagctgtggtgttgggaggaagcactaatgaggaaagactctttgcagagaagcgaggccatgtggggggcttgtgtttgaaagcagccattcactgtgtggcaacaaggacttggtcttgagtgagttttctcgttcccgcctcgaagatgtccatcgcattttataaataaatcagggctttttgtgttcaataattgccttgctttgtaaccgagatcaaaagcacccactggccttggattcaaagccaagtttattttttattttttggttgcatgagagagtggagtgagtgtttgcatgctggagggtccagctatgaggcctgcatggggaaggaggagggagagagcagagtgggcaccctgccaagggatgaggcgccttcagccaatctccaccgtctcccagggagatgaagtcgcgaacggtcactctgccagtagagcctgctaagccggtcatcatcaggcactcccaactcatttaataaacatatattagcactagcatgacagtaggtaaacaataattatagataacaaacagtgagcaaacgcctgcagtgtgccaggctctgggctaagcattctatacacatttaactcttcaaacctaagatgaagatgctgccattatcccattttacagatgaggaaactgatgccaagaaaggtgaggttagggtttgaatccagatgtgtccaatcccagagcccatactcagtggtaaaggcaggtgccaaagaagatagagtcaggtgcagtggctcacacctgtgatcccagcactttgggaggttgagggggaggatcgcttgagctcagatgtttgagaccagcctggaaaacagggacaccttgtctctacaaaaggtaaattatccaggcgtggtggcatttgcctgtggtcccagctactcgggaggttgaggcaggaggatcatttgagtccaggaagttgaagctgctgtgagctgtgatcactgcattgcactgggtgacagagtgagaccttgtctcaaaaaaattaattaaaacaaagtgaagtagttagataaacgactcagacacaatgtcctcctctccctcaaggagcttccagtgcagtctgaaagcagagacaggtgtgaagcggtaactcattcagatacagcagagagggatggttatcaccacagaagtttgttcagagggagaacttctaacctgggagggggaggtttgggtaaggttagaggtgggggaagcagcatttgaagcgagcctcaaataattaggatctatcaccagggttccctgggaagccagctctgagactgtatttcggtgcaggggtgtatcagggaggatacttgggattccctcctgcagaaaaaaagggaggaaagtaggagttagcaaaccgagaagtcggactgtggtgcagtcttaaggatgctggggagctgggatggcccttcagagttgtcctgagctacagcgaggaggctgagcctttaaaccctcctgttgggtagtcattggatgtgggctccctctaaaagaggctgtgggcttgagcagatgatgcctgtgcagccaaggcagttccaaagcagctgacatctgagggagtccattggcagcactttcctgcagctgggggaatacgttccccaggcccgaaggggatctgagtggtgcgtcacagcgtccacaacagatgtgcagagatttggggaaggtgggagacggaatccacaccaaagcagaggccagtgggaggaaagtctgggtcctggatcacgaagaggtgggtagtctagtgcagtggccaaggctggggccggactctgatttcatctctgttttgccactttcctgctgtgtgagctccacctaatcccttaaactctctcagttttgtcattttcaaagtggagctaataatagcctccatcaaaaggttgttgtaaggactaaaaaatgatatgaaatgtctacctggtacacaataaacaatctataaataatattatagcgattaggccaggcatggtggctcacatctgtaaccccagagctttgggaggccaaggtggaaggattgcttgaggccaggagcttgagaccagcttgggcagcatagcaataccgcatctctacagaaaaattaaaaattagccaggtgtggtggttcatgcctgtagtccaagctacttgcaaggctgaggctggaggattgcttaagcctgggattttggggctgcagtgcgccaagattgtaccactgtactccagcctggacaatagagagagaccctgtctctaatatatatatatgtgtgtgtatgtgtatatatatatatatatatatatatatatatatatatatatatacaaaataatgtaaaaaatatataattagctattatatataatatataataatatattatatattagctattattaggatgattatttggactttgagaagaaatttaatgagaatgagattggagatgggatgaaggaagaattttttcagggcatacaggttaaacaaaggatcagaaataagaaaatatgctcaggaaccactcactgattagttctaaatgatggtggtcttgtctcttcttttataacctctaatttctttttcttgccttattgtcttggctaggaccttcatccagtgccgtgtggagggaagtggcacccttgactcttaaaaggcatgcttctgatttttcatcatttaagacaaaaactcttagcaaattaggaataaataggaactccgcctgataaaaggtattatcaaagccaagagcaagtcacacttgctgctgaagagagttcagcaagatggctgcttaaagattaatatacagaagttaataatgcttctgtgtgccagccacatccaattagaaaatgtcattgaaatgcatacattagaaaacgagaataattgaaaattgatgccattgaggctacaaattagctgcatcccagaagttttgataagtgatgctgtcattgtcattcatatataaatatttcataattttcattatgatttctttgactacaaattattcagaattaggtttgggtttttaaaaaaataatttcaaaggtttttttctaaagccttcttatttttagtttctgaatttattggatcataataagaaaattaagacaataaagatttatttttgttttttgtgttttgttttgtttgtttgtttttttgagatgggtttcactctgttgcccaggctggagtgcagtggtgtgatcatagctcactgcagcctcgaactcctgggctcaagaaatcctcttgccttagcctgctgagtagctgggactgcaggagtatgccaccacaccctgcaattttttttttccagtttttgtacagacagggtctcactttgttgcccaggctggttttgaactcctggcctcaagcaatcctcccatctcagcctcccaaagtgctggaattataggcatgagccactgtacctcgcaaggttatacattttttggtatttgttggaggattggccttatcagatatcaaggcttcctctggagtgatagtcagacattactagagcagggctagacaaactgatcaattggacagaagagagcccagaaagagagccctccataaatggaaacttggtaaacgacagtggtgcattacagatcaaagggaaaaggatgactacttagtaaatggggctgattcaactgattgtccttttcttattatttgtaagagctaattttatatatacataaacatatactttcctcatatggaaaaatataaggcctttaccttagtttacagaaatttattctggaaagcttaaggtgctaaaggtaaaaagcaacacttcaagactttggaaagacaatgtagattacatttaatatttaaaaccttggtgtaggaaaaggctgcttaaagaaaacattagaaagcacaaaccataaaagaaaatattgattaatttcatatataaaaataaaaaatcttccatacaacaataaataaatagaaaatatggccaagacaaggagaagatatttggcatacacagaatcaataaaaggttaacacccagaatataaaatcagctcttacaaattaataagaaaaggaaaaacaacccagtagaaacaggtaagtgataaaaattgataagccacagaaagtgaaatttaggccggatatggtctgggattacaggtgcggctcacacctgtaatctcagcacttcgggaggctgaggtgggaggattgcttgaggccaggagttgaagacaagcctgggcaatatagggagaccccaactctacagataataatgttaaaaaaattagccaggtgtggtggtgtgtgcttgtggtctcagctactcaggaggctgaggtgggaggatctcctgagcccaggaggttgaggctgcagtgagctatgattacactactgcactccagcctgggcaaccgagcaagaccctgcctaagaaaaaaaattaaaaagtgaaacttcaatggtcagtgatataagaaaagatgctcacaattactggtaatcaggaaaaggtaaaataaaacaaaatgagatacaatctgactcccagttggtaggtaaaacaatcctaagtgctggcaagaatgtggagcctcaggaccctcatgcgttcccaggaaacatgtaaataagtccagctccttgagagaacaatcaggcagtatctagtaacagtgctggaaggggtatggaccttttgacccaacaattttacttctaaatataacccaaagatattctagcgtatctgctcacacacaaaactgtatgagaatgtttgctgcagtggtgtttctaatagagaaacagagaaataacctaaatgtccatcgctagggaaatggttaaataggttgtgggtagttgcaccatggaatcttatacaatagtgaagaggagctagatctacaagtatcaatgtgaataaagcttgaaaacttaatgttgggtgaaaaaagtaaggtacagtatgatatttttataaaacttggaacacagatgaatagtttatatggttcatatggttagacacctggctgaaataaagctatgcaaatgtagaatgtgtaagaatacacagcagtgtcagaattataattgaggaaagagggaggaaggaaggagaccaagaacatttctagtgtatctataacattttgcttcctaaaaataattttgaagcaaaaataacaaaattttgttatctaatttgagtgatgtgttcctgggtgtttgttattgttcgctctccttttctgcatgttttagatgttggaaaatggaaattaaaggtaaaaataaggaaagtcaggttggagacaggtcaaggaagcctttgggtgtcagagtgagaagctgggatttattttctagacattagagatccattgaaggttcttgaatggggagtgaaatgagcagagacaagttgaaggatgattaatttgatatggtatgtttaatggctttgaaaagagattttggatggacggtgcatgttattatacatatacacttgtatacatattagtggtgaaagataatggggactggatcagggagattgataaaggaatgggaaggaaggaaaggaaagatggatgaatggatgagtgggttgatggatggatggatggatgaatggatggatgagtggatgagtgggttgatgggtatatggatggatgaatgaacggatggatgagtggatgagtgggttgatgggtagatggatggatgaaagaaaggatggatgaatgcatgggtaggttgatggatagatgggtggatggataaatggatgggtgggtgagtatatgagtggatgggcaaatgggtggagaggtggatagatgggtgaatacataggtagagacatttttgaaatgccaatgcaaacctcatttacatcctgtccacaaataattcaagtgaaacagaagatcaggttataaaatgacaaagaggttaaagtgatgtctcaagtcagtgattcagcagtaataagtgatcaataatgttttgaaaccaacaaataagcctaacaacatccatagtcatcctgaagataatgtagagagggagaaagcctctcaaaactgagcagcttcaggttttcatagatactggcttttcaggaagacagccctgtcacttcccatgacatgcatgcaggctctcatcttaccctcaaccatagttcctgatctgtgagtgactcttagagagagagagagagagagaatatgtatataaaacatcgacatcagggacacaatcaagaaagattactcctgagtatgtgaatatgttctgggcccacagagattcagcccaactttccacaccatccccagctacctcgacttggaagccagggtgggacaggattgagtaacagatgacaggagattctgcaaaatggcacggggcactgtatgttatctgacatttatgatgatctaaagcagagccttgtaaatatcaatatgctttctatactaaggcagaagagttttcatgttttagaattatttttagatgtttagggaaagaagaccttaaaggtgcttagagagctaactttcccagtggaggcagcttggttgagaatatcacattcactagctctatggccttgggcaaattactcacccttcctgagcctctgtgttctaatcttcaaaataggttcaacaatagtgcctcgaataaagggctgatcttaggcttacatgaggtattgtctcataaagcagttagcattgtgcttggcacgtgctaagacatcaagaaacaataactattattgttattatccacaatggtatgtattataagcacatagtattagtagtaattgtactaagacttattattaataagtattaccattattaataatatttagtattatccgtagagatccagaaactcctagcctgaccatgtcaggtcacttttcataaccattccgaggtatccttggacttcctcaggcctgttacgtaaagcagttctgaaagtgaagctttcagcataaacagggtcccaaagtaagcctgggagtaattgcagggaaaggaaatgctggccacggtgctagactcactgcctccgtgcatgcctgggctcccgggtgtgcatgagtgaggctcaccactgccaagaacgtccaggtggttccaaggccttcctgcttctttgcagtccaatataccagccctggcaacagtaggaagacctaaggactcgaatctgcattcttgaaaaatgagtagatgacaacatttggagttcagcaacaggaggcataaattagtgtgggaagggaaagagaacagggatgagttcaggagcagggaaaggaagaaaatgggaggcagaggggaagaataacaaggatcaggatagagggtgggcaggaacccggctaaggaggatgtttgaaagcagaggttggcgccgggatggagagccgatagcccggttattggcaaccaaagtcctggctaggaatgggagtgagccgttaactgttggagctgctgtgttcaggggtacgtggaccttccagcacaggctggagaagcctgatcctctgagacatgccttttaagcctttgttttggaaataaaaacacaatcactttgggagatggcccgtgcttacatacatcatgtatttaaatagggaacatctgtgggtctcaagttttgtgatttgatgagaaaacaagccagagtgtggagaagaagtgggtaggatctgtcggcatttaggactgaaagagacaaaggattttgttgttgttgttgttgttgttgagttgtatttgtttcctgttgttgtttttgaatcccagaattaggaaaatcatgaaatgtccctaagagtaacccaacatgagaacatctactcaagcaaagagtgagaaaagagagacagggggctggctgacgcagggtttgatgagacaggagaagagaggcccagcacggataactgagagttaacaaaggccacctgtcttactcctgcattacaattttctaaaagattgtttaggatggtgtcattgggagaaatgaaagggcgtatgtgtgtgtgtatgtgtgtgtgtgtgagaggtcttgttcttaaaactcaacattttaagatggtattttttttttagacatagagaatgacattagctctggaaatgacccgtctttgagttattttgagggagatagacacacgccctttaaaaacagagcttttcaggctgggcatggtggctcatgcctgtaatcccagctctttgggaggttgaggcgggtggatcacctgaggtcaggagttcaagaccagcctggccaacatggtgaaaacctgtctctactaaaaatacaaaaattagctaggtgtggtggtgcatgccagtaatcccagctacttgggaggctgaggcaggagaatcccttgaacccaagagatggaggttgcagtgagctgagattgcaccactgcactccagcctgggtgacaaagcaagacaccatctcacaaaaacaacaacaaaagaaatagagcttttcaaatgtaactcataaagtcttaggacctactgtgaggtttttgagagttttccctaaaaagcatgatgatccctgcattgaaaacaaaatcaaatcatacagagcaagattttcatggcaaaggaaatgatttaattcagagctgtgtatgtcaagaacttcatcagctgatttcatcttgacatgaattaatgttcacttgattttttttttttgtgcaaagaaataagggttatgggtgaccatcctttactcctctctagtttcctactgctctgcacaatgctgagctcatccacaggcatttacagagctccttttgtatgcaggtcttcgtaatcggcattgtgggaaactctttaaagccagggatctggtctttagggtgcgtgtgctctaattgttgggaaattagtccttttgcaggaactctttgaaagctgatgcttggtggagcgttttcagaaggccgtctcattcagtggtcatttcggtatctacagactgacataagcatggattacgttagtattttttcaaataagcaaaaatgaaaatgtatgggatcctgtaaactgatgaagtccagaggtgaatcttgtttaggcaccactagatctagggacggaaaggctctggctgtctgccgtagtgggcctggtactgcaggcagtgcaagactcctgaagacccttttagcaacccccggggagaaatgatctgagagtgtggttatgagaaacgtcccaaagaagattcttcattggcttagcctggaacacgtgtttgtctctgatctgatcactgaaggcaaggagctggagcctggtcagaccctgcccctgcctgatgatcttgtgtggccaggcaaacaggagcctgttccaccaacatctcatcttctgttagtagaaggaggaagggagaagcaagacatgaccatgtctggtttattcctagcagagcaggtgtagctaaagaggatgagatctgcttgtaagttggggcaaggcccagagatgcagatttctgcacaggtgataagaaagtgcattggacaggtaggtggtgtctggagggcagggcctcctttgtactttccttgtggtctggactcatctccattacagcattgtgatgactttttttcactgtgtgtctgcatcttgaactaggtcctaaggaagcagattatagtaagttgctatgagtgccaactttggagtcagaccaatcaaaaagatgaatcttggctctgccactttctagctgtgcaaccttggggaagttgctcagccattctgagcctccagccccccccccccccccgcccaccccacttatctgtcaagtgggaatacttatagcagttcctgtaaatatttaaattagataacacatgggagtgactttggatagtattcaacaaatggggccaggcaccgtgactcatacctgtaatcccagcactttgggaggcttgagagcagggaccgtgtctcattcagctttgtgtcgttagtgcctagtttaggctggtatatactgggtagtcaataaacacccgtgtaaatggaatcaaagctagtgaaacatggaccacagagggataagaggccacccctttcctgagagacctcaccagtgtctggtcataaactaaaatacatctgtgggctgtacggaggacatggctgggtggagggagaagctgggcactgtggtcacctggaccagcagtagcacaagcccgtaccgaaggggccaccgtacttgaaacaggggctcggcattgctggatcttctagaattaccagagacgctgaaaatcaggacttgtgcaggaaatttcctgagttttcaacactgggaaagcatccagatgctctgaaagcactgaatggccaaacaaaacatgtctgcaggccagagaagctgccacttggaagccttgttccaaggtactatttctcaattgggcaggagagggggagttttatcccccagggaacacctggcaatgtctggaggtaattttggttgtcacactgggggttgggggtagggaatgctactggcctctcacgggtggaggccagtgatgctcctaaacatcctatacacaggacagagaatgcctggccctaagggagctgaactggctttagctacaggcaaagaggcaaaggaaccaggcagggctggggttccctgcattcatgatggctggctcttgagattggtcagcctcattttactggcttatttgagcgtgaaagacagggctgtgctccgtcaatctggaggagccatagctgccatggctgagccctccttggccccatgtcaccgttttccactgtccacacactccctgtgcatgaaggaagcagcctgccaccctgacccctgcaggcatgaaagtagtgtggaaaatgtgggcagtgagagcgaatacattatcacttaggttcctaagggctgggtatggtgtcgctggagatcacagggtttgggtttcctgttcctggtgaaaagtttggtttgagttcctcattcagtagtttctggaaccatagttgagaatatttcccttcccaatcaaccccagccaaaaatagaaagaacgcctttgagtcttgtgcaattgagtatttgctgagcatttactctgtggccagtccagggcttgatactggggagttggtgagcagagaggcctgggctggttccctctggcggcttacagtcctggggaagagatacaagaacccgatctccagctcctcccattcatcccaccctccattcactggtgtcttcaccttcctgaagcgtagccctggtcatcttaaacttctgctcaacaaccctcagtagttcccagtcctgctctgaaggaagcctgtactctatccgcctctgtgatctgacccaacctctgtctcaggcttatctcctgctcacctgtggccgagcttctctcttcatgaaccagtcttttcaccatccccagtctccgtgcctcctgcctagaaggctgtctccagccattcatgcaagctaagaaggccttggaagtatccccttaatcctcttcatcacttcatctcacatcacaccatcctttactcttgtatggccctttccgcctcctgccttagaattgtgttcttgactctaccccagcaaactgggagattcttaagggaaaagttactaaaaaatttgattttatattcccttctctgggcaacttcctagccttgtccttggcatctcgtgggtgttgattcagcctgtactgctatttccccgggacttcatctgtgcctcatatggtgctaggtgctgccatgtgtgttatctcttttcatgctcacagggactccatgagacccatgacatcatctcacttttacagataaggaaactaagtcttagaggaactgtcacttcattcgttcatagattcattcagcaaacacatatatatacacacacacatataaatatatatacacacatatatacacatatacatataatgtgtattttatatgtatatgtatgttacatatgcatacataatatacgtatatgtatatttactcttgtatggccctttccgcctcctgccttagaattgtgttcttgactctaccccagcaaactgggagattcttaagggaagagttactaaaaaattcaattttatattcccttctctgggcaacttcctagccttgtccataatatacatatgtgtatagtatgtatacatatgtactatacctatatgtatatgtatattatatgtatatgtaatacatatatacatataaaatacatattatatgtatatgtaatacatatatacatataaaatacatattatatgtatatgtgtagatgtgtgtgtatatatgtatacatatataatatacagatacatataatatgtatttcatatatgtatatgtgggtgtatatatgtgtatatttatgtagatatgtgtgtacctatatatatacacacacacatatacacacccacatatatacacacatacgtatatatggtttttttttttttttttttttgaaacagtctcattctgtcacccaggctggaatgcagtggcacaatctcagctccctgcaacccctacctaccaggcttaaatgatcttcccaactcagcctcccttgggactacaggtgtgtgccaccacacttggctaattttttgtatgtttgatagagacagggtttcaccatgttgcccaggctggtctcgaatcctgggctcaggtcatctgcctgcctcagtctctcaaagtgctgggattacaggtgcgagccaccatgcctggccaagcaaacatatttaatgagcacgtactctgtggcagactctgttgcattgcagaaatgcaggaatagggaaataagatattgcagattgggtcccccaggaagcagaccctgggacatctgaatttagcttctaggggaacgatgaaggagtgttctctggatcagccacttgggaaggcaggtgaggcagcagggtaaggtcgagctgtgatgcaggctgccttactagaagtcctagccagcctggtggggagcttttttaaaatttttattttcagttcagaggtacatgtacaggatgtacaggtttgttacataggtaaacgtgtgtcatgggagtttgttataccaattattttatcatctaggtttttagccttgtatccattagttatatttcctgatcctctccctcctcccaccatccatcctccgataggccccagtgtgtgtttttccctgtatgtatcaatgtgttttcattatttagctcccacttataagtaagaatatgtggtatttggttttctgttactgtgttagtttgctaagtataatggcttccagcttcattcatatctgtaaaggacatgatttcattcttttttatggctgcatagtattccatggtatatatgtaccatattttctttttctaatctatcattgatcggtatttgggttgattccaagtctttgctattgtgaatagtgatgcaatgaacatacacatgcatgtgtctttatagtagaacaatttatatttcctttgggtatatacccagtaatgggattgctgggtcaaatggtatttttcactttagatctttgaggaattgccacactgtcttccacaatggttgaactaatttacactcccaccaacagtgtagaagcagggagttctgaagatggaatgactcctcagagctgtctgagttgagacaggaagaggctgacctctctgccccacaatgatcagtctttgggcaaggactacactgagaaggaggtgtatacttggtgtcattgtgtcctctgaggccatccctgtagggtgctctcagctgagggctgtctgcctgagcattcattgccagagagaaagtctctttgccctcatggggctgacattgaagcaagggaagcaaatgataaatgaatgaacaaataaacaaacaagatcatttacaagtgcagagaagacataacaaggtgctcattttacagtcaggaaagctaagatgccaataggttgaatgactgaaagccctgcctccaaaccaggtctctgtggcccccaaagtcatcccctctgctgcccaacaggcctgtgctagtcgtgtagagttagcttgactcaaaattcaagctaaggaactggggcttgattctgtagacaatgaggaggctttggaggaataggataagtccatttccaggaaatttcactggcacaggcctgcagaatggactgtaaactcaaagacacaagagctaaggattttggtaagaggtgcctcttaacaaagtgaatctgggtctgtggtgatgatatgcttgctacgggaactggtagtggaaaataggactgaatcccttaggatgcttttggctgcaagtaacagaaaaccccagctgaaagtgacttgatcaataaagctacagaagtggaagttcactgggaggcaggctgtgggtcttcagtccaatcaattgtccagaaggtcattaatcctaagtctgcttcctcttttggttctaagatgcctgctggtagcaactgggctacatgcatttctttcttttttctttttttgccagcactcagtagaaaagctaaaactttccatttgaccacagaagtctttctcttccatccagttaagtcacatactcacctctggactaataacacacaccagaatccaccgtcttgagttgggatggcctccagcttcccttgaagaactctcctggaggaatgaattcctgggcaaattcatggctctcttaggaaataggaagggcaagaatggatattgggaggtgggggaggccagcttgcctgctactcacaacaaataattggaaagtttgcaggcaggacccagtaacagattggattgagaaagacagattaaacaaagtatcaaatagaactcctaggtatccagttgacaagcccaggaagatactatcgcattgaccaaaattgaagggatgggggaacagttcacctttggataatttgagtttgcggggatgaggggacatctagaccatactgttttgcagcagctaaggatacaggtctttgagcttgggctgaaggtctcctgggcaggacagaacccaggagagaggcctgggagatgatgacatggcttctggtcaccaagaagtgggaactggagtcaggagcgtgtgagggagccagctgcagcagggaccaagaagggaaggctggagggaattctgaagacaggactcttcccagcagaactgcctctaggatggggtccctgcccatatgcacagtgacagcacacaaggatgttcacagcatcaatgtttgagataataagatgctggaggcaatgtaaatatccatccctaaggagctggctaaattaattatgatgcctctggtatatggaatcccaagcagctgtgcaaaaaaggggatataaaagttacatgatggaaaaatttctcagagatatcgttaagtgaaaagatgcaaaggtgtgtatgatatgctcccatttgtgttaagagagaacatatgatatgcaaatatatgtttgtttattcatagattatttctggaaagtatcagaagaaattttttgtagcagttgcctctggacaaggaggagccttgggagacttattctttccattttacctgctggctgttagaatttctttaaccatgtgcctttattacctatgtaaaaagatcataaaaataaacacataagaaatagggtcttgggtgtcaaaggtgttggggagtttgaggaccaagaggaggccactggagagtgtcagagaatctggagtcagcagtgatggggaaacatcagggggaggggccacaggggaaactgaggcactgattgttcacttgagagagtcatggagaataggaaatggggatagctaattgggttcatagagcaccagtacagaaatcacaggacactgttgaaggtccccagtgagctctgcacagaaggttctccacaccctctcgaagctggagggaggtgtaaataggtctctggaattgcctccgaggtttctgctgtctgttaaggggtctggcacaagcagagaccaccttcagaggggtgattcttggcaagccaggcccggaagctgagagaaagggctgtggggggtgaggagaaggagcctgagaaggcatcattctgatattaagccttcatgagctaccactggattcagaggcttctcacctctgcaagggtgagaggaaggctgttctttgcccattagcagctggtccagctatgaggctgaaggaactgggaggaagagcaggaggctgcagctgctcagggagccaagatcacggctcccattttcgatacagaaactcaacacgatggtcttggcaaacagggagaatgtcttggtccttttaggtgtctataacaaaataccgtagactgggtgacttataaacaacagaaatgtatttctcacagttctagaggctgggaagtctaagagcaagacactgacagatttgatgtctggtgagagcttgcttcctggttcatagagggcaatctcttgctgtgtcttcacatggtggaaggggcaaggtagctgtcttgggtctctttaagggcattgtattagtctgttcttacattgctgtaaaggaatacctgaggccgggtaatttgtaaagaaaagaggtttaattggctcacagttctgcaggctgtacaggaagcatagcacaggcatctgctcctggtgagatctcaggaagcttccaatcatggtagaaggtgagggtggagcaggcatttcacaaggcaggagtgggagcaacagagagagagtgagaggcgcaggtgccacacacttcagaatacaccaaggggatgtcactgagccgttcacccccatgatgcaaacatctcctgccaggctctgcctccaatgctgagaattacatttcagcatgagatttggcaggaacagaggttcaaaccatatcaggcactaatcccattcctgagggctccacccttatgacctaatcacctcccaaagacgtcacctcctaataccatcacattgggggttaggatttcaaaataggaattttgagggagacacaaacattcagattatagcagagaatatttaccaaaatcataatcacaatcataaataaaataacaaagaattctagactcttcaagctgcatggaacctagagataattttctcattgttttctgaattgtgtccttaaatatcatgaaagccacttcatggaaataggactgtggtcaatgaaactacagactatacctccttcttagaaagtctccatgcaaggaaggacatgaaaggcactgagaagtcctgcattaagaaaacttgtctacctttgttcaattagctttttctcaaatgcatgtagtcttagaagcccctgctccccctttttagcatagcatctagcagtgatcttcagaccatgctttggaaagtattgttttagtttaagctttttatttgataggtgaggtagctgaggctcaaagggggaagtgattctccaaggccacacagccaacagtggaaatgagaagctagatcttttgccttgtgccccagaggcctttctgccaacctgtacttctcctgttcctcattggaagagacatcttgagagtgtggacttgcgactgtgtcaggatctaggcaatggtaagatgagattaggcagaccaggggaccagcactggggagggctgagctgaaatttggagtcaaactaaggttagggcatctgttgtaaccagtccttgaaagctaggaaggcgatgtccaagtgggtgccagctgctgattctcagtcaaggaagacaagccttcaggaaacatcttctggagcagtggtccccaaccttttttgcaccagggaccagttttgtggaagacaatttttccatggaccagggtggggcgatggtttcgggatgattgaagcacattatatttattgtgtatttcatttctgtattattgcattgtaatatataatgaaataattatgcaactcactgtaatgtagaatcagtttgagccctgagccctgagcttgttttcctgcaactacatggtttcatctgggggtgatgggagacagtgacagatcatcctgcattagattttcataaggagcgtgcaacctagatcccccacatgcgcagttcacaccagggttcgaggacgtatgagaatctaatgccaccactgatctgacaggagctcagatggtaatgcccgctcacccaccgctcacctcctgctgtgtggcctggttcttagtgggccatggactgatctgtggcctggaggctggggactcatattctggaggacctgagatttttcctggaggacttgagaattatcatttactctcaagaggaattgggatgccaaatcattgtttctcaaagtgtgttctatggaaccccactctgtagccattcatgaggattgtgcaaggagctcagaccctggtcataccagcttagtacacgtagaattaaagaaaaattctgtggggcttccccacatctttaatatgctactgtcactgtgagtcactgtggtagggaaatgatgtgtagggttctccaactcatatgatcagggaatcccatctgcaaggaacctctctctgtgggtttgtttcatggacatagttgaggaatttatgttgttgtagatcaatgaaatttatgctgatttctgtaccccttctgaccccacccgaaacattcctgacctttcgcttttgaaaagagattggtaaatgtagccagcaaacttctcccccgctgacatttgttcttccacattccagagcaaggagattggcctgcagatgcacgaggagctcctgaaggtgaccaatgagctctacacagtaagttctgcccaggctcactgctgttttgggattgggtctctgtcttcatcaccagagctggagggaagcaaaacagaggtctggaatgaccccaggccttttttgctgcgttttatgctgagtgacagtgggtcatcgtgtcaggatgtaatgactcacagccccagcttctgattctgtacatctggggcagggcctgggcttgtctagtttgtcaaaattcacgagagattcaaacgacctgccgctgtggggcgtgttacctgcaagaacagagggcacaaagtcaaggccgggggagtgtgagtgtgaaggctcctgaaggcagggatgtgagttttggagtgaggcagcacaggctccagcagaggcccctccttaccaactgtaggaccataggcaggtgggcagtttgtctgggtctcagtctgtgcatctgcaaaatggagcacggttccgaggatcacgggaggtcatggggtgagcctgcattgccatctccaaggcatagtttcataacatcacagtgtggtccacggctgactttgttacctgcttggagtcaacatctaactgtgcttgagatgagttttagaatccaagaaggtgagcaaatggggacacaaacacatgaggtgatgatgcaggaactttcagactgtgctttgaggagcctacggcttcctcaagaggaatgtggggaccccatggagagatatggggagtggggtgggtagacccagcaggtagagctccaggcccctcaatcctacccaatcagaacagagaagaatggttatgttttaaatagataggtgccctatatagcatttcatgaaaagtgtgtttgtttgtgtgttggggagaatctgctggtaaaattgtatttgaaaatccctggtatgaggggaaagaacagcagtctgtgagaagccccttctgtttggttttattatctttctgtgtttatatcctgtgtggccagcaggtggtaaattcctcagaggcactgagagcctttgcgggagggcctggacctcaggtcagaaagcctgcctcagatcccaacaagctacggaactctaggcaaggcattttttttcctgggcctcagtctcccaatcagtaaaacggggctgagagttcttagataaaagttgaaacttttaattctgtgattccaaattaagaagcaaaacttgagttgtgggtagtttttagttgagtcattcttagggtaaaggaagaattgctgcttgagaatgcatattgctttgcatcagctggtcactggggggcagaacagcctgctgggttaaggcacagattttgaagccagagatctgggttcaaatccaggtgttaagtagaaatactagtacctgcttagtgcacgtccctgtgagaattcgaggagatcctgtatgcaatggatgcttagaacatagagaaaaaaagagcattctgtaccagaagttctgagtgtcactatcatcatcatcactatcattggctcctccttgatgggtgtgaggtaggctgttgtacatactcacggtggggggaagggtggtgataaataatgcaagcctggtaaaccgaatgggattgtcgtgctcagaattctgcagcgagtttggctagaccaggtgctccccagtctaggtcctttttatgttcctcaggctccactttgaatggatcactttcctccacagtgtcaaaacaacttagccccaatgtcctgggacccccccattcattcccacctaggtctcttacttttgctgtgacctccagcggggctcctcttcttggtgccctctatttacaccaaataccttccccctctgctgctttttccctgcaatccctgctgtctatacctacctgttagtgtcatgctcatttttcaaactcagaccaaacctcgccaccttcagaatgttattacctctcggcttcaagttcctatggcagatgtaccaaaatctcttgtatctttattgtctatatcccgtctcccaacatgttggagtataaactccctgggagtcaggtcttggctgagaaacactgcatgaaaggcccaaaggctccatttgaacccagctgtgtggccttgggcaagtcccttcacttgtcagtttcacctgtgacaaacagggatggtcacctttctgtggtttgtagactggacaaggccaggtgatggtcagagatcaggaggacagtggcatctctctgtgtccttcaaggtcccagtgcccagcacagtggcctgaatccagcaggtgctccatgcacacctccctgtgctggctgcagggcaggatggctggacagaaatgccgctggtattggagacacaggccaggcagggtggctgaggccccaacaggacaagccatgccttgccatttccacagcagcctggtgagggtcaccagaagctagtggaggaagaagggtcctagctctctcctttggaagagtgggatcctcatggtgccagcacaccccttgtgaagatcatttgttgactgcacactgagtcttcagtagttactcagaaactcagttaaattcgatcatttgttgcctgcacactgagtctttagtagttactcagaaactcagttaaattcaagcatttggggccacatgctgtgggcccagagctgcagtagggcacagtgggggatcatgaatattcagagtctgtctctgtcagagtcttgtacatccttggtgcttccagggtgctcactgaagcaaaggagggaggagggagggatgaatacatgaaagaaactggtcttactcctaaggagtttggaatctgggcagagagataagagtagtgtgtgaaccactggggcttgtcggagggggagggggtgggggactgggggagcgatagcattacgagatatacctaatgtaaatgacgagttgatgggtgcagcaaaccaacatggcacatgtatacctacgtaacaaacctgcacgttgtgcatatgtaccctagaatttaaagtataataataataataatataaaaagagtagtgtgtgaactgttgctacaacacaagtcagagcctagtatgtgctggacatgtgggctcacagaggaggtacctctgggcttggctgtgtaactcgcctgtgagctctgtggggctggactttgttccccacagtgtgcccagagcccctggccaaccatgcacacacataggaggagatgggtgtgtattagttgagggagatgcacatgtgtgagagatgggttgagaggaggagggagggagggagggagaacaagaaggaaaaagattcagaaaagtgggctactgtgttccagggtgagctttgagcttggtgcctttggatgggtaggaattaaagaagcagagggaatgagaggaagagagaaggagttctcaacagggaaggcaatgcaggatcacagcagtgcacactgatcacagacagatctggatttgaattcctgctgcaccacttacgagcttggccaaatcaattaacctcgttggctctcctctttgttgccaaacagggatgatcctaacatctgtagccacttcatgagtgcttatgatgcatctcactctgtattaggtattttatatatattatttaattaacactcttacatttttacagataaagaaatggaggcacagagaagtgacttatttaaagcctttgtttcagctatcagttgctgtgtaacaaactacctcgaaactctgtgacttagaacaaccacaattttctgtgctcgtgattctgtgggtcagcaatttgggcagggttcaactggggccactcctgtggctgcagttttctggtcaattaaaaaaagaaaaagagcccaaagtgagcaaatcccaatgtgcaagcacttttcaagcttctgcttgtgtcatatttgctaatatcccattggccaaagcaagttacacagccaagcccagagtcctgggttagaaaagcaaggccccctccccttacagagtcacaatgcaaagggccatgcctgcagccatgccagtaatgatcacaatcctctttgcaaacagttcactccagccacccagctgctggcggcactatgtgccccaaattcatgcttcattgctagggatttcttttgagcactttctagttaccatgcctggttatacaagtctacagtccccctcctccctcagccctagggtcattaccacagtcactgaggaacaaataatgcagagaaaggattttccagtaaactccactttttttcttcttaaagttctgtaagggaggtggtggtggtctgttccgggggtcctacagggtataatgatggtggagataaatgctaaaggccacccatcacttgctttagagaaaaggcttgtctctatctggggctaggaaggatgcagaggagactgcaaggccaggcattttgttcattcatttattcattcactcactcaataagcctagtccttatcacccagtccttatctgctcagcccttagcaccttgaggcaccctcctctttaaaacatgctagcatgggtgtttatgcacatatgtgcgcgcgcacacacacacacacacttgcatacatgcatgtgcagtttgacatgcaccacacactagcacatatgcacattcacgtgcttgtatgtacatacacatatatgcaagcgtgcgcacacatatatcccactccacttcttttccctcgaactcccatcagcccaacacaatatagttcttgttcatgtattggcctgggagaaaaaaagggcagaggtaaagaacgtggaccagtatggcaatccttctagaagaggcaaatcaaaacaaaacaactcacaaactgtaagccccactgtgttttcactgttcggctaaaaatgtgttcagattttcaatatatttctatattatgaaatgcatgtgtgtcagtaactagtgaacgtccagtgtccccccacctgtctcttcctctgtgttcagcagctctgctccaaactgtgggctggccttccaagcccagggctgcaggagaggcccagtgactttgttctttgccatgtggggagggcctgaggagtgtccattcatacccagtagcagctggtcacaggtagaccctaactggagccatgaatcactctacctttgacttgttcaagccttgattgattgtgtatgggctcagggatgtgacatcaactctgggccaacaggcaaatcttggcaaaggtgtctccctcctcatgacttccctcagagatggggatggtggagagagctgagactgggagcccaggagcctgagttctggtcccagctccaccctgggctcactgcgtgtctttctaggatgacattcaggtacagccccacagcttcatcctatctttgggccctctgtcatttactgaatatttttctttaagttgacctcccctccctttttaagttcccccagtgttagttaattagtggaaagcagccctgcgtgctggaagagcacaggttttagagtcagctggacctaacttgaaggccctgccacacaaactccctgagcccagtccctccctggaacatggggctgctgccagttcatttgtctggattattctggggagagtgattgtcatagagtatagcccagtgcctagcaaacctgagtcctgagtcattgtgtcttttatgaaagaatgaggcataaatatttttcctacatagtttggaatctttcttctccattccccatctccactgggccagccagagccctaagaatgtttcgctggaaaacgtgcagccacctcctccttcgtttcccattctccgggcctgctctctgtgatgctggctccatacttgagctggatgactttcctttaaaaaaattgtttaatatttaaatttagaaatagaagatacatacacttggttaaaaaaataagacagtaattaaacaataaaagaaggtacccaggaagaagcatgtctcctgactctttctccatccccgtataatctcagttactaggttattagtgtccagttagccatgtctccttccagagaccttttagccatcaatcagcacacacgtttgggcatatcccacacattcctgttttatgcaagtggtgacaactgtacttactattctgcatcttgctttgcgttcataggtatattttggagattgtttcatctcaagaataactagagcctccaatcatgtacagtgcttgttgaaggccaggggctggtctaaatgctttacatgtaccgatccatttcatcctcatcgtaaccctttgaggtaggtggcattatgaccacgcccgtcttagggatgagaaatctgaggcacagagagcccaggtggccagctcagggttgcccagaggggaaacagcagaacctgctccagactccgagtgcttaagcgctcccctacactagtgatataaatacattaaactatttatatgactatatagaaactacttatctgggctgggcttggctcacgcctgtaatcccggcactttgggaggccaagtcaggcagatcgcttgagcctaggagttcaagaccagcctgggcaacgtggcaaaaccctctctctacaaaaaatacaaaaaattagcaaggcatgttagcgggtacctatagtcgcagctacccgggaggttgaggtgggaggattacctgagcttgggaggtgaagactgcagtgagctgtgattgcaccactgcactccagcctgggggacagagtaagaccccgtcttaaaaagaattaaaatttaaagttaaaaaataaactacgaacctgcatttattgtggaaggaaatgatacttcacattagcagatgaaacacagtttggtataaatagaagcgttctgttagttaagtgaaaatcaagcagtgttgtatattcaagcttgtgcctgccagagcagcaggcgagaagctttgaagatgtgtgggcacgactgttttttcctcctgatgtaatcaaaggatcctcagagagctgaaaggggtgaagaacagtacagtaaacaatgcaagaagatacacagagagaagcatatctcctgactcttcctccagccctatgtcacctcggttgctgtgttactagtgtccagtttggcagtgtttccttcccatgacaccgaaagtcaccttgctaacacaagtggcaacactgacccagtgccagatagtggggctctgacactcggtttcccccgtctgtgggatgaaggtgtggagtttgaggaatactgaggctcctgccgggcattgatcttcatgccactgtgccctggaagggagaccagggtcctggctcagacttagggcagggcagctctgcggggctgtcacagcctgccagccagggtgtgtgcacagtgtcatccagggacggaactggtcctaagcagaatggaagaggtttccctctaggtaaccttcccttctctttctgctgtcctgcccagacacccattcactaagaatacatgtattgatcatcagcatatccagaccacgagatgtggctgcacactatgacaggtgccttagtggggatatgacagtgtgtgggaacatggaagagggggtgatgaaatctactgagtatcaggaaggtgccagagaagagatggtatctgatcgacagtggacagttcctgggtgcagagaggggcagaaggagcagcacttagcgcggtgggaagcagcacccgggatgctggagggagcctccgcccagtcagcactgctcctgagtcactgcactgagcctggccggttgggatcaggactgatatgggtagttggggaggctgaaagggaaggaagtctgccttttgcaatttgtttagtggcaagggactggaatctggtgcaaactggcttagataaaaatgacactctgttgaatcacatgaacatgtagctcaggtctaactggatccaggggctcacacactgatttgtctgtctcaccagtacggcgtgtactctgtgaggccagagaccccaactgtcttctatactgtattttgactgtagtgcatttggtatagtacctgacacataaataaatatttgataattgaaggtgtagctgttctccccgccaatatactcactagatcagaggcagtagaactatgcctcccccattttacccttttccctccttccttctcttcctaccttccttccccactctttccaatccatccatccatccatccatccatccatccatccatccatccatccatccacctttgagaatcagtctctctcccacttctggtttgttttcctctgtgtggacttcatgatctggcaggcttctcccatgtggtgacaaaaatggtccctagcactgcaaattctcctcccattagcctctccccaccctccagtggaaagaaaacactcccttcccagtgtttccagtgaagccctagggtagcatctaattggcctagctgagcttcctatggccagatgaacataagtttacggattggccaggccagggtctcatgcccaccccaggattgtggggtgatgtcaaactcccatgaaccacgtgtactgagaatagtggaggggaatttgggggatttcctcaaaataaaattagggggctattcccaaagaaagaagactggatgagtctgggcagagaaaaacaacaggtgtccactgaggaggagtcccttggggagaatgaggaagtggttccattggctggtgctcctgatgttcatacctgacatacctgatgttcttccacctttcagctgctccccagtcctgtttgcctcctgctcccctgggctaatgctcactctgctccctttgtctgggacactccacccccatcccaagccctgctcacccagctaacagctactcttcctgcagtgttcagtttagatgtcacttcctccgggaagccttcctatggtgcctagtacgtccttcatcattgtacttatcccaccatgtgatcatcacttgtgtaattgcctgtatctctactacagtttggatcctatgagggcggcgacctgcatgtcttccacactgtagtattgcctagcatagtacctggcacataatgaactgctcaataaatatttaatgattgatggtacagcaatctccctacttccaagtatgctcagcagaacacaggcaatagaactgtacctccctcattttaccctctctccctgccttcttctcttcctttctcccatctatctacccatccctgcatttatccacccacccacccatctgttcatctgtccatccatccatctacccatccattcagccatattcactgatccactgatcttttgatctgttgatccagccagcccagccagtcattcattcatgcaaatatgtgttgatacttgctgggtaccaggctctgctctggtacagagaatactatcacgaacaagaccctggcctcaggactttgcttctcttttccttcaaggaggtctcagtcatgcactggcctagggtttcacccatacacaaatgctggaagcagtgagccactgtgcccagggacagccctgtctgcagggtggaggaagcacacagggactgcatcattgagaagctgttttctaacaactgatccttatcctgcttcaggtgtccctttatggatgctgtcaacttccagattctgtttgccttcttttgcatttaaatgaggggctgaaagatggtacagataacactttgctgttttcagaatctgaggatcagggaagaggcaaaaggcaatgtgtgcaaagcaaaaggcagtgtgatgaccagaagaggcaatgcttagcggtaaacagacctggcctgcagtcccagctctgcctggctttttgtgtgacattggacagcactcttgctatttcttttctttctttctttctttttttttgagatggagtctcgctctgtcgcccaggctggagtgcagtggcacaatctcggctcactgcaacctctgcctcctgggttcaagctattctcctgcctcagcctcctgagtagctaggagtacaggggcccaccaccacgcctggctgatttttgtatttttagtagagacagggtttcactatgttggccaggctggtctcaaactcctgatcttgtgatctgcccgccttggcctcccaaagggctgggattacaggcatgagccaccgcgcccagcccgctcttgctacttttgagcctccatctcctcaagtgaggggctaggacaccaagatttatggaggaccttttattctgagaacacatgcaactgaacttggtccaagaacagtggtcttaactgacacatccctacgaagtccttccctagactccctgaatagagtctggagggctggaaagtgaatcccttccctggcatcaagtggatgggtacctctgaggggcccttcagacatccccagttcaggaacttggcctcagctgagctcctgcatccacctctgccccttcccagccctgggcacactgctgctggcagttggtcacttgataatttgcagttgacagcactttccccatctacccccttctgatcttcaccaggcggacacggagaggacacacctctccacagctacccagcaagtagtgggagggctgagtctcaaaaccaagtctcccgaattccagtgggctggaggagcctttcacccctgttttacagttgagaaaggggtacaaggaaagcaaaacaaccatgtgttcagtaggcccaggctctggggtcagccaccttggctttgaaccctgactccacttaccagcttttcacctagagaaacttactgacctattctgggccatggttttctcatctgtaaagcagggatcataggatgcctatctcatagggtttttttgagaaataaatgagttaatataggtaaagtgcataaagcaaggcctggcaagtagtaagtgctcaatagatgctagctgctatcattgttgttactgtcatcacactacctcccaggattagggaaaggactcattgaaatgctcctttactagaagggctcctggaaggaggtttgcaaactttgaagcaatagataaggttaaatattatttaatgcatcctggactagcaatattgagctaactgttctagtctattgagctaaggaccattcatgctgaagcccatgtatcaggtaattaaataaaagaaacatctagaggattctgggtacaaatagagtcattttggagaaacttccaggtgaactctttggtggcagctgtctgtcataagtcaccctcggcagtggagttcactgttattcttggaatcaggaatcgagtagatcacagggagtttggccccagggtacttgggttgtcttctccaagcatgggatttttggaatgaagtttagaggctgtctgggaagtttggcctgtcggagggcaggaagagtactctgtggctcaagaagagtagaaaatgatgtaaagggagagaaaataaaaaaagaaaactaggcaaaggatatgtgggaattgagaacacccagctgggctgttgaccttgagagagtggatggatgcatggtgattggacaggaagatctagctgtaaatagaaaggctctcttttcccctgaactacccagcacagatgacagattcgtggcgaggcaagcagactcagaagccaaaatagaaaaaggagatgtagcaggaatcattgaacgcagacggggatgggatccagacatgaaaaacaccagcaatatggtggtgaggcaaagaacccagggttgtctgtggatgtggagggacatgtcgagaagggggaaggtggggtcctggagacagccgcagcaggcgttctcacactttagccacacctattttattttatttcttctttacattccatccatttttgctcatttgtaatctccctaaaactcctagaaacccccttcttgctgatttcatcctctctgtatgccagttccaccaagaccatatccaaataactcaatggactcatttattttatttttattttaagttccaggatacatgtgcaggacacgcaggtttgttacataggtaaacgtgtgccatcgtggtttgctgcacctataggcccatcacctaggcattaagccccacatgcgttagctatttatcctgatgctctccctcccgccgcctcccctgacaggccccagtgtccttttaaccaaggcatgaagatcatcaaaataggcgcctgctttgattatctgcaagtctgcagtcaccccttttggccactagatgtcgagaacgcatcaatatggcacatattctggtccattgagttatttggatgtgatcttggtggaactggcatacacagaggatgaaatcagcaagaagggggttttttggagtcttagggagatcgcaaatgagcaaaaatggacggaacgcagagaagccgtctttccaccaagacccatgaagaaaagttgactgcattttaaatccatgtattgttttccaagtttgggggatttttaggatgaaggaagaagggagaaacatggcataaaaatatattttttttcacattagttaatgttctccagagcttgtaagcatttccaagtgagcatgtttcaggttcttaaaccctgagcccaaatcagggataataatgatgatgatggtggtggtggtggtggtagcatctgatagatacctccatggctcttactatgtggaaggtattgttctcagcactttacagaaattaactcatttagtgctcataacaagcataggaagtaaatttttatcccatttttacagacgaggaagcagaggtcagagaggttgtgtgacttgtccaaggtcacacagctaaggagtgggaccatcaggattcagcccagacacttgtccatattcttaccttccatgatctacaatatatgttgccacattgactcctggccagtggcaaaggcaactttctgaacaatgaatcaatgctgtgatttaatgataaaagtcacagagcctgggcgtggtggctcacgcctgtaatcttaacactttgggaggtcaaggcgggaggatcacctgaggtcaggagatcaagaccagattgaccaacacggtgaaaccccatctctactaaaatataaacattagccgggcattgtggcgggtgcctgtaatctcagctactcaggaggctgaggcaggagaatcacttgaacccaggaggtggaggttgcagtgagccaagatcatgctactgcactccagcctgggcaacaagagtgaaactctgtctcaaaaagaaaaaataaagtcacagaattcctcattctaataaacgcacttcacagcacttcaaatgacaaggaataagattttagggttggccaggaattcattctgagttctctgacttacagggcttggttagataggagcacgtttcattcctgggggaagccttggctctgttagctgttacagtaatccaagccacagaagagaatgaacaaggcccaggagccatggattccagaagtttctttgtttcttagcatagaaagatgatcatacacttggcattgcagaagaaaagtacatttctggttggggaccagtaaaaatgctgttggtatggagcagcccagccagtgttcaggctactaaaagtatgcctgctcagaaaatggtaatgaattaaaaaaattcattaagggctgggtgtggtggttcacacctataataccagcactttgggaggctgaggcaggaggatcacttgagcccaggagtttgagacgagcttggacaacatggcaaaaccccgtctctatttatgaaaaaatgatacagacaatctaggatgatctggtagaaaaagtggtggattaaaagtgagaggccagatttccaatatgattaaatatatatttaccatatgaccctccatcccacgcctgggtatttacctaagaaaaatcaaaatacatgtccacacaaagaaatgtacataagtattcatagcagccttattcaaaaatagctaaaaactataaacatctcaagtagctgtggacatatgactaagtaaacagattgtggcatagccatacaatggaatacttagccataaaaaagaagttctgatatgtacggcaccatcagtgaatctcagaaaagttatgctgaatgaaaagagggctgatccaaaggagtttatattgtatgattccatggaactggattctagaacacacaaaaccaatctacagtgacagaaggcaaatctatgattggggctggggtggggtcagggattggctgcaaagggccatgagggatctttctggtgcagtggaagttctatattttgcttgtggtcctggatacatggatgtaaagtctggcatctctgcactgatactttgcacctccgagcctcagtttccctgtttgtcaaactagaaggttgttggattagatgatgtctagaatttcttctggctcagaaatttcccctgtaataacaatatccattttttttattatggaagtagagtagcaaagtgcaatttgctttataggaattgtttttataggcaaggatgaatttattccagagagcatagaatatctattgggttacttaatattactcattttgggtacagagccatttgcagcccattgtacttcaggaaacagctgagaaaatgatttgtgtgtaagaaggatgtttcccattcaattcccatgggtgtgggaggaggggctttccccgcggcactgggaggagacggagggatgccacagtcactactggcagggctagagaggacagctgagcaagggccaggcttgccttgtcacgtctgacagtccccagatgcttggagctacggttacccttttaaatttcctccttatttatttatttatttatttatttattattattttttaatttcctctttactagcccatgcctggctcttagttagggcttaatgatgttgttgttgatgatgatggtgatggtaatgaccatcatcatcatatccagtcctcagagagtctgtgcaaaagtaaaggaaggcaggtgcccagagtgtgttttgggaccagggcagtggccagctagagtgtagaacttggtatggagccaggagtaacagggagggccgtgctgggccatagctggctgctgatttcccctacttgtgcacccccaggtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaaggtgagtgggggccctgggctgggagcgattggggacagggcacaaaggggagggccatggtcttggcggacagccttagccttcccccttattcccctgcatcccagtggggtggtggtgggtaggggggatgggacaatgtagccagcatctcctcttttggagatcggtgtcctagtggaagcggagccaggcatgcccgtgctaacactggttaggcctggcttagtgctaaggtcagcaggcagacgaggtgctcaactcacaagaaagctgaactgtgacgagattcacacccagcaagcaccttctcagatgagctggaatcacaaggcattagcgggagcaggggcttgttccagaggccaatttgatggccaagggtaggggcggggggtgaggtgggaactgattgctgaatgtgtctcaacaagagggaccagcacctggaaagctggtgaagggctcattccaaaattgccattgccaattcaaagatgagagagttagaatccctgtgtattgattctggaaaagtcctttagtagggtgtggtgggaggaattctagctttggagtcaaatgagctgggttttgaaaatgccacgtttacaacacctctctgagctgcagttttcaaatctgataggagtggcaaattcgtctcatctctcatgtcaactctgatcaattgcccagagcactgggctgagaattgtgaaactcgaaacagatttagttaaaaacagtgctgtagggctggccacagtggctcatgcctgtaatatcagcactttgggaggccaaggcgggaggatcgtttgagcccaggagttcgagaccagcctgggtaaaatggcaaaattccatctctatttatgaaaaaaaaaaggcaaagaatttgaatagatgttgctcttaaaaaaacatgtatgagtggccaataagtacatgaaaagattgtctgggccaggcatggtggttcacacctgtaatcctaacactttgggaggccaaggtggtcagatagtttgagcccaggagttcgagaccaggttgggcaacatggcagaaccctatctctacaaaaaatagaaaaattaggcaggtgtggtggcatgtgcctgtagtcccagccacttgggaggctgaggtaggaggattacctgagggaggtcaaggctgcagtgagccatgatcacatcactgcactccagcctgggcaacagagtaagaccctgtctcaaaaaaaaaaaaaaaaaaaaaaaaaagattgtctctattattagtgattaaagaaatgcaaatcaaactcagtgaactatcacttcatacccacagggatagctagaattaaaaaggcagactataggaagtattggtgagaatgtggataaattggaatcttcacacactactaaagggaatgtacagtgattctatcactttggaaagcagtctaaatgttaaacatagactaagttaccatgtgactcaacaattttattcctaggtatccacccaagaaaaataaaaacatatgtccattcaaagacttgtacatgaatagcagcattattcttaatagccaaaagatggaaatgactcagatgttcatctgctgatggatggttgaataaaatgtggtatatccatgtgatggaatattattcagccatgaaaaggaatgaagtactgacaaatgctgcaacatggatgaaccttgaaaacagtatgctaaatgaaagaagtcagtcacggaagaccacatattgtgcaactacatttatgaaatgtccagcatagacaaatctatggaaatagaaaatagatgattggtttccaggggctaaagaagaggaaaatggggagtgactgtgaatgggtgcagcatttctttctggggtgatgaaaatattctaaagttagataatgatgatggttgtgtgactctgtgaatacagtaaaaataaataaaaataaaataaaataaccaagcagggaatgataggactacaacatagggagaaggagagaggtagagtgagtgctgactggaagtccagaggccgatttttagttcagagttgtatttttggttcgattagctacttggctcttgggcaagccacttctctccagttctcatttcctcatctataaaatagatgagtttaatgaaaatacctttaacatcctttctaggtataacattttatgagtctatgaagggctaaaaaatggtctcagggtcatggtcatagttgtccactggaaataggccaagaatatcaaaactctctgtggggggtcaggtgcatggctggcgtaggatgtaactgccaggaccctggggaaaagttagagatctctgaagagaattaaaaggatgagaactcactgtggaataggaaggtgtaagaatgtctaggcaaaggagaaaaaccatttatttacagagacctgactttttacacagcaatgggactcatcagtctgaaaggagcaggggacagctctccagcccacttcctctttcctgctccattcccaggctggcttagccaggagcagctccctggggggcaattgggtccctgctgagatgggcggctctggctgccccaccccacctctcccatccagtcatcctccctccctcctgtcctccagtcactgaaaatgactgaaaatgaccttgtgcagggacagttctgggcgctccagacctagcaatgaacaaagcagatcaagtccctaaccccacttattttctaatgggagatcactgacaatcaacaagtaaataaaagggtagaaaaaaatacagtttcaggtggtggaagtgcttattaagaaaagagccgggcaggggtgggcagagggagtgggagaggtagatgagcttgtcatcgaaagccaatctggccttgagaccttgggccaaggctgagggaaccatgagtttgagggccttgagacaggaatgaattttgcctcttaaaggatggaccaaggaggctgagcaaatgagggggagcctgggggaaggtggagcttgagaagtggatgggacaaggccatggagggcttctcaggtgcgagcagcagtttgagacatcactggagggtgctgggtaggggtcttattgattgattgattgagacggagtctccctctgtcacctagacctggagtgcagtggtgcaatctctgcttactgcaacctctgcctcctgggttcaaatgattctcccatctcagccttccaagtagctgggactataggtgcatgccaccacacccagctaatttttgtatttttagtagagatggggttttgccctgttggccaggctggtcttgctctcctaacctcaggtgatatgcctgcctcagcctcccaaagtgttgggattacaggccaacgctcctggccagggatcttatttacaccccaccctagcaaggaccgtcagaggctgctgctcatctagtgtcctcatcggctgtgcaggtgcaaggtgcaggtgtaaggggagctgcctgagtccaggtccagcccttactcatctagcagatggaggtcttccataggtgtggctgtgcagggcttgggtggcaggcagctactataaagaaaaaaaaaaccactgggccgggcatggtggctcacgcctataatcccaacacttgggaggctaaggtgggaggatggcttgaggccaggagttccagatcagcctgggcaacatagtgagaccccaccatctctaaaaaacttgaaaaacaaaaacaaaaactagccaggtgtgatggcatgcatctatagtcccagctactcgggaggctgaggtgggaggattgcttgagtccaggagttaaggctgaagtgagctatgatcacaccactgcactctcacctgggtgacagagcaacaccctgtctcaaaaaaaaaaaaaaaaggaatagaaaatcacaaaccccgtcctcttaaatggcttgctcttacatctactcttttcttcttccagaggcaggccaagtactctgagaacaagctgaaatgcacaaaggcccggaatgactacttgctcaatctggcagccaccaacgcagctataagcaaatactacatccatgatgtctctgatctgatcgatgtgagctccctggggagtctgggactgagcagggcccacaccagggctggcacatgtcactggctgaaggaggggctggtctttgtctttacctgacattctcgggtagccacagctcttttgagccctgctggaggggaagggcagtgatttggggaggtggaaaatgaatgttacctcgtggtgtctattttcacgagtgggacatgggcctctggtggccccagtgcagttggcttgggcagttgtatatccaatggcaacttcccaagtaccctcctggacaccaggtcctttgctgggtttgaggggttcaggggggaaccatacacagttcatgccttgggggatttcccagtgtggtaaaggagatgttattagtaaaatgtttggcgcccctagggccactcagccagacacgtgtacatgcgaaagaaagtagcgaatgagacagacttaattatacagatcagctttgtgtggggaagttatctcgggagaaatcgggcagcttaagcaaatggagaacggaacactgactcccgagtacccgctgtgcaggacacgccacagggacaagcagactgggagaaagaacactgtgagcggtggtgctggggagggcttctgtgtcatctaagtaggagccaggactgtttctctcatgtcctccttcctgcaccgatgggggagctggccctgtccatgtttagtaaaggcttggtatggtcgatggactcttttcctggtgtatcctgtcgggaagtcagggggctcctgcttttcccgtggctccagagggggccccattgtcagcatcgcaaggagagggagctcccaaatggcccaaggccagaccttcctctttcctgcttttcgctttctttttttgccctttcagcccctttattcattcatttaccatatattaattgagcacctgctgttgtctggaacttgaggagcaggagcagtgggttggccctcggggagcttacctcgccaaggacatgttgataggtgattttaatactaagtggcaggggtcacagtgagagaggtagagggaaatgtggacccctggaggaggatcacctgaccagctctgagtggggagaacatcaaggaagctttcctggaggaagtgacctctaaactgaattccgaaagaagggtattccaggcagaggggatgcatgcacaccaccctaaagaagagaaagatgggctcacgcttgtaatctgagcactttgggaggccgaggcgggtagatcacaatgtcacgagttcgagaccagtctggccaacacagtaaatccctgtctctgttaaaaatacaaaaattagctgggcttggtggtgggcacctgtaatctcagctactcgggaggctgaggcaggagaatcgattgaacccgggaggcggaggtagcagtgagccgagatcgtgccactgcactccagcctaagtgacagagctagactccgtctcaaaaaaaaaaaaaaaaaaaaaaagagagagagaaagatggtgaatatagggaacctagttctgctattgcccaaatctcaaccgcaactccccttgaggggcgccgtgaggtttgtgcagtaggattccaaagtgccttggggcctccgggatggaagattcggctgtggaaagggaggtaattgtaagtcactgtggtggccagtgaccgcccctccacatcctggctgtcacccataaccttccgttgttgcctctccccaagtgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtaggcttcctcctggagcccgggcttggggctgcttccctctgttcccccatgtgctccagtacatcatccctggttgcacgtacagaaagtttctatccgacgcctggggtcaagctcctggttcatgggcttccccagctgaggagtttaccactaataccctcatcttgctgtctcaggtgccccccgtgcagaattacaggaccttggcttcccttataacccctcccagctatgtctagaagactccaagggagccccagtctgcacacaggctcatgttctaaccccacatgtgcgggtgaggtccacgggaagcctgggcctcactgtagcctcaacacagccattcaggctggtgcattccaccagggcgctcccttcctccaacactgcaagcctttgatacaccagacgatcgagtttccttcagtgcttgtgctgctcagatccttgttatattctgaataaaacaaacgaaaaacaaatggaaagaaggcccttgtcactggccccaacacagccctactcgttacccaaggcttacaaaatcccttatgcaaatagttccctgagcttgtctgtgtcactgctccctcggggcattgggggaacccactccaacagtgtcccagacccagccagcctctgggtcccagtgaggctcagctgggccacccgtggcacctgctgggaggggaggggcaaggaggcatccgagaagatggcatttgctagaccctctgcatggctctgcccacttacttctgcagggctgcactgctgtgtctgccccatccctctcagtcctcccgatccatcacctggacctgaaaatgctggcctcatggtgaccactggtgaccgtaaactttgggttgtgcaattagtagcaaataactagtacagtccacagagcgctactgtcccttgtgatcctagctgtgttcctggaaggggtgaggtgcacatgcctgccagcagcccagcccacaggtaatactggagtcccacatgaaaggtggaaggcggtggctcacgtctgtaatcccagcacttgggaggccgagatgggtggatcacttgaggtcaggagttcaagaccagcctggccaacatggtgaaaccctgtctctgttaaaaaacaacgacaacaacaacaacaaaaaacaaacaaacaaacagcaaataaacaaaaaatagctgggcatggtggcaggtgcctgtagtcccagctactcgggagactgaggcaggaaaattgcttgaacctgggaggtggaggttgcagtgagccgtgatggcaccactgcattccagcctgggtgacagagtgagaccctgtctcaaaaaaagaaggcagagggagaacagcatttctctgggtgcttcccctcctccagccctcggcccagtcaattgctgggggacgaagagctatgagctgtgagagcacattgtctcacagctgccctgctgcagtgtcattctgcggcacaatgggagtgcgcccctgattgtttcccattcaggttttttcccattggcttctcttaggtggttgctttcttgccacaatttcttgccttgaaattaaccagttagttttgcttaataagattaaattaaggctctttgtaaaccttcacatgcttcccaaatgtagatcatgactgaaaggccacacctggcagtggcaagagtgcggactttgagtaggaagaccccggttctcatctggcattggttgccacggccacttatgagctctgtgaccttgagcaggtcactcaacctttccgagcccctgtttcctggactgtgattgggatgttaatggtagcccctgccctagctccacacaggtgaggagggcacagggcaaccacagatggtggctgttattcctgcaggtctgccaggtcagcgctcagcagcccgtccagacagaactgctcatgcgttatcaccagctgcagtccagactggccaccctcaagatagagaatgaggaggtgagtgagcccctctgccctataagggattttctttggaaggcctggcttgtcccagggagtccacttgtgccacgaagtgcataagaaatgatagttccacttataagatggaatagtacacgatcattaaaaccacacacaccaagaatcattaatagcctggaggaacatttataagatgttaaattgaagaaaaacaaaaggtgggaggctgaggtaagagaattgcttgaacctgggaggcagacgtttcagtgagctgagatcacgccactgcactctagcctggatgacagagtgaggttccatctcaaaacaaacaaacaaacaaacaaacaaacaaaacacaaaaggaaataggactctatgttcagtattgccataactggagtaaactaaagcatatgtatattcctaggcatagaaaaaagactggagggaaatgcttaaatgttattagttgctatgtttgggttgtggggtgataggtgctttctgtttacttctttgtgctttcttctattttctgcaatgaatttctgttttatcattagaaataacagtaggtattttaaattacacaatgaaataaacaacctagggcacactaaatttgtcatggattctgagctccaaggaacaggtcagccttaccaggcccagcctccctcccctgcagctgtggggcataggattctcagcaagtgggtacagatggaaataccagtgcagtggctctattctgatgtggactgaagaggccagatgggaaacatcctattccaacctggactcttcctgcaaggaggatgccaaccaactggaggcccctggagaaaggacaccaggatggagggagtgacactcgaggtcatgggcaggtttattctttaaagtgcagtcatgggggaggtgggaagacacagtcttgatcttcaaatctcaagagttctatcctgggcagagacagcaactttgcttttcatctccacaaaggacagacctaggacaaatgtgagacagattggagctcaggatgatagcaaatcagtgcagtccccagggggaggttgtatggagacaaattatatatttgtttttcaaacctggaaagagacaggagatgaacagagtgttttctttatttatttatgccctacatcttcccccaaaggattttaaattgtttacacggaatagtatgtggatcataatgttaatggaatttaaattggaaatcagggccaaagaaaggagaatgaagccaatgttcttctgtatgagctgctaacgggcttgaatgtgcttaattttgaacctgagcttcctgtcatgctgcgttagaaagaagaattgatttgtgtattcattcaacaatatttattcaagtatttatagagcacatactatgtgccaaacattgttctagatatagagtaaagtgaccaaacacaacgcaccatagcacctcctctccgggagggaatattctagtgagaaaagacaaataatacttgaaactgttgacaaagagagtcaaactctgtaaaatacttgaagagatttattctgagccaaatatgagtgaacaatggcctgtaatacagccctcaggagatcctgaaaacatgtacccaaggtggttgggccacaacttggttttatacattttagggagatgtaaggcatcagtcaatacatgtaagttgtatttggtttggtctggaaaggtgggacaactggaagcaggggctttcaggtcataggcagattcaaagattttctgattgacagttggttgaaagagttaagttattgtctaaagaaaggaatgtctgggttaagataaggggttgtgcagactaaggttttatcatagagatgaagcctcccggttgtaggcttcagaggataggctgtaaatgtttctatcagacttaaagagtctgttctaacagtaattccaaaaaggaggagggtataatgaagtaggtttgccgcccccttcccatcatggcctgaactagtttttcaggttaactttggaatgcccctgactgagaggagaggtccattcagatggctgggggcttagaattttatttttcatttatgaaacacaaaaagaagccaagaaatgaatgagcttggaaaatattagacagtaataggcactgagtgaagatatcggggggaccaatgtcaccaggaggtgacatttaagctgaggtctgagtgaaaagaaacagactttgagtgacaataattttataacaaacactggaggcagtttttccagggactgtttttggaaccagcctccagagcaaagaatctgccttttaggcacagttcagcaaaggggtgttgtaaggtcagggcccgtgggccctgcttgtgcaggcttctggtggtcccacgaaattccagaagaaaaaactggagtcctagctgaacaatgtgtgcctcagcaactgtcttcctggagttttccttttctcagctgggcttttgataggagtccagtagcagatacctggagagtttgttgcacgaagaatggctgcccaccattgtcaactttgtctctatccttctctgaatgaagagaactagagcacatctaatgttgtccctactcaactgaccaccttgcattggaggaacttgttttgagttacataattaggctaagagaaacaaacctagaaacctgggttcctcatttgttgcaacattcctcaaggttctctctggcagaagccatacgataaaatatctttaaattgggcaacctggcttttcatcccagccagctgtgtgattttgggttggtgactaatttgtgttttccacattaatacagtgagaaggattatttttgttctgcctatatcctagggacttcatatggaagaagtaaagtgacagctgggaaagggactttaggtgtcaacggcagtatgagaatacaggatttttgtcaatctgctgtgtttccccaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacagtaagtggcatcctgggcccagaaccacactgtcggccaagccactggcagtgacttttcaggagcaacccaagctactgagaaccagagaaaccacatgggtcaattggatctaagactccatcaccatgcttttaaaattaagttgcctggcttggttttctgaaatgcagaaagtgaattcccaatgggtagcattggcattgatcttgggtgatgattattgaaattttcttgctctagaaaaaaaccagagacagttttattcagtggggtgataagaaaatggctgacagagtcaggtacaagtcccaaggaacaaccttgaaattatgtatatagattatcatgttgaattgtcttaaatttaggtgtgagctttggaaaaaatgccctcaaaaatccaagcaaattgctcttgagttgctagcccttcatgtaaaatcccatgttaattatctttcatttggacagggactgggaggagaaaggagacggggactggggctttagttcaacatgtgtttactgaacatagaatattaggtttgtaagggaccttaaatcttccatgggatgcttgagtcagttcagccacatccctgaccaggggccatcctgactctgcctgattgctcccaagattaaaatctccctttttccccagacagcccttttgtttgcattgtgcctggcttttggtattaccatgttttcctttatctttgctatcttcaaaaacctacctcactaggatttcttggttctgttctctggggccacccagagtggaggctaattctacatggcagtgtttcacatggttgcagggagctgggatttcatttctctaggctaaatgtatttgattctttcagtcttgccttataagcttttgttttgagtagcctcagtatcctagtgactctctcctgaacatgttccatgtgctgatgcctcttctaaggtgagactccgagcagtggtatgcccaacacagaactgagcaaaattggccgggcaccgtggcttacgcctgtaatccgagcactttgggaggccaaggcaggcagattgcctgagctcaggagttctagaccagcctgggcaacacggtgaaaacccgtctctactaaaatacaaaaaattagctgggtgtggtggcgtgcacctgtagtcccagctacttgggaggctgaggcaggagaattgcttgaacctgggaagtggaggttgcagtgagccaagatcgtgccactgcctccagcctgggtgacagagcgagacttcatctcaaaaaaaaaaaaaaaaaaaaagaattgagcaaaattttcaccccttctataccgggtactatgctcctattcatatgttctaagatcatattcttttattattattttaaggctaagttattatcagttatagctgtcttccctacatgctgccattaaccaggcctcactcttcctaaggctttgtaggggatatcttgggcaggtcttctgtttatcaccagttagttttcctcttgatgaattcaattcatggttttagtcaacatcctgatccagttactcagcatacgtgctgtctcctcaaacctgtgtcacctgcagattcagtaagcatggcttccaaactttaatcaatttaaagactaatgggtataccaaggccaaggccaaagacagagttgttaaaaatatgcagctagggccaggtgccatggctcatgcctaaaatcctagcactttgggaggccgagtaggaggatccctttagcccaggagtttgagaccagcttcggcaacataggacgactccatttctacaaagaaaaatacaagtgcatatctatggtcccagctattcaggagggtgaggtggaaggattacttgagcctgggaggttgagactgcagtgaactgtgattgtaccactgcactccaggctgggtgacagagtgagactgtctcaaaaaaaaaaaaaaaaaaaaaaaaaaaaagcaatgaggctaatattgattggattgtagtcatttaacccatcacaaacccacccaattctaacttccacctccatcttataactgcctttgtcaaatcccttgtcaaaaaccagtagtcgatacacactacattttctccaacactctttgaccctgtcaaggaagaaaacaaagcggagcttagcaaagcagcccacgctgattgctggtattcaccacttccatggagcctacggtgttcacaaagagaatttgtggttacaacatgcacatgaagattaattcactttggcagtagaagcaaagaattctggggaacagaattcaagaagggagtttggcctactcgaagttaggagaattctccagtatctatgactaatggtcatcagatgttatagtttattcttaatacttagtttgctaacctggtttcctagtataccttctcatgactcattattttaggtctttttaaggacatcgtaatcctttcaatgcaaacatcaatgcaatttgatggcattctttattttgcggacattcgttgttcttcaggtggttgaagcttaaatgaggcggacagagatgagctacagagccccaggctgtaatttgcgctaaccagtggatgacctgccaaggcatgagttaggcatttgggattacatcttcaacttcttggagcagtgagacacggtggacagaatatcagcttacccctcagctctgcttttttggggaattcttggacaggagataaaatgagaggacattattgctggaagcatctatagagagcctctaggacagtagttaccaaactgaagtgtgcatttgaaccatctgggaagcttgttaaaaatgcaggttctcagccaggcgcagtggctcatgcctgtaatcccaacactttgggaaccgaggtgtgcagattgcttgagctcgtgagttcatgaccagcgtgggcaacatggcaaaaccccatctctacaagaaatacaaaaattagctggccatggtggtgtgtggctgtagtcccagctacttgggaggctgaggtcccagctacttgggaggctgaggtcccagctacttggctggcgtgtgcctgtagtcccagctacttgggagcatggcttgagcctgggaggcagagattgcagtgagccaacatcgtactactgcactccagcctgggcaatagagccagaccttacctaaaaaaaaaaaaaaagtaggttctcagaccaccactctcccaagatgggcaactggaattgtgaacacttctgggcctcactggttcctcctccagtgtcaaatgaagggttagactcgagttattctagaacaggaatttgcgtgttgacagtctccccagctggttacaagcccctggccctctgccccacacttggagaaacactgagtctactctcagtttacactggggaggacagggaggctcagaaatgctcggtaatctgcccgaggtacccagtgagtgaccacagttctgagcttctgtttccttctgggtagaaggggcctgatgatgttttccccatttgccatccaagactctgatgaggcttaaacgtacgtgtgtgaaaactgtcaagtgctctgtggatacaagtcgagtgactcttaatggccaataggccaggtcctgggagcctaggaccatggaaaaggagagaggacaccacaacctcccaccagcccagtcgttccagaaacccatcaaggtgggccagtgtgaggtgaccccagtcttatttgtgtatgtgtcagcccctaccccagtgggtctttcccccatagctgtcaatgggaaggtggtgatgttagaggccctcctctatagttgacttgggggtgtctgagcctctgcagctcacttttctctgccccctttttagtgtgctggctgggacaatagagtgggtttctctttgagaaactagcaggtggatttggggcaggcacatctacctccttcactttattctcagggctgttgcaattactgtaccccttgcttgtaaacctccttcccgcaggtccccatgtggccccctttctacctccttcaggccttggctcaaatgtccactttgcagtgaggtcttctagacttccagtccactgttcccactttatttgatttatttatttttttgtggagatagggtctcactctgttgcttaggatggagtgcagtggcatgaacatagctcactacagcctcaacctcctgggctcaagtgattctctcaccttggcctcctgagtagctggcaccacagcacacacccccaggcctagctagttttttaaacttatttttttagagacttggtcttgctatgttgcccaggcttgtcttgaacttcaggccttcagcaatcctctcacctcagcctcctgagcagctggaattacaggtgtgagtcaccgtgctcagctctgctttctttttatccgtagcattcaccaccgcctgactgagtggtattttatttaccttttttgttcgtttattgtctccctccccagcccaccacgtaagcttcaagagggagggatccagtgaaatttctcagcacctactctaagccagtcacagctttaggcactggggagctggagatgagctgggcttggagcccaccctctagcagctggccatgcagcagaggcatgcccagtggggctctgtgacagtgcaggtgggggaagctggcacctgtgtagaggtggctaaggcccactgagttccaggcaggtaggtgtgtttctgtcctggcctattctctgtccctcagtactgctctgaggtgcactgctctgggccagagccctgaactaggaagcaggctggggttaggcctggcccatggctgactttccgtgggaccttggacaaatcacttcctggtgcaagcttcatttttctcatctgtacaaagaagaaaatcttatcaccccctgcagtttgggttattttaatgggaaagcctctcaggggcctgcaagcccctcctccttcaaagtggggccagatgaaaggaagactcgttccgaggctcctctctgacagatccgataaagctccctagcttcggctgcgtggcccctgggacggctcccatttttattgctcttggcgcagaagcacagtggagctttgatgactaaagaggccctttgctttgtctccccgtggcccttacctgacaaaggcagctttcactgctgccattctcccctggtttgctttgtgttcctaacccccgacctgaaaggcctggagccctccaagggcctggcctccgcctgtcagcgctggggttctagatggaggaaagcaaagacgcagatgcagaggcctctctgttccctgcgccggggtccctgcgggtgacgtgatctctgttcggcttccgtgtcccagaggtcagttgcagaggcagagatcccattactcggccttgcaatctataacttccttgtgccttgtgtcttacagaaatttaaagagtatgtgaatggcagtaacctcatcaccaagctgcaggccaagcacgatttactcaagcagaccctgggcgaaggtgagtgggctggtggaggccctctgggaggtgctgcgttccccactggctctcactgtggccccctgacgtgttgagctgttcaggcttgagacagcaggcacctggcagaatgaacctggacttaccaggactgggcaggctgggaaaatcaccttggtacagatgccttgtggggtccaatctggctatagaaaatagagggtgtgagttgctttttgattaatagaaagaaaaaaaataaaataaagaaaatagaggctgggcacggtggctcacgcctgtaatcccagcactttgggatgctgaggtgggcggatcacgaggtcaggagatcgagaccatcctggctaatacggtgaaaccccgtctctactaaaaaaatacaaaaaattagccgggcgtggtggcgggcgcctgtagtcccagctactcgggaggctgaggcaggagaatggcgtgaacccaggaggcagagcttgcagtgagccgagatcatgccactgcactccagcctgggcgacagagcgagactccatctccaaaaaaaaaaagaaaagaaaagaaaatagaggccaaccacaagtcttagtttaggttggcagggacagtccaaggcaaagtgatagaggggcatccatcaggtagggagtgggaatccagggcctcagaggctggcactgacatttttcagcagacactatttgcaaggaatactactggagtgtctggctagggttctaggtccagagaaggaaaatccatacatgtaagtcagggtttggccctcgagggacctgacaactaggcttaaagccactcaatgcattccagtggcagttggaataaaatcccagctgctgtcacggcacatgaggccttataccacttagcttctgcctgcttccctgacctcatcagtcattctccctttccttactgtgccgcagccatgctgagcaaatttctgcccttcaggactcaccaagcttattcctgccccagggcctttgcatctgcatgggcaaccaccacccaaatcagggggtagagcatttcagtcaccctcaaaaattccctcgtgctcctttgcagtcagcaccccacactctactctgatctgatttctgtcactgcagattagttttgtgtgttctaggtagtaagggctggggaactttgggggctgacggaaataaaagctccatatcctgctttgagtggtggttatacttgggggtagacatttgttaaaactcattgactagggggtaggaggggggaagactcagttgcagtgagctttttcttcattctttccctctaaattttacccatcccgacatttcagtattgggccagcgggtaaagggggtgtggaggagtttgggtagcaaagagggaagaaaaacagtgagaatggaggagaaagggagagagtccaagagtggagctcagggtgtgggtgccatgggggcagcttctaagactagcattaaagaggagggttggtatttataggcacagggcagggggctattcctcatgagccagttaaccaaaaggtaggaccatatgagttggtggctacttgcatttttgaaattagatgctgaatttggaaaactagatcttcttttaaaaaatacgatcctgggcctggtgcagtggcctgcccacgccttcttggtgcagaagcatagtggagctttgatgaataaagaggccctttgctttgtcttcctgcggcccttatctgacaaaggcagctttcattgccgccattctccgggggggcttgctttgtgttcccaactcaaatgatgatgattgatgatgacggtcatcatcaatcatcatcatcatcatcatcatcatcattatcaccatacttagttttggcataactcctggtccatttggtcctccaagtttatttagccttcaactacgccttgctctaagattgctctaccagtctctcttctgagttttgagctgattagcaataaaaaaaaacctcccggaaaatgcattttcagaagtagaggggcagctaagaaaaagccaactggaagagtctccgtaatcctgtgtttcagtaagctggccgtggagaggctcactgcgcttcctttgacaaatggatggttcttgatagactggtcagttctacagaagttttttttttttttttttaaagtaaactttctcttttaaaacagttttagagctacagaaaagttgggaagatagtataaagttttcatatactccacatctagtttgtcctgttattaacattttacattagtatgctatatttgtcagcattaatgaatatggtacattattattaactgaagttaacaaattactgaataactgaaaaagatggaccctgaataaattgagaccaaatctccagtcatttttatatagccactacacgataaagatacaggtagattcttagggcactgggtgaaaagggagaatttccactgacctaattgataaattgatcaattggaaattgcccattgggtgaaggaagaagggaaaaaattcagcaggccaaagagagctcagaatcttagcaaattcatccttcttagtgtcaactggtgattcaccttttcctgagcgttttggttcttctattcagtaggattctcttctaagagtagggtagcgttacagctgcgtcagtggcctttttatgccgtatgagggctattttgtagtatcatgtctagtgcctcagtttctgtaaagtacagtagcccttctttatttgtggtttcgctttccatggtttcagtttcttgtggttatctgtggcctgaaaatatgaaatggaaaattcccgaaataaacaattcatacgttttaaatttctcgctgttctgagtagcatgatgagcacgctgagcaaatttctttgctgagcaaaaatcttacgccatcgcggctccatctctgccaggatgtgattcctccctttgtcctgcatatccactctggatatggtacccgcccactggccacttagtagctgccttggttatcagattgaaaaaacagaggacatgtaggatttggtactatccacagtttcaggcatccactgggggtcttggaacatattccccacagataagcgtggactgctgtactcttttgacaggatggctcaaggaaactacaagttagatgaaacccaaggtcttttgggtcagctttacttaaaagtggatttgagaacatgattgaccccagacatgcaagtcaaaaagcttccaggtgcttggcaaatggcattccctgttacaaaggatgtcactggcgcttctcgggagcaagagcacataccttggctgttgctatgccattttattggccagagaattctcagtttatcatcatctctgagtcttagacttataacctttttattgctctggggtgtgggtattctgtaagctccagggtttacactcaagatgcggttggtttttgaatttttgaaagtccctcaagcatgaatgaacagtgtgccacctataaaagggaaggagcatgaccttttcatgccaactttaattgcccatcacagagcaaaatggccaccaggaccaggccatctgactttctagaaaattactgaaccaccaactataaaatatatttttaaaatcccaacaggtctcagaaggtaaaggataggcaagttttgatttcccatatttgtgagacagtcaccctgtttctaaagatgctggttgtgggattcttgagagctggaatgtgagtctgaagctgaaagacagcatattagattccacgtcagagaaaagttttccttcagtgtgttctgacattccactccacatcctaaaacctttgatttctacctgcccccttctgttcacccatctatccaagagcgcaggcattttgtttggccaggcctggggagatagtggtacacgagaaaggtaaggtccctgccctcatggaaaagagagacctcaaacggtaaacaaactactaagtaaacaatgataattgagcccggtgtggtggtggccctgtaatcccagctactcaggaggctgaggcaggagaatcacttgaggccaggcagtggaggctgcagtgagccaagatcacgccactgctttccagcctgggcgacagagcaagtctctgtctcttaaaaaacagctgggggtgggaattataattgtgttaagtgccatgaatgaaaactttgggctgagatagagaacaatggtgtgtgtgtttgggagagatgggggggacctgctttagatagggtgatcagagaggcttcctaggggagttgctgtttcagctgaaactaaaggatgagaagacatcagccaagtgaaaaaccagggaaagagtttttggggaagaggggacaacatttgcaaatgcgggaaaggatgtggtgagtcagaagaattgagagaagggtattgtaacttgttgagtacacagaagagtggacggtttgggaacccagaggagggggaacaggaaatcaacactccttgttcactacaatcccaggccatcgcctgaccactttcatgggctgccatcagctctaacaggagggcttgtgtctacctgaaaattttatccaaactggtgtctggtaggaatttgcccttgactccagacacacagtcaaatcaaacaggacaaatttgcctgttttaccgaacttttctcctttcctgctttggtctttggttccaattccaccaactgcagccacccatgtaactgcttgtggctttgctcaggaattaaggagttgcctgttgatttgccccaagttctattttcagacccagattactctcttcctctccttatttccctccctggccctattctgccttttttttttttttctgtaaataaaatgctcgattctttcttctaaaagtcttttaatgttagtgctaggtgggattccagagttgagagctgtgctgtccagtatggtggccactagccatgtgtgcctgatgaacacttgaaacatggctagtctgaattgggatgtgcaaaatgaacaccagattttgaagagttagtacacacatacacacaaaatagaaaatatcttattgattttctatattgacacatatcaaaattataatctttttgatattaggtcaaatgtaatatgtcatgaaaattaatctcacttatttctctctctctcttttttttttttttttgagatggcgtctagctctgggggtcccaggctggagtgcagtggcacaatctcagcttattgtaacctccaactcctgggttcaagcgattcttgtgtcttagcctcccgagtagccgggattacaggtgtccgccaccacgcccagctgatttttctgtttttagtagagatggggtttcaccatgttggccaggctggtctcaaactcctgacctcaagtgattcacccacgtcggcctccgaaagtgctgggattacgggcacgagtcaccactcccagcctcatctgtttctcttaacgttttgtaatgtggctaccagaaattgtggcttgtataaatttctactagatggcactggtttcagagattctgaactggaagcagttcttgagaatattaggaaacggagagcatttttggagccatgactggggacagtactgctggtagttggtgagtgagatctagggatgtcagcatctgcaaagtactagacaggcaatgaagaatttaaactgaggatatggaggcccaaagaaaggaagtggcttgtccaagctcacgcagtgagttgataaaagagttaaacagtaggactcagacctctttgttttcagtacagttttggtaggagaaggaaaagatattatttaatctcttcattttgagtgccatacccttgccaaggcagctgtcctctaatgtgtggcatccctgaagaggggatattataagaagccaaatgctgccttcagggagtccctgggtcggaggcatatactgctggggacatctgttctccctcaccttgtgtttgtggaggtggaaccagcttccctgggtaaacttagacttgaagttaggcaacctggattggaatccagactctacacttagcagggacttgggaaagtcactccatatctccaagtccatttgctcatctgttgtgacaggaatgacaccctgtgtacaattgtgctgcagcacttattacactatcgtgtaatctgcttattgactcatttggtactaagcttcttgcagatagagcacttgttcattcattcactcattctacaaatatttgttgagcatatactttgtgccaaacactgcccaagaccttggtgtcagcgcagttttaagaactgacaagattccttctctcacagaacacagtattttccaatggagatagactggcagtggacaagtaaacaaataataagtaagaaaaatattaatgataagctacatgtattgataatttaaatagagaaacgtgatataaagagacaagtgtgtgctttagatagaggaagaagcctgggcaacatagtaagacctcatctctactagaaaaaaatagctgggtgtggtggtatgtgcctgtggtcccagctactcaagaggctgaggcaggaggattgcttgagcccaggagactgaggttgcagtgagctgtgattgcaccactgcactccagcctgagcggacaacagagtctaaaataaataaaataatataaaatagaatagaatagaataaaaataaaataaataataaagatagaggaagcttgtctctggacacagcttttaagttgagacccaaaagacaaggtgaaatgagccatgcaagtgttgggagcaagagaattccaggcagcaaatgcaaacgcctacttgaggaccacacagaggcctctgcatctgtagcagagcacacaaaggagaaagcagcctgaggagatggagtagcattttgaagggtctactctgacctcaaagggtttataaaacagagtaagaggtctggattttgtcccttgtgcgatgagaggttattggagggttctaagcaagggaaggacatgatctgatttacagtttaaagagattgcttggctgctgaggcaagaatggatggtagtggaataggagacccagttaaaaagaaagtcgtccaggtaagagacaagcatggcatggactaagaagatagtgttaagtggagagaagtggacaaatttaatttatgaaggaaagacagttttcaaggagagcacctgttagacttctggcttaaagaagaggggaggtggatatccacttattgagatattgaagacttgggtgaaagtaggtttggggcatagaaagaaagagtgctatgggaaacatttaaggtttgagataaaagaaggcaatttgtgttgagtggataaagaaaatgtggtctgtgcatatgatggaatattaccaagtcatatgaagaaatgaattactaaaccgtactatatggatagacctcaaaagctttatgctaagtgaaagaagccagatgcagaagaccacatcttgtataattccatctatataaaatgtctcgactacgcaaatctgtagagacagagagtagattagggttgccaggggccggaggcaggaacagggagtgactattagtgggcatgaaagatctttttctggggatggaaatattttcaaactgaattctggtgagggttgcataactttgaatagtcactaaaaatcactgaattatacactccaaatgggtaaattttatgatatataaattatacctcagttatgctatttttataaaagattgcagtgcatctgagtttggaattctagggaagcgtaagatctggacatagagtagggagtccttggtaagcacttgcggtcacttagagaggatgtgtagaaaaggaaagcagccctgggtctgtgtcctgatggcactccaacattttgaggtttgaggttgggcagaatgaggaggagacaggagaaactgaggaacttgtagggcaggaagaacacctggaaagtgtggagtcatgaaagtgaagagtagagagctttgtaagaagggagtcgtgaactgagcagcatggtgcggagaggtcaggtacgataaggacagagaagaccattggattcagcctcaaggagatccttgttgcccttaagtgttgaccttgacaagagcagtgtcagcccagggatgaggacagaagcctagctgcaaagaggtgaggagggaatagcaggggaggaagcagtagtgcctccagacatctccttcagggaattgtgctgtaaagaagagcagagaaatgaggatgtagctggaaggagaaatggggtcaacagaagggttaaaagctaggtcatgcatatccagaacatgttgatatgctgttggaaatggtccagaagagaggagattggtgatgctagcgagaggggagatacctgcagaaactaaggcccccagaaggacagaggggatggaaccagggcataaggagaaggtctgggctttgtctggcaggtaggtgggagggcctcgtggaggcatgcacatggagaacccatagtacttgattttcttttccagtaaagaaaatgagaagatcttcagctgggaatgaaggcagaggcagggcagcagggtggaggagcaccagccttacggctggtatccttcagtgccaggcatacaacaggggctcggtcaatctttgttgccattaaacattgcaggagtttttgaactttgggaggcatagaagtgatcaccaggggtggtagttaaaatgcagatttctgggtttttatctcagagattctgattcagaagacccatgagacagccaagaaatctgcatctttaacaagacccccagatgtttctgatgcaagtggtcagcgggctgtagtttgagaatcactgaaaatatgtctgtgaacaataatgtgtgtgtgaacacagccctacaaacaggaggcttttaatgaagaattaataagacgcagttcttttcaacagaccgcaccttaggcataattagatttcatatttcataaataattaagactcattgtattttgtttttagaaaaagatgaatgttctttggattaaaaagaaaaggcaattaaacattcatgtatacttttctttgcaggggaaagagcagaatgcggcaccaccaggtgagagtgggagagttgtgttttctttcatctgctgcccgaggtgggagtgggatggggctggggaggcactgccaggagctggagaagcagggatggcttcttcaccaatgtccccaagggccggtgtgggtgtgcccaggtgaggcacagttgctgctttgcttgttctagcattagactgacaaagccacgcccctccaggctggcgatggaaggggcgcttttggggctgctgtgtggcagtggggcaccctccctttgcgctggccatcgggtgagacagtattgtctactcagagtggctgagggcagcctgtaggggccagaggctgtggggtggctgttgacctctcttcccacctgctacaccatgctgagcaaactgcccagccatgctgcgaggcccagcctgaggtccccatgtaccaaggctttgggccaggctcagattgcgcgcagctgggcacacgcatgtgcataggcgtgcacagactctcctgccgtccacaccctagcttggacctcacgggcacttggatgagctgacggaaagtaacacacgggcaacttctgctttctcttcagcttgttcaacattcccttttgcgctttttcctgagcagaccagagccagtgaacactttccactcagcagctgatagcccaggggctgactttacttccctttcagagagcttagatccataagtggctctgtcactggccaggttgtttgcttagagcctatttcatttctatgttcctattaagagatattgcactgcctagctggaattcagccagtggcccagaggcctgcacttttccatcacacggcagtagagcgctactttttgcctcactttctgggcccagggacctgagggcattctttcttttcccacaaatgctttccagtggccccaaatcctgggaagccctcatgtttggcaagagcaaagatgaactcccaactctctcctgctccttgggaagggagttgggcaaagtcttggcaacctctggggttttcagtttcctgggctcaggatggggagacggagggcttggcagaagttcagcccgtacagctgttcctctgggctctggcaatttggaaacatcaggatgattcacaccaggcaaggcccttccagcacacggggcggcagatgtgcagggtcactttcgaagaaccttttagaaacgaacccattataatttttttttcttttctggcgagagaatgttgtcatagtctcaaaacaacagaagctgtattttacaccaaattctgcaaatagtgaaacagatgggggatgaattgagctgtccctcacttcctcctaattcctagaactcacgcagagaagtttgttccagcagagtgtgggagaggagatctgtaatcaaacacttggccaggtctcagggtcttccctcaggggaaagttgagggtttgtgtgttttgttttgttttgttttgttttgttttgtgttttaaataaagccctctgaagtgttgtcttccacaccctccttgacctagggcctgggaaatccaagctgagtttatcagacctcccacttagacaccctgcattcaactgcagctaccctgcgttcaattgcagacatagccctgtgtactctggttcctggtcaaggtcaaagacaactttgttagtaaactaaaagtctccccttacctccaaaatcatgatttaacttgtggaaattgttgctaacaatgtctctgtcctatggctctctctgtatcttccatggactcccacacgaggtggatatcatttctggatggttatttgagcaggatcccctcagctaagttgctgttgaccttgtatagaggaactggtgttgcatatgggctgcagcatgttatatttttctcacacttcagaaccttatcttagaatagaccaaattcataataaccctgtaattcaggatggccagatgtgataatgcacttaagtttaaaagcgtattgcaaatgtcaaagcaagatgcaaatataaggtttgattattgtgattcaaatgaatgtctggctccccttacccaggttgacatgccctcgtggtctggattagaggtgaaatcacttgagatcttgttcaggcagatgcaacgcagtacacagcccatgaatagcctccaagggcccgactggcattgccctacagcattgccaccatttgggatgttgacctccaagtctattaggttatctaggggaatttttcatcacatccctttagttgcaggataattttgaggctatttcctgtgttgccaacgtgtgttaattttcatcttgattaaaaggcagaaaggggacattggtctctggtttctctttcttcctctctgtggctttctctgttcctgttttccctgcctctctttctttctttctttcctttttgctctgcatctgagcagcagaagagatggaaggcttaggctgccccactttccttggccgagctgcccccctgctccccactttgtgccccacccagcacttcagtaagtcgatatagatttgatattgtgcaaagttgggatagctacgtttccttgtcagagattccagacagtgcacagagcaccacacaaagaaagaaatcctcgtgtgattcacacagtcctttgctttctggattgggcaggaaaaatgggaaaacatatgctatttccccttttttccactttgtagaatttaagaaaaaacaaaaaacacttaggactttcttttaaggaaaccctccagttgggcaccgtaggttttttgatattgagtgtccaacacctgcttttagagtctccgctcttcctggccatgagaatttaacagataatttaatgttacttctggatgttctatgataaaatcactttcatactcacactagatccttgagagtaggaagagctgaattttaccaccagcctcaatcacattttatttgtgtgaccttaggcaagtttcttcatcttttgtgggctcactggccttgtatgtaaagtgaattgaatattctttcccagcctcacagggttgttgtgaggttgtcatgcaatgtgataaggaaatgatctgggaatgttcaaaaacaagccaaacactatgaaaacagggtgacaatgttgctatcatcaagttatttctaatccccaaacttaaaacctttggccttgtgtcacatttttgacactctcttttgcctttggtatttgaaaatttaagagcagctcttgtaagaaatcccaccccacatacatacatcctcaaaaaaaaataagtaatttttgaaaaataaatgacatggacttagctaaccaaattgacatagatccaagatgggcttgaaagaatcttgcctgttgtttcttttcaaaattttgatctgtgctgttattttgtttccattgtttgggtggcatgatatttggattcacctggtttttgcccatgcatgtactggagctagcagcatttgctcaatactcaaacacctaggagaagttggttagaggtccctggggatggctggcttaccgaaggagacaggtaccacaagcccagtcagcagaggcagcatgaatctcattaatcctgattggctgcatagtctggaagatttcttgcccgctcacagaaatcaatcaagacttgggggaccaggtctttgcttgtcatgtgtggacattatctgtgcctggctgagtccccacttgttgctacccaaattttgaaccaagccatttgaaaatgaactgcctctcttggttaggggccctcttcttaaccttcaaaaggcctttgccccagaaggctggcaccattgagtcaggccaacttgtgtggtgaaatgagcaaataagccaacacaggtatatgcatggtgagcaattctggaaacgggtccagtgtttgtggctgtttctctggtgaactgtggtgtggttacccctccctgtggccaagagtggagcacactttaggaatggaaatcctaaagtaaagcaagacactttcaacctgatcccatggcaaaggttactggggtagatgagtccttggctggaaataaaaaagtgccctaaggctccatgatggtggcctggtaggaaaagccctgaacttggagccaaagagtcctgggtttgggctccagctctgtcagttctccttcacaggaggcttcagtctctgcctctgtaaaatggggccacatgcacagggttgagatggtattaagtataataatggatttgaaagtgctttaattgaaaatgtacttgaggctgggtaaggaggctcatgcctgtaatctcagcactttgggaggccaaggcgggcagatcacgacgtcaggagttcaagaccagcctggccaacatggtgaaaccctgtctctactaaagatacaaaaaattagctgggtgtcgtggtacatgcctgtaatcccagctactcgggaggctgaggcaggagaatcgcttgaacctgggaggcagaggttgcggtcagctgagatcatgccattgcaccccagcctgggcgacagggcaagactccgtctcaaagaaaaaggaaaaaaaaaaaaaagaaagaaaagaaagtgtacttgactaaagagcaggatattaccattatcctggggtcacccagggaccccaaagaagttgcagcctccctcatggcatcagtttcttcatctctgaaatgagaatagtaattgcctggctcttagatcaatgaagtaaagatcagtcaagtgcatttgaaatgccaagaggcattaggaagatcagtgccctggtacattgggagttgagacttggtgataaatttaaaccaaaataatgaaaattaaccctcacaatcatttttgaaagtctcttgctttctcgggctacagattacatctctctcccctgattccccctccatctggtcagctttgcaggatgacagcctctgattggagtttcagtggtttcttgcacatgtactatattccccctaagatttagaatgcatttgagttatgtaagagttgctcctgcttggcattgtgggtaaattaaggtcccctaaaacatccaaaggccttcagatggaacattggaaaccaatgtcttggcggggggtcaggggcttccatttacattttgtgttcccctttagtcgtgggttttaagagcatctttcccagttgtatgtttatgttggttgctttcttgatttcttttgttccgttttcccctaggcccccctgtcttccccctaaaccacagaaaatgaggagacctaggcctctctcagtgtatagccataaactctttaacggcagtatggaagcattcattaaggtacttgctggggagccgtggagtccgcgaatgcacccaatgtaatggcagcctctgtccgcccgcctccctgccagcagacagccctgtccttggccaggccctgtggagctagttcctcactgcagcctgctcttagcttcagcaaggacttttcacgggagctgccgtggcttctaaccatttgctcctaagtgccctgcgcaattctcagccctgggggtagggattcagatcatgaaagaactcagggaagtccaagtatggctgaaatgccacacttcattcacgcttcattgcttcagcaactgcagtcctaacacctgagggacagtcagagaaaccccattccctcacttcacacctacatctcccaagaggagctagattgaaagcaacacagaggaaatccctgtgggtatcagtgtgtttttatacacgtgaattttttttttagttgcatatataccagcaaaggaaacacatacattttttataagagaaaatcctcccacctagttttgcttcctgttaggtggtctgggagaagggagaaaagttgaggttgtcccttttgaattctaggttaatcctttgtaccttaaactaaaaattgaagtagtttagctaggcgagtttctcttttcttttctctttggtgtaaagggtatgagattaagccatatcagatataatggctcaagggaaattaagaagatggagaagcgaagagcagcagctggggagatacttgaggaaggggagaagcactcttaacattacttagaggaagcagggaagtccctgcaactgatttgagagcccactaccttctaatgaagacactttcttcagagaagatgatagatatcaatcaggagaaaaaacaaaggctcctgggctttgccaatgatttgggggttttggaggctgctcgtgctccagctgtctacttgtgatcctcagacagggtccagcacaagacttgcaggacagcaaaagactggatatatgagtttggccttaggcaggggagggggtaagcaggaccagcctgggtcccaggactgtctctgcctgtgggctgagttctggggaagggagagtggggaaaagggcaagtggaagaccagggcccaagttgggactgcccagggtcgaaggatgtcaggggctgctgtaggatgcctaagaagaccaaagcgtagaggattcccaaaaggaagggcccatggatgcatcaggaaggaagatcaggaggtgacccagagggagtggtttactgggtcatgggagggcagggctgtaccaaaggaatcctctgtctccatcctccctcctctctcctccaagactttcttctttcatccttgcccataaaagagccatggtccatggccaagaaggggctagttactctcccttccctcaaggagtcagtagtggagcttgggcaattttaaacacaaaaggcagaaagtggaaggtgatttaggatgagcacctggtgagttatccccacagaaacaagtttaggataggcgcagtggctcacacttgtaatcctagaactttgggaggctgaggtgggaggatggcttgagcctggtagatcaaggctgcagtgatctacagtcatgccactccagcctcggtgacagagcaagatcctgtctcaaaaataaacaacaaaaaaaaagaagttcagagcaagaagagctatgagctcaagcacagtaggcttctggaggggctttgagagaaagatgggaatacagaggagaatgaaaggacagaaggaattattgaaaggaagaacagaaggaatgaaggctcagagacagggacatcctcagtttgcttaggtctttggaaatgggtgatcagtcaggatacttggaaggaatcaactcttatctgacagtacttgacaagtagatattctgttgagttaagtattttcgtaatagaggggtcctatatataagatgtgactataaagttatctgactttattccttctgaccaacacatcataacctagtcaaccacatgagtgtttgcccctttgagacagtcaccttgggaagccaccttcttacctgaatgtgttggcattgctgcagctgctttggtcaatcttctttagagcctggagcatggcctttaccagtggggccaagactatgtattcaaatggacaccttgtctttggaatagaaagctccgtttgaagctgagctttgcgatgccattggaggtgcaaaatggcaagaggaatatgctacagtggggctgttccactggctctgaaaagagcaccccagcagcgacagcccagagcacttgagcagtggcagcgctgttggaataagtgcatcacctcctaaggggaaaagttggaggaataatactcatttgactgggaaaaaaggtgtgtttgttaaatactatttcattcattcattcattcattcattcattcattcattcatttattgaggcagtcttgctgtgtcgcccaggctggagtacagtggcacaatcacggctcactgcagccttgacctcttgggctcaagtgatcctcccacctcagcctcccgagtagctggggctatacgcatgcaccaccatgcttggctgattaaaaaataattttttttttttttgtagagacaggatcttaccatgttgttcaggctggtcttgaactcctgggcccaagggatccttcccaagggcctcccaaagtcctgggattacaggcatgcgccactgcacttggccttactattgcgttgctttatagtcacactgtactcatcacataccatcagcacagttcaataaactcatactgtgcacctactatgagctaagtggtcaatgttttacagcacagttttactgtgaaagattattaactttcagagaatgaaaaggcagtataatgtattcaatccttcaactattgagaatggaatttaattttctattataattcacatgccttctgaaagaacattgaactaagagtccccagctttgaaaaaccacacctgtgaaaagtttttttaataaaataacatcactgggacttcacaattatggtggtctagagggacaaggaagcatcccctgggttcataatcataagtaaatgttgctggagtttgttttatacatttcttggaccctacctgaataaacaaacccctttcaaaatccttgatgttttttcctcctcctctcaggcaaaaggagaactcatttttataagagccaattttgaagcccaggaggttcacctctgggacaaggggagaatcctcttcttgtttctgtaaaataagcatgacaattacctacttcatgagtttgtgaggaagattaaatgagccactatatgttatgtttctagagcactggatggcacatagtaagcactatgtattacctatgattattagcattaatgttagcatattgctcatacagcctgttcgaccaggctgtttgctcagttctgggattctggtagatttagtcagcatgtcaggtagcagacaattccagctgtcgagatgctgagaactggacagatgactctagctagaaggcacacatcctccaggagcctggatgggacaagtgctcaccccagagatggacctgctgcacaggtggaaagagccgatggcgctcccctgaaaatgggcatcatcagtggcttttagtgaaagtaaaggccccagttctgcccccaagctcatgaaggcattctgactcaacttccctttctcctccaggccttcctcagcttttgtattccttaatgccagtgtaagggtcaagaggggaggaaggagagcaaagccaagtggatacccaagaaaagcaacttagggtgtacggcagggaaacatgggaagctgtttggaatttggcatcaggtggaaacctatgggcatctatccagagggtaccttgtagacatgatcttgttagaactgaacttttcaccaagaatgtttcttgagctgaattccagagacattgttccagtggacataaaggtgtatttctctcctttttgtgggcagctgggaataacttatggggtcgtaggtagcttttgtccatgggtgcataaacagtcccttttgttgaagagaagctaggtacagggatgggaatgggtccagtccacacagttgctgctctttcacaaggactgaaagaggcccccatgtcagctggtgtctgggagggcagctaaggcagccacatgggaaggctggctgggtggcttccagaagtcccatgaagcttccaggcttgagggtggctctccccacaggccggctgtttggcaggctccccaggaccttggctggctgccattgcatttcggcgttcacggactctgaaggatctgcttactctaactgatcttattcctgcataatcttttctttttctcctgctctgctgcctgtttattttttgttatcagaggaagaagaaatgctcgaaccaggaaccaggtatttactagaaaggcccattagccccattcaccgtgatggaaactgtctttagtgctgacttccagaacagagcccaccttgcctgttgctgatgggtccatattcttgtcctgtccctgggcacagtcaatcaaggaaagaattcacaggtggggtgtggaggagccaagaacatatccaaatccatgctgtcttcacaagagcatattacatgtgcctcatggtttactcacgttgtgaggaggctaggcctttgatttggccccttttaaagaaagtttaaaagaatttgatgctctttaagtgacctggaataacagagaggtcaacaaataatggaatccaaaagaaaatgtttcccctccgccataatcatttgtggctgtagaccagtctaggaagatgtcattgaaaatacattcacatcccaggtgcctgtgttgagaattgcatctttttcagccttttagagtaaggttggcccctggatggccaatggctgacatcggctgcctctagagcttttccctgtgacatgtttactgttaaatgcagtatgcatctgggtgtttacttgtgacttcatgagtagaactggtcttcttttcttagagctcaaaatttccaccaggggccagccttgcttcccccctggtgtgcccttaattctgacatcaggtactgcagtaataggatgaggacttgatccttgagcactgagaaaatagtgttgagttgggacaaaatggagggggaggcagagaactcttcaaggccagactccagcacccccccgaggtggttccctctccactgcccaagtgggcctgccaggcctcctgagcccaggttcctttccagttgggtaagaagaagagcatttctttaaaataatcatagctatgcctttttgtgcatacagttgaagactctctattgtaactgtccgtggagactttaggattagcagttccttgcttgttttcctactaatctgatggtactaatattctggcttgagtctgtaatcggtgtttgcaatgtctttttcctgtggtggttgtcaagccccataaaactcacaatttttcttttctcaaggattcaggacaagctataccgcttgtagtcgagagctgcatccgttacatcaatttatatggtaagctggatcttgggccagtgttttcagcaatctgcagaacaggtgctaggctgttctgataggaaatgagattctaatttgtcctggaagacttcccgtcacagctctgctttggagggggaaagtactgcacacagcagctgctcttctgagtgctgcttttgagcctgtgtgttgagggatggagatcatggtgagaggatccaagacctaggaaaactggagagtagaaagggcatggacaagagaactcaaccctatagctctgtgctttgagcactgaatggagtttgccagtaaatcagctaatacggctagattataagctccatgaaggtattaggttgatgccaaagtaattgtggcttttgctattacttttgaatggcaaaaaccgcaattacttttgcaccaacctaataatgatgtctgggatttgttaaccatggtgtcaccagaacataactggtgcttatccactcgttcattcctccaaaactatatttattgagtgcataataggcactgctttggagagtgggaatacaggcatgaacaagacaggtgcaatgcctgccctgcatagcttacacttccaatgaaaagggcaaggaaattatcaagtggaaaaataaataatatcatttgagatagtgcaaatgccatgaaactaatttaaagaggatagagaatggctggaaaggagaggaggtgctttggctaaggcggtgaggagagatttctccgagggggtgatgtttgaactaagtaataccgagtagaagcagccagctatgcagtccaggtggagagaatggaggatggcgagtggaaaggcctagcatggggaggaaggtcagtgtggctgggtggtaaggagccaggaagatgggatcagagacttgggtggcagaagttcaatattgtttaagtaaagagatgaagaagcatttattgaggatatactatatacaaaccaaactttgaccaaagcctgccttttgagagtaaatacttcctaaattataatgtggaaaattgttttatatagaaaaacagagatagggaaaggatcacaggctcccccattaattctcattaagatgaaacagaccttttaattccttcagttgtacaggctgctgttatgtcattactgtcatgtcatgtataagggtctcctctttgttaaggtcttgtagaaacatgtaaaaaaaagggatagttttactttaatgatttaacttctctcaagtcccagccagaatatactctggagtctagctcttcttgaaggcagaacatgtctgtgtacagggaaggaaaggtattgatacaaacttcttgaggccttttcctttaagctcaaacagaagatcacaagtgtttgaagcagatgtgtccaaggattttggccagctgtactttaccgtgaaggccatttctggagacattcatagggaacgactctgttataaaggatcgggggagaaagagacaagcaatggggagagtcactgatattcccggtagtctaatgaactcaaggtctcgtggatttactatttctttttctgtatgtttcttttttaggactccagcagcaggggatcttcagagtgccaggatctcaggtggaagtcaatgacatcaaaaattcctttgagagaggtgggtgcagagcgaccatcttaggcttgtggccaggggaagccagggtgaatattcacgtgtgtctcagagccagtggtgtgcagaagccagcctgcagtggtttgcaggagctgattgtgcacatctcttcccaacttcacatgcagtgcctttgtcctggtacttggaataagccatggctggcgtgtttacaccagagaaattggctaacactaagttctaattgttacctgccaaagagttaactgttcaacatttacctaccaccagcaccagcaccagcaccagcaccaccaccactgttactactactatgactactactgctattactactattactgcttttgggtggtttctccaggggactgcacagtggttgctgggaaagggcaccttgtaaagagctctggaatattcatatgaatctgtaaatgatgctacattttagaattggaagaacatagaaaatactgagtggcttttaggatatcctaatttttaattttttatgcagtgtttttggcaagccacacattgcggggaagagattatacactccctccaaccctggagaggtgacctagttcccattttgatttaaacaaggatatgaaagcttattagaaatgaggtggaccactagaccaggacacatatgatacatttggtgtagcctctctgggcctcagaatccctgataggaacagatggccagtgacagtgtccaagccaagtaaggactcactgggtcaggaaacactcaatttttcttacacctctgcttttgaatattcagtgcttatctcactgctgcactgaaatggaaaatccatgcagtttcattcgaggaaatattttcaatcctgctccctgattctagaacaaaacctagcattaacaagaccataacctcatcccaggggaggaaagaagagttggaatatcagtatcccaaataatatctctgcctgcagttttccaatatttgaaaaggtcatgtctccatagtccatgccttctcaactctgatttactgccttcttctctgagtggttctggtgctgaagaccccaaccccatacccctttacttgcagtacataacatcccaaaaggtatggtttacccctgttggctgtactctgagcagacctctctgtgtgtttccacccatagaattcttcctacttattacctagctcccctaccaccccaaaggagctgcctcttgagcaaattctctgcctctcggtcatctccattccatcctgcggtggaggaagcattctgcagccccaagcagtactgccacggcccccaggcacagaccctctgtggatgtaggtgctctggcttggaaccatctgtagacaatgagatttggctgcatgtcatgctcagtggccttctggggtctaggggagcttcgtttctggagcctcctcaaggatctcgggtgcttagaaccagggagccccaggacctccttgctccaagctcctacttagtcatgtattcattcactaaacaagcatgcactgagccctataccatacaaggtaatggacaagggcctggaaatgcaatatgaacaaaacacagtcactactagtgggggagccagtttagtcaacagccagtataatcagtgcaatgatagagtaggcattggggagcataggaggccctagcccagcctggatggagtggggaggaacagcaaagccagggaaggtttccttgggaaaaaatgcctaagctgaggcttgaagagtaagagccaggggaaacaggggcaaagaaagggcattccaagccaagagaacagcatgtgcaaaggtcagaaagcaagaggtctctcccatctgcgtccatgatgcaagtatcatttgtcattgctctgagcctctcttggcagcactggacagtccaacccataatgttgtttcttcattttccccagctccttacatccctgctgccttgtcttcatttacaatgaacagaaccatagtctggaacctttgctggttgcctcctcctgggctcatcccattatacagaatgccttgtcaccctgccttgaatctcgtgggcaaactcactgcatggtgcctccagcctggcaaccactttgcctggcatttccctgcctctccatattctgtatgtaaccttgttgccacgggcaaccccaccctttccctactctggtagcactgctttttaccttcttgaatgtgattttctaaggtcagcacctcctgtcacttgctttggtgctttgcaggggtgatgtgcaatttaaaagaattctctgctcctaacaagccttgggttgcctcaggcagagcccagctgggcagagaatgtctgaactaaatctcagctgcaaaaaatattttttcctttttcttttcctcacggatgcagttggcctcactccctcttcccatcgttccaaaacgaatctcattctctcgccagcctggtccttctgctccacctgagttgacaatggagcatgctttcttctgaaagaatcgttctagtatgtctcttttataaaaatcctttcctggattttctgggttggccgctgccagatttctcacttactcttttctgttccttgatattcaccaagcatatgccctgggtttggctcctaacctggctgacactcagggccgcttcctcccacccctccccagactaaggtcttccctcttcctggccgtcagcctgcttatctctgtgtttccctggcgacggggtggcccaaatctgggcccagctcaatatttctcttctcgcccactcttcacatcccacatggtttaactcgtgactaaatttcctctccaaaccagtatgccatgtttttcctttcttcctgtattttatttatttatttagttagttagttgggatggagtctcgctctgtcaccaggctggagtgcggtggcggaatctcggctcactgcaacctccgcctcccaggttcaagtgattctcctgcctcagcctcctgagtagctgggactacaggcgtgtgccaccttgcccggctaattttttacatttttggtagagacagggtttcaccatgttggccaggatggtctccatctcctgacctcgtgatccacccacctcagcctccgaaagtgctgggattataggcgtgagccactgcgcctggccagtttatttagtttttgagacagggtctctgcctcctccggttcaggtgatcctcccacttcagcacccttccatccaccaagtagctgggattacaggtgtgtgccatcatgcctggataatttttgtgttttctgtagagatgggctttcgccattgaactcctgggctcaaagcgacgcacccgcctcaacctccagaattgctgggattccaggcgtgagccactgcccccagccttttccttttatttttaaaatttaaatcctctaattcctgcagggtgcccattcttcaccagttgttaaaagggatttgggtcttgttcttccttggctctgtttttcccttctcctgagtagaggtcttcccagagttccttgcttaaggctgttgaaaggagcatggttttcttttccttgagctcctgaaaagtgataacatgttggaaatccactcctggcttattattcctaaatctacttttttttttccttctcatatgagtcaaccagagttttagttggaattctttttgttgttgtcgtcagtaaatcttaaactcactgctcaagttttgagctctccctataaatcttctggcaaaatgaaggagagagagaaaaaaaaacacatcatgaaaaggcaagaattagctactgagctgtggtttgctcttgtctcccagagggtcccccacaaacctctctaggtgccctctttgtatgcacagatgggagtgctgaggtctctccttatgtggagggggtgccttgccaaggaggcaatggctctctcccgctgtgcatatctacgcagggtttggatgtggggctaaagccatgccacgtaggctctagcacactcttgactctggatctgccccttctgagacctgtgtcctgcctcaagaagagggatggaacctggagatgctgggcggggttgtcatgtcgaggggctcgaggacctgtggccagagagaactgccctcatgagagagactgactccaagcttccagcagcaggtctgacagagcctttaagcacacactgtgtgctcagtctctgccctgggcacagccctgtcttaaagcctttggcaacgcccaggtgatctgggtaaaagtaagctccaggcagggcaattcagtaacaatgccacctccccaggacattagctagctaagtgtgaacatgtctttccttcagatttgcctggaattttagctctaattctcctcctggagaaagccgtcattcacaggaaccatccagctcgtctccagctctgggattccattctcagagccaaaactgactagcttgcagagagccaaaggcctgggctaattgaaaagaatgtttgggcagttcaatttatggactgagagccttgcaggaggaatggcaagaactaatggcgtgtgtatgtgtatgtgtgcgtatgtaaagtcaatatgcgaatcatgcttaacaacgggaactagtactaggcaacatggaggaaaatatccatgtgtttttgaattatgagaccacaggaatgatgtgtggagctaatagggaaacagcttaatatggtacagtttttgaattccttaggctgctacagggatagagagggaggctgaggaggtaaggcttggacatcccccaccccagttcaactaagacagccttgttctataagttgggatttcacaggaattttttactgagaaaaaaaaaaggttgagattctactgtaaaggatgaaaggaaggaaggaaggaaagtaggtaaatatatacctacctacataagcaggcatagatgcagacagacagatcaaaaaatcacaggtagaagaaagtgtatctctcagggattatgagaccttggagctgccagtatctgttgttgactttgtgattatgggcacactgcttcatctgccagggcctcagctctctcacaggagagaatggtggtattggaaccatgtctcccttagtgacatgcaatgctgttgtaagggttaggagagttcgtatgtacaaatgtgcttctcacttgagaagtgctgtgtgaatacaggtgatttttttggtgtgtttattttctctcttccttccctacaaagaagtcttatggaggcagcattctcacgtcctccagtgggaacatttgagagattgacctatttgatacctgtgtctgggccaccatgcatgattgttcactctgggcactgcacaaggctgcccagccaagagaacagatgggaactgaactctggctcatgctctgtacactgcaagccttggtgcaggaaggcagggggaccgttctctaattcatactgaagcatgttggggctagggaggctctggcagtgacatgtattcactttccacagaagcagagtaaaaagatccaaggatgagtttccagttctgcttttcattgcttgccagctctagaggtgctcttcgctgttcaggaggaggagcagcccattgtgtggatgtctctgaacatcaaaacagcagaaggctcgctgctgcctttcacctcccccatggaaattcacagtggtgaacctgcccagcagctctgattaaattgaaaagtgctactcccctgagataacattttcccttgtccaactggcaaaaattcaaaacactgatgatatgccaggggcagggctgtggaaaacaacattcttgagatggtgttgctggtaggaatataaaatggcatagccccagtgaagaattcgactatgtctgaaaaaactgcatatatgtctaccctatgacccagccatccctcttctgggaactgatcacagaaatctgcctctgtgcatacaaaaacacaagactattcactgtggcaatatttataataacaaaatagtggaaagaagtcaaatgttgacccctaagagattgattgtataaattacggtctgtccatgaagtagagtactttgcagcctttaaaaaaataataaatagaggaagatctctgtgaactaatgtggagggatttccaggatttcttgttaagtgaagaaagaagtttatttagaagtatactacattctgtgtaagaaataagaagatattaaaaataggcctatgtatttgctcacacagcaagacaaaccagaaacgaatgaaaatggttaaaaggtgtggaggagagaaggataagagtagggcttttctgagtgcaacttttgacttttggaccctataaatgctttgtgcattcaaaactgtaaatttaaaaaaagtatttctaaaaaaaattactacctaaaatacgaagaaaaccaagtgtgccacttaccaaattgataactacagagagtaacttttgaacatgtactccgatcatacatttttagcagctttattgagttgcacaccataaggttcacccattttttgaagtatacatttcatgcaaatcaaaaccacaaatatcatgtcaccccagttagaatggctattattaaaaaggcagacaataacagatgctgacgaggatgcagggaaaagggaactcttatatactgtgggtgggaatgtaaattaatacagccactatggaaaacagcatggagatttctcaaaaaactaaaaatagaactaccataccattcagcaatcccactactgggtatttatctagaggagaataaattaatgtatcaaaaggatacctgcactcccacgtttactgcagcactattcacaatagcaaagatacggaagcaacctacgtggccaccaatgcatgaatggaaaaagaaaatgtagtgtataatatatagtagaatactatccagccataaagaagaatgaaatcatgtcatttgcagcaacatgtatggaactggaggacattatgttaagtgaaataagccagcctcagaaagaagatttctgaatgttctcactcctgtgtgggaactagaacactttatctcatggacacagaggatagagtgataggtgccagaaggaagggtgagtgggagtggagaatgaaaagaggttggttagtgggtacagacatagaattagatagaagaaataagttctagggtttggtagtagaatagggtgacgatacttagcaacactatttcgtatatttcaaagtaactagaagagaggacttgaaatgataccaacacatagaaatgacagatattcaaggtgatggatacctcaaataccctgacttgatcattatacattctatgcatctaacagttacatgtacaccataaatatttaaaatgttatatatcagtaaaagaaaaaatgcatttcaatggtttctattatatttacagagttaggcaatcatcatcataacgttacttcagaactttttcatcctccccaaaaggaatcttgtacccatttgcaagtccctcccaatatcctccataccctggccaccagccctaggcaaccactgatctactttctgtcttctgaccatatatctcttgagtgggatacattttgaagataaaaatactaaacaataacataaacaaaagccctggaaagaaatctcaagttgtgtgtagcaggtttattgttagtggtaatattgctattaaaactgttacaccattgattgtgtattataggataaagcagatgaatgtaattattactaatattattcagaaccaatatttttatggtaagaaaaaaatgtacaaatacaaaataagtgaaggtaatgaaaaccttattgtatgaataagaaacatcagtatgaactcatgaaaaaaaattctagttctatccactgaaaggatctggaaggtctttatgactcttctgtagcaatgagcacacctaatacctagatcttggtgtctcgatatgagacaccatatttgtttcctacaaaaagcaaacagagcccgctggagaaatgtttgattcaagatctggatcaaggaaagtaaaaagtaattggggattttttttggtccagaaaacaaggaagtgctcaatggaggtcacattaaaaggacacaagaaagtatgctccctggccaaatttgggacaatttaagtattctaaaaaatagtgatggtaatgggtaatcacaattcagttaaaaattacaaaaacaagttcgtataaatgttaataaagggtgagagtgggggacaggaagacagctcttctttacaaaagaatgcctgctgatacacagagaagaaatgacataattagaaagtcaccgttttgcaaccccagtggaacaattaatttgggcaaaaatcatcactggatgctaaaaccattgggtgaaacatgttgggcactacatgcacacggtcgtctcagagtatcatcttgacacttcgagtatcatttcacagatcatacttattacaaagtagggggaaaatacctttataatgtagagatctggaggccaacaccttgacccagtgatcaaggttggcatcaccagcagcaggacagcctgacgtacgtgccttctaatgggatgcattaaggtgtccataacatcacccatgtagtgttcttgccaaaaatatttaattggagtctaatcatgagaaaacagacaaatccagagtgtgaggcattctacaagacaactggccagggctcttcagaaagagccgagattgtaaaaaacaaactagcaaacaaaaatatcggggcatattttacatttaaaggactcaagaaaaataaccaccaaatgaattgtgtgaatgttgattagatcttggcttttgaaaaaaagtctataaaagacaccatgggacaactggggatgtctgaatgtgggctgtatatgagatgttctttttgaatggttaattttcttaggtgtaataatgttgtggttacatacaagaatatccttattcttaggagaagtgtgttgaagtagttagcggtggtgtgttttgatgtctacaaaataatctcaaatagtggagcaacaataaatataaatacagaaagagcgagaaatcaaatgtggcaagatgagttgtaagcgaagggtgatgggcgttcattattttatttttacaacttttctatagatttaaacattttcaaataagttgcagggagaactttaaacttgctgaagtggggggcctcatatgtgggggagacttttcccatctgcctttcctgtggttcaggctggaccaggtcatctcttcggccatctgcacgttctctgactccttcccaagctgaaatatcatctcgtctcttgtttccactcaggtgaagacccccttgtggacgatcaaaatgaacgagatatcaattcagtcgctggtgttttaaaactgtatttccgaggactggaaaacccactctttcctaaggaaaggtttcaagatttgatatctactattagtaagtatttcccaggtgaaatgatcagttttttgacaaatcattgttggagttgagctacaggcttactgctgtgctaggcatagaggagggacattatgaaaggcgaagtgtgacgtgcatcctcgtagaactgaaagcggaaataacaagatggtttataatgaaagggctaatgggcatgtcacaccccctgggtagagaaggagctcagaggagaaccagaggaagacttggtttcgcagatcagagccaagagagagtgctgggagcagagtgttccaggaggaatgagcacgggggatcctgggaagcgcaagggacatagacccagtgggaccagccaagagggtgtcccagcctgtgcatggtgcaagaggttggaaggggaaaatggagcaaaagggggaagaccttgaatgccttgcagacattccagagcttttccccttgggtgatggggagacgtggaaggtctagaggtcaggtcagcagcatgaccagcaagggaaatgctgaaagtaagttgtctggggatttttctctgacattgctagttagttgtgagaaactattatgtttctgtggataaaatcaggaggaacccagtctagggagctgatgtcatggcaccctgactctgaggtacccaaatccaaggtaaccttttggaaatttttttaaaaaataagctttcaactttagaatattagaattttagtcatttagaataaacttttaaatttgattcacagaaaagttgccccatacccagtttcatttggggtgtttctcacagtactctgagagatatttgcagccaggaaagtgtcccaggagatggcaagagaagagggaggtttgagctcttttttattgtgtgtgtaaaagacccttctgttcctctcttccctccacactattccctgctcatctttccagacctccatactacaagctgtattctagactgcagaggtctgaccctgtctgagccctgtatcacttgctcagccagtgtttccagaaccccaaaaatcctgttcctgtacagggccctgagccaatttcaggtctaggatgacctggaaacaggggtcagagatgagatcccaagcatctgccagactttggctgataggtagcttgagaagtggtgatttattcgatgttcatttcctgagcaaccactatgtgtcaggcctgtgctgcagctggtgtttgtaaagagtttaataaaacatcgtccctgcctgtgtctgtcaggactcataagtaacagaaacccagcttaaacctgcttacttcataaaagggaatgcactgttcgggaacctggaaaacttaggtccagctggactcagaccttcacacggcatcagcagatatatgccccgtccggctctatgccagcttcactcttaggtgggatcctcctctcaggggcccccactgtgctccaggcttccctctacccaggtccaagagggcatctccctgtgggtttctcacaaccaagtccggagagtcgactctgattggttcttgattaggccacacctccagcccctccctgtagctagggagatggatgctctgattggccaggccaggatcacctgtgatccctggaatcaagagtagagctggctcccccatccacgtgggttgatataggagatgtggcgagcgaatgtttgttgctttgctctctgaggatgaaaggcacgctgaaaggcccctttatgttacagaactggagaacccagccgagagggtgcaccagatccaacaaatcctcgtcacccttccccgcgtggtcattgtggtcatgagatacctcttcgctttcctcaaccagtgagtgtctggccaaggggcccctttttgactcaggcctggcctcttttgggagggggtatcttgaggcttttgcagatgctgtttttaaaggagaacatggaaccctcctggatttgaatagggtcccccaaaagaaaaaaaacacagggggaggacttgcctttcccagatgacttgtgggtaactcctctctcctagcctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattggtaagatgccattcctcttaatattattatcatcgtcattgttattgccattgaataggaacaataagaaacccttcagttttcttactgcttgatagtcggtgcttccatatacattttctcatctgagcttcacagcagcttcacatgagagataggtacatcagttaggattctcttggttacaagggacagacatacaactcaaatggcctttaaccaaatgggactttattgatttacttaagtaaaaagtctggggatatatcttcaggtatagcttgatccaggggctcaactattaccacaaggacttggtcctgcagtctccattccttggccctgcttgattctgtgttggcttcattcttggatagccatttccttggtggtcgcaagcaggcaaccagcaactcaagatctgtaactcactctcttagcatcttcaatagaaaaagaccctttccttcccaaatgttccaacacaagctcaagaattgtgtttcattgctgaggtttgggcctggtgaagtaatcaccttggtaaggagatgcaatgctttaactggccatgtgagtcacaagcccatctcaggaagcaggggagtgactagtccccacctcaacttcatgaactgactgtgacacttcctacccttgtctcctctcacctaggagttctcttttccagacaaagtgagctcagtttctttgcgtgtccaacaccatgtcaacaatcactagtttgggacctctgtgtgcctggtatacctggtactacactaggtcttaggagaaagattttagaaccttttcaaagtcagggctttaaaagcttccccaggctaagaccttaaaatgtgaagacaggaaaaaaatctttaaatgtggtgaagacaggaaattcaggacactcaatgacagagaccaaagcatttctactatttctttatttccaattcaggagagcacacagctatatatttaggtattacccacactgccttcagccaggtgcctacaggggagtttgttttttgattgtcaaagcattcctggacttttgaattgccttagtactgtgagcatatttgggcagctgcttcaaagaaggaaggtgttccagcctttgtgtttccttcccacatgcctccctgcatagaaatactgggtcatagtggtgtctgatcacagctctctaatctcgtttgaggcactagggagcaagtccatccctgttctgtaacagaaacattaaacagctggcaagcataatttctggacaaagagaattttcacacagtttttgcaaccattaccagttctcttttcttgctgcaatatatgtaattagtgttctgggaagggacccacagatcttcgtgtacttatcaaagaacaatatacaataaccacacttttcttaatcctatttgtttcccacgagactgtaaaactattaattacatggtaattttggagtcttcaaaaccaaaaaaggagacttggctgagggtctcagcacagtagacaacattcattcattcaacaaatggttaccaatcatctgttgtgggctggattctgtgctgggagtcagagatgtaaccaaacaaggttgacccctggtgcaggagctctgatggaacaggaaacaaatggctccagaagtggggctccctgagccgatctagggaaatcaggaagggcttcctgggggaagtgcagactgagctgagactgcagaatgaacaggagccaacccagtgaggagtgggaagacctggagcattcagtagaatgaaaagcagttcagtgtggtcagagcatagcatgtgtgacaggggaatggtgaaggatgaggctccacaggttgggtagagccaggctgtgaaaaatcttggaagccattgagtttggtcctgattcaggtgacagtggagaatttttcgtaataaaatgcatattcctttaaatggcattgcaaatgtcaactcctttgagaagccttctctgtccactctttataggtcccctctgctcttcttgtctctgcccatttatttcctgcataacactacataacataacttgcaactgtcttatttaatggcctatttacttcggttttttttcttgtccctctccctacaatgtaagcaacatgaagccaggaaccttgtccgccttatctatcattgcatccctcctaccagcacactgcctggcatattagaactcactcaatggctctataaaaaaaaaactggctgattatgtgaattaacccttgcctcaagaagcttataatctagtgagggggtagtagctggtgaaattataccagcacattaacaattaaatctgatggactggattactcagccactatgcccatcatggttgccagtctactctcagtgcctgcatcagtcggggcttttgcatgcagaaagacagggcagcccttgttagcttcatcttacctcctgggatatgtcacctcagctataagacaagagagtcaggccagatgaaataactcatggtacttcaaagggttctttttgttctggcctgtggtccttctgattataaatgctggggttttaccactgccctctggatcttacagaacacgtaagcattgacagacttcaccaagaagacagctcagcaaattccagggctaggagggcactgggggagatatttgggaagcttcgcaaggaggaggctgggagtagttttctgattaggaaggtccccggagtggtcacatggaaaagataggatggtataggcctgcatctgagctgcgggagggcccagaggccaactggactggcatgagaggctgaaggtgctgtgagggtagataaccccccgcagtgagtcccattcccgtgtttccttgcagtgacagcccacacagcgagccaggggccatcgatgaagttgaccatgacaatggcactgagcctcataccagcgatgaaggtgagtgagggggatcctggggacaagggattcttcctggggcctctcacactgacttttgtcagcccaaccacagggctggcccacatagacctcttcagctttccaagtcagccatctgtccttcagaatagacgaagaccccgaaaaaccttcatggcatgccccaagtcctggcatgggcctgacacagagcagatcctcataggctcacgctgtgttcacgacaccccacacctagcccacttcattccttaatgtgtcctgcctggcccaggtacaaatcctaagagacatgagttccctaagtagaaagcaagctctgttcctccatccttcccctttgagggtctgctctgtgccaagcctgtgctgggacttgggcacagggatgaacaagacgtcggtccttgaggaactcccagtctgtcaccagatcttgacaggttggaagtagcttctcatggtgcaaagcgataatgccagattacaggtgtgtctggtgcattgggcaccctggagatgaaatcaaagggtgatgatcctgggaaatgtgtggtgagagagagagagagaaaggccagtcaagacctttctccagattcctccaccccttccagacaaggagaagagagtcggactagtctctagggaaactggactgtgtagacaagcaatctgaaccatatgccaacttatccgtcaggcagagtaggcatagtgccaagggcccatggtacttgtagaggtccactaaaatgttttaatttcttttaaaatcagaaaaaaaatgaacacaatatccagtctggattatatttgtctttatactaatgcagttgtaaaatataatttttaactttttttttgaatggaggaagggacccatgcaggcaaaagggcctaggacccttgaaagttagaatacggcccaggatgcaccaagcacctgggatagttttcctttttaaacatcatggcttagcagttctcttacttgtcctttgtgtttcttttgtgggaccaggacacgttggccaccacatttgtcaggagagcagggcaggcattcaggtgacagttctgggaactggtaaaagagacaagactgacagatgggttttcacattctagtaggactatttcagttgctaatgacagaacccccaactcaaatcaacttaagcttaagagagagtaagttcctatacctgaaaagtcccagggttgggatggcttcaggcacagctggatccaggagcaagggtgatttttgtcagcactttgtctctgtcttcttgttctgcttccctctgtgctggtttcattctcgtgtaggatcttccggtgcagtggtctctggcaattccaggctttcaccatcatcttacccaaactctcagtggaaaagggcttcctttctataatggttccaagagaggtcctggggtggagtctcattggactgccttgagtcatgcacccagtcatgatccagtccccatggcctgagagggagctaatgggtcagacccgggtcacaggaacagaaaagcaaatccagatgtcacgttcagcttgatcagactcctgagaggctaaagtcatcctgaactgaggaatgtgtcctgcagaggctttgtttggagatgtgaaggccgccaccttctgcttattcctggtgatttgcttttctctttcctcctttttttcttctgccgaccacctccagttctcccctccctctatcccttttaacagccctcaccctgtcctctccatctgttgctctttttatttctggatctccttctgtccatctctttatctctccctgtagcttgctctctctctctctctctctcctactcctgtcatttcctctcctttgtcttgaccgaagcacctgccttcctgggggctgaggtccctgtcagtccctttgctggtttttccacagctcctcgggctgatgggcagaaggcttctctggacaccaggactgaagatgaggagggacagagagaatagggcttgctgggtcagcgaagaagcagccatgggactcacccagtggggcttcctccccataagaaccaccccccagaaagtgctgcctcccacttctcagggtaaaggttcacagtggcccccagaatgcatgagtcagagctttgggtccccctccgagatgatccttcttctttttgttctttgtaaggctgctggtttctgggaatgacaaaggcaggaaaaatcattctgggaaggaagaagccacagtctgggagagccagtttcatgttccctgaaggctctcaaagtatcctgtgtgtattagtggggggtattgaatcaggggcactctttggtggaaaatcaattgcattttctaaatgttacattcttgccatccctggccaaacagtggcagaatagtgagctgcagagacagtcaaggggtcactgtgctcagaaaaaagagacctggagttgaagcacagagggagtccttatggtcatgtaatctgaggcaagccacatcacctctggcctctatttccttatctataaaatgggaatgacagcaccaagcaaattatggcatgggttaaaatgaggtgacatatgtgaaggagcctagcacagtgcctgggacagggaggtggataagaaacatcaatggactctgtatcaaacagacatccttcctaatcctgatagaaaaactgagtcctggagaattttcttgacctaactggcattggcagttactggtcattggcaaccagaacctcctgatttgtttacctgtttcctcttagacatttcatttaggggatcatcaatatctgtcttctttgctcttgacagcacccggtatgaatggaatccagcaggcctcaaaggtcaaatcaggcagagaaccatgagtccaggtctttgccatgcatgaatcagccaatgaatgccaaattgcaggaacaatttagttgtttgtgtatctgttgcctttcttgtctcaaagattctgtaccaactgggcgtggtggctcacacctgtaaccccaacactttgggaagttgaggtgggcagatcacttgagcccaggaattcgagaccagcctgggcaacatggtgaaactccgtctctacaaaaaaaaccaaaatacaaaaattagccaggcatggtggcatatgcctgtggtcccagcaactcaggaggctgaagtgggagaattacttaagcccagggaggttgaggctgcagtgagccatgattgtgccactgtactccagcctgagtgacagaacaaggtcctgtctcaaaaaaaaaaaaaaaaaaaaaaaagattctatacccaactgatgcctagtctcctgtcttgagtctgataagtctggaaattccatagtgcttgctctttggtctccaagagttatataaagaaaccatggttaggccaaggatccttgactaaatgaaaaaatgaaggcagcctgtcactaacaactttattaattggaagctaaatgagaaacaagattattagattataaaaccactaaaatcagtgacagaggcatgttcatatgggtgatatgtccattttcaattataattgtgccaccattctcttactgatattttcctgaaatttttgaggttacctttgactcctccccctgttggtctgtttacaatttcatataaatggtattgtacagaatacagttgtttggctctgtcctctttcactctgcataatattctgagattcatccatgtcgttgtgtattaaggtgaggtttttgatggtattaaaatgacattagttgatttatgcacaaacaccccagttgtggagtcatagccactccttttcttttcttttttttttttttttgagacagagtctcgctctgttgccaggctgtagtaaagtggtgtgatctcggctcactgcagcctccgactccctggttcaagcgattctcctgcctcagcctccggagtagctgggattagaggcatgtaccaccatgcccggctaatttttgtattttttagtagagacggggtttcaccatgttggccaggcaggtctcaatctcctgacctcgtgatctgcttgcctcagcctcccaaagtgctgggattacaggtgtgagacaccacgcccagcccactccttttcataagaaattaagaacaatagaaaaaaagaacagtggccaatttcttatacttggtgtatgctcctaatccctagtaataaacatggtaaactggcttgcggcatttggctcaggccttatacctacgaaggaccctgccttcttcttaaaaccactttattgagttatagatcacacaccacacaatttacccttttaaagtgttcagctgagtgatttttttgtgtattcacagatatgtgcaaccatcaccatggtcaatttgagaacattttcatcatcttgaaaagaagccctgtaccctttagctatcactccttacgccctcccatccctaccccccacatttctcccagccctagtcaatgcaactgtaagtctacccactgtctctatggatttgtctattctggacattttatataaatggaattatataacatgtggcctttctcttagcacagttttctaggttcagccatgctgtagcatgaattagtacttaatttttgatggctgaataatattccatcacatgaaaatgccagactttgtttatccatttgtcaattgatggacatttgggttgtttctacttttcagctatgatataatactgctgcaaacatgtgtgtgcaagtttttgtatagacagaatttttcatttctcttgagtatatacccaggagtggaattgctgggtcatatgctaactctatgtcagtcatttaaggaactgccagactgttttccaaaatgaccgcaccattttgcaatatcatcatcagtgtatgaggattccaatttatccatatccttgctagcacttgttactatctgactttttgattcttgccatcctagtggatgtgaagttgcatcttattgaggtttggatttgaatttctctgatgactgataatgttcatcatcttttcatgtgctttttggtcacttgtatatttttcttcagatcctttgcccatttttaaatttggttatttgtgtttttattattgagttgtaacagctctttatgtattctagatcataacagctctttatatattctagatctaagtcccttatcagatatacaatttccaaatattttctcccattctgtggcttgcctttttattggtgataccctttgaagcacaaaagtatttcattttgactgagttccattcatctattttttcttttgttgcgcatgcttttggtgttatatctaagaggcctttgccgaatccaagttcatgaggatgtattcctgtattttcttttaagagttttagagttttaggtcttacatttagatctttgatctattttgagttaattttggcataaggtaatggtcaaactttattcctttgtatgtggctctccagttgtcccagcacgattagttgaacaaaattattcttttccacattgaatggtcttagcacccttgttaaaaaaagtcctttgactacaggtgtatgggtttatttttgaacttgcaatgctattccactgaccaatatgtctatctctgtgttggtactatactgtcttcattactgttgctttgtagtaagctttgaaattgggatgtttaagtcctccaactttgtccttcgttttcaagattgttttggctattctgggtttcttgtgattacatatgaattttagaatcagcttgtcaatttctacaaagaagttaggcaggattctgatagggattgcattaaatctataggtcagttggaaatatcaccctcttagtagtgttaagtcttctgatccataaacacaggatgttttgccaattatttagatctttaatttttttcaacaatgatttgtagttgccagagtggcaactacagagtgccttttatccttttgtcttgaaaggatattagattttgtcagtgctttattcctctgtattttattctttttatgctaatgtaagtgaaattgtttccttaatttcacttttgaattgttcattatgagtgtatggaaatataattgattttactatactgctcttgtatcctgcaaccttgctgaacttattcatgcagtcaaatagtttttagtgatttccttatttttttaatatataagattatattgtctatgaatagatatatttttacttcttttccagtttggataccttttatttctttttcttgcccaattggcccatctagaatcttcagtacaacactgaagtaatgagagtgaacatccttgtctaagtcctgatcttatggggaaagcatccagtatttcactgttacgtatgatgttagctgtgggtttttcatagatgccatttgtcaggttgaggaagttcccttctattcctagtttgttgagtgttttatcttgaaaggatattagattttgtcagtgctttttcttcatctattaagatgattgtgtgatttttgttttttattttactgataagatgcattacattaattatttttagatgttaaaccaatttggcagtcctgggataaattccacttgtgcatggaggatagttctttttatgctactgcatttggctcgctagtgatttttttgtttgtttgtttgtttgtttgttttgagatggaatctcactctgtcacccaggctgtagtgcagtggcacaatcttggctcactgcaacctctgcctcctgggttcaagtgattctcctgcctcagcctccagagtaactgatattacaggtgcccgataccataccaggctaattttttgtattttcagtagagacaggattttgccatattgcaggctgatctcaaactcctgacctcaagttatccgcccagctctgcctcccaaagtgctgagattacaggcatgagccaccgtgcctggccgggtttgctggcattttgtagaggatatttgtatccatattcataagaaatactggtctgtagttttcttgtgatacctttgtctggttttggtatcagggtaatacttgcctggtgaaattagttgagcagtgttcccttctcttctagtttttggaagactttataaggaattattactaattcttttttaaatgtttggtagaattcaacaatgtagccatctgggcctgggcatttatttgtgggtagttttttgatgattgattcaatctcttgttataagtgtattcatttttttttcttcttaagtcagtttcaatagtttgtttctttctaggaatttattaatttcatctaagatatccaacttgttggcatataattgttcatagtacttctttatgatcctttttctcctgtaaaataatggtagtaacgtcccctctttcatatctgattctaatcatttgaatcctctctcatgttttcttggtttatttagctaatggcttgtcaatttcattgatcttttcaaagaaccagcttttggtttcatgattttctctattgtttttctgttctctattttattaatttctgctctaatctttattatttccttccttctgctagctctaggtttagtttgcacttttttttccagtgtcttaaggtggaagtttaggttattgatttgaggtttgggtttttttccctaatataggcatttacagtcatacatttccttctaagcactgctttagctgcatcccataagttttgatatgttgtatcttcattttcattcatctcaaagatttctcttttgatttttttcttcaaccactagttatttagcagtatgctgtataatttttgcctatttgtcagtttcccagtttttttcctgctattgattcctactttagaagaaacttcttctatagaagaaatcaataattttatcctactgtggtagaagaacacattttgtattatttgtatgattttgaattattgaggtttgttttatggactagcatagggcatacccaagagaacgttccatgtgcagttagaaagaatgtatagtctcttgctgagtggtgtgttctatacatgcctgttaggtctagttggtttatagtgttgtttaagtcttctatttcctctttgatcttctgtctagttgttctttccgttattgagaatggggtattgaagtctctaacaattatttttgaattatctatttctttctttgtttttgtccatttttgcttcatgtattttgctgctcttttattaggtacattttgtttataattgtttttatcttgatagatcaaaatttttatcattatgaaatgctgccatttatctctagcagtatttttagttttaaagtctattttatcgatattagtatagtcattctagctttcctgtggttccagtttgtataatacatttttccatcctttcactttcactctaattgtatctttgaatctaaagtgtgtcttttaaattattttattttatccagtctgttaatctctgcattttaattggattgtttaatccattcacatttgatattaccacttatatagttggatttttgtctgccattttacttcttgttttctgtgtgtctcatatcttttttgttcctctattccttctttaccgatttcttttgcatattttctaacatagcatttagtggatattttctaatatagcatttaaacttctttaatgatgttttcactatatttttgagttatttttagaagttttatttaatttttgatggacagataattggacatatttattggatacaatgtgatattgcaatacatgcatacgttgtgtaatgattagatccgggtaagcagtatattcatcatgttgtaaatatattgtttctttgtggtgtgaacattcaacatctcctctattccagctattttggaacatacaatacattattgttaactatagtcaacctactgtaaaatagaacaccagaacttatttatcctaactaactctaacattgtacctgttgagcaattgctccccatatcccctccccttccttcctagcctctgacaagcagtattctgctcttactatttttgagttattttttagcagtttctctaaggtttaccatatacatcttatttgaatgagcttctatttatactagcttaatttcagtgacatatggaaatactgctctgtgggatgacagtggttttggtagggttctccttccctgagatgccagtgggtttggtagaagtctctttcccggatcctttccggctgttaatctctactaattgctggatgattgctattctttcagcagtgcccttggtcctaaattgctctacagattaatgcagtcaaattctgtccccattatagggatagtttctgaagtcaatgtttgatatttgttctgatcccaggagttctcctggctgtcttattccctggttctcctctgctaactatctgggttatagtctagcttctatattcgttaaattcatgaaccatcactggattgcccttcaacacgacctccactgttcttgagagtccccttcgacttgaacttctccaagctctgttgcaactgaagtcaattcctttgggataagattaggatctgtctgttttacgggatggttctcccccatgggaaaatctctgagccaggactctgagactggggatggagacaatggcatcttctgagtgatgtccccactgagtgctttgtggaggggcagccagagatcctcttaacttccctctcctgccatgcaaccaccacctcacaagctggggcaaggttgatagaacccccacattttcagtggtgccatgcccaaagtacagccaccattccatgagtaggggttgtgtgaaagaatgaagccctggtctctccactccactcacctgggacttagcctcagcaacaggtagtgggagcaggatgagaatcactgagctcctgctccttccaggaagaaagccctgtgactagaagatggtaaagggagaggaagccctgtgtgcttgactgcagtcatctgggttggagcctccatctccccaagcttggagcaggagtagagggagggagcagtcttggttcaagtaacagagattttcacctttctcactaaatttttatagattttcttgaatagatgtttcttcatttgctttttgcccttaggaccatttccaggggcttgaaatatttctttttctttttctttttatattttttctcgagtttccctggggagctcttcatgctgtcatcccagaagtcggtctcactcctttccttttaaattaaatctaaatctcaatatcagctggtgccaccaccgaatgcaaagaaagaacccaaggtcatgagtgagaaggggagaaaagagggaccctgtaaacaggccctggcttctgtcattactctcatcacagggaagatgacggagaagagaaggtacacccacattctcagcctttgatacagtgacttggcctctagtaaactggttgcatgagattagtgttctcacttctggggatgaagtagggggtggggtaggcagagggacataagtggtattgagaggaatggagccatcccctctttcatgcaggcaggactcatgacctataacagagttctctggaatggcatggctagagggagggatttgatgggtagagaagcataaatgtccaaccttcagattctgaaataaaagcaaagcttcaacatgtcttttcatctccggaaaagcccatgtctagcccatgctagttcagaggccgcaccagtgtagccgtctctgaaccactgctgcctccagcctctcccctccaatccctccactgctctgctttgccactggagtgattttcctaaaatgtgactccagccaggcccctactgagacagtctcaacctctcctgtagctcaggggctgggctgttcatctcttccctcactgtagagcccacagggtttttacctggtacaattagcctctcaatacacaggagttgaattgcatcaaacacagagcattgtatatctatatagtcaatttacactgtacagatgcaaagaccttgtggcaggaataagcttagcacaattcaaaaacatctagaagcctctattaatgatgtctgggacctgagctcagatgttagctcatcactgtatctactggtgtgacccaaccctaggcccatcattcaacccagcttcagttccctcatctatgaaatgagggtagtgcctcaaatgttgttatgggattaaatgtgataatgtaagtagaacacctggtaccagtaaaagcttaatttgttcatgcaagcaataaatatgtattgagtgcctgtttgtcctagggtctgttctaggagtcagaatacagtaggaaagaaaagaaaatctctgtcctaatggtacccacactttggtaggaaagattgatagtaaagtttcaaaattatatgtgtgtatatatacacatatgtgtatgtatatgtgtgtgtatatatacatatatatagtatatatatacacacacacccataccacaaacacataaatacacacatcatacacacacacataaatttcaggttgtgataagtgccatgaagagaaataaagcaagagaaggtgttagaaagtgatttggcagttggggctcttgcagttgggagcggctgggaaaggccttggtaaggcaatgacatttgagtacagacctgaatgaaattagcaaacggcacatagcattaatacatatttgttgagtgtggatgaatgcaaagatctgggagaaaggcatcccagggagaagcaataggaagtacaaaggccctgtaaagggaagacacttgtctgttttaaaagcatcaagaaggctctgtagctgggggtggtggctcacgcctgtaatcccagcactttgggaggccaaggcaggaggatcactcgagtccagaagttcgagaccagcctggtcccccaggctgtagtgagacccccgttgctacaaaaacttaaaaaattagctgggcatggcggcatgtgcctgtggtcccagctactcaggaggctgaggtggaagaattgcttgatcctcaggaggttcaagttgcagtgagtcatgattgcaccactgcactccagcctgggtgacagagtgagaccctgtctcaagaaaaagaaaaaaaaaaacctctatgaatatttatgctgaagtgtttagagataaagtatactgatgtttataacttaatttaaaaatcattaaaaaataagacggatagaagggtggatagatatatgataaatctagcatcgtaaaatgtgcatagcggaatttagttgtgttccatgcatgttcactgtgaaattctttcaattttactttgtgtttaaaaaatgtcatactaggatgttggaggaaaaacatcaagaagcttagtgaggcaagagcagattgagctagtgaaggagagagagagacagagaagatgaggtctcagaggtctctgcgattgggatcctggagggccttatgagcagtgggaagacactgggattttgttccagcctccatgggaagccttctgaggattttgaacaggggagtttcatgatgtgattgtatgattgtaaaggaccctctaggctgctgtggggagaagcggctctacctaagcaagtatggaagtgaagagggtggcatgggaggtggtgagccatggtcagatccaggggacactctgaaggagtcgctaatggatgaggtgtgcagagccatgccagggcattggcctgggtgagcaggtagacagcagttctgtttcctgagatggggaagatgagggaatgaagtaagcttgggtaacagagtgtgggagagtgatgagggggagaaacatattctgtttcaggcacgagaagcccaaataacagacttagtaatcaatgggagctgttattactgtttccaccacacacacttatgtaacgacgtctgcaaacacacgtgctttctctgagctggaggttcgccctgttcctcctgttttctttccctcacattgtctgctccccctgctgccccactctttcaacttcaggctgctgtccagtgactgctggaggctctggtgatggtaaaggcagaaaccggaggcagcccctctgtgcccctctgagtatcagaaaacctctgcttaggtcagcgcctttcttagtttggggaatctgggtcagaggaagtccctgggcgaacccaggagcacgcagctgtctgggctcagctcctgcccttgcaaaccctccggcctttctgactcttgtaacgaggcaggcagatgggctagcaggcagttccagcacacggccggatgtgagattcaaagatgctgcagagagagggaccaagatctctgtttgttttactgagaatgtgactctgagtcaagatctgagttagtctgacccatttagtggtgctgtcatttccccacctccttccctccttccttctctcccaacacccaggttagaatagcatttaaagacatttgtcgggtagctagctggggaagctgacttgactgtttgaggcctgctccctgcagaaggctgcctcagtcactaagagctaaatacatcccaaagccactgcatctcatggggacacaagcatggtcttcttgagccagttgcttccagaggggagccctggtgcatgtgtgtggtggggagtgatggggagtgaacaagggagtttcctcctcctgctctttgatttttccatgccatccgtggcccttagaagtgcaccagcctctggtaacaacatgtgtgtaactcttatagggtactatgtgccagacactgttgcaagcacttcatgtatattcactcacttaatccttctaataaccctgtaagataggttctatttattaccatttccatttaacagatgaggaaactgaggcacagaaagaaaaactaagtatcccaaggtcacacaactaaaaaatggtaaagccaaatgttctgagcttaactgtgtgatggacaggtggatgaatagatcgatgaagacgagattgtccacagtgaatggagcagatagagagccccaagaaagctcagcatggagaagctatctacaggctagagagagggcaggggttgcttttgttactcttctgttctattaaaataaaaaaaagtaagaattataatgttaaacctctttgtgcttactttaaaatattaaaacattaatacctatacaaaatcagttttctaccacatatggacacttcttagggtagaaactataaaacaggtggaataaactgtaggcacaatcccctgctccccaaaacgtctcttccccaaatatcactagttgtatggtccttaaaccatgcagtttaaaacacttaaactctctgcagttcaacgtctcttctctggacgcatcccataggccaaatccattaataattataatcacagtcatgacagctgctgtcaaccgaatacctcatgagtatctgtactaagctatgcccttttgtacaagaacttttgtttgtttgttttgagacagggtcttgctctgtcacccaagctggagtacagtggcatgatcatggctcactgcagcctcaacctcccaggctcaagtgatcttcctgcctcgggccctagagtagctggcaccacaggcacgtgctaccacgcccagctaattaaaaaaaaatttttttttggaaatgaggtctcactatattgcccaggctggtctcaaactcctggactcaagcgatcctcctgcctcagcctcccgaagtgttgggcttataggcataagctaccacgcccagcctctgctcctcttataaagacaccagcactaggattatgaccccaccattatgacctcatttaactttaatcacctcatttacattaattaaagcctctaaaatacagtcacgttgtgggtgagggcttcaacatatagatttgaggcagacacagttcagtccttaacaatgagctttgaagggtctgggtacccttaaaatcctgtatcggattttgcagattagagtctgcatacatgatgtggcctctcaaaagattaaaaattactaaaagtattataaatgacaaagaggaaaagggtgcatagaaaaatagaaatattaatagaacttgtgttaaggggtggaagaaaacgaaaattctacaatattgtcttaatgagcattaaaaagtagagaacaagaagggcagtggaaaaggagcatgtatcagctccctctttacattttgagggtttgatggttttcctgaggttgcagggtggagagtggatctgaggctaggaccccagggtcctgagccccagcccaccaggcgttctgtccatgttctcaccagctgtgcagtctatccttccccagagaagccagggccatctgagtgaggctcctgagctgccactttgctgacctcagagacgctttttcccttgatttccttccagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatgtgagtggagtcgagaattctgtgaagaatgccgaaatagattagtgatgtctgggatgggcaccgtaggggagtgctagcttgtatgccagcaatttgctctccttgatatcatacgcttgttcttctctaacaatgggtaatatctaacttccctttaaatggtgatccacttaacggatatccaaattcctccttctgagcacacagaaacggtgttgggtgcctctggcctacatcctgatgcagctgacagcccccagggagtgccatcacccaccagggctctcagtatccaggggatcctgccatgtgcctccacctcctaggcctcccctgcctacggttctacactccagaggtagctctcttaggggatgggcagaaacatgcccttgtttctgattaatagggtactattttttaaaaaataatttcaggggttaatgaaaaagagccctgcatcccaaatgcctagtcctaccacaaaaagtctgcactttccattcctttgaaagccatggaagcttccagtgcacaccttccttgggagctctggtcaggctcggcagaacagatttaccatagaggcagccaccaagctgagcctcaagggaaggggatcaacagcccacattgtgatgggagagagggggtctcagccagagaaaaggccagggccaagcagactgccagaggaatgccatagtggagggcccttggcagcctcccgaagtccccagacctctgagatcagggacaagtcaccacagcagagggccgtggaaggaggccggcagggcaccccaacaagcttgggagccacctcacagtagcccaagccctgggtggggaggtgaggggcagaggcagcttcttcctcccttgcttagccagaagccatttctcatgaagtcacacagagactcagcactcagccctcggtgctcagcctgcggactccatccccccatttctccaacacaccctgcagcatttagcttgtcctagcctggagctgcctgggaatgaacaagctagaagagaaaaaaggaggaggtaggtgtgggacagaagagggtcccagctgcggaaactgaccaggagtgttgcaatgggcatgcgtggtgggaaggcacccagtgggcagtggcctagcaagcgctgtgggcacaaagtaaccataagttgtgttaattcagcccctcagacacatatcagggagctctgtatatgctgggttctttgggggaaggtgcctccaattcatgtctgtcttctccccagggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccggtaggatatgcggattcattttttccctgctggtgtcaatcctgttcatgtctgatttgggagaagcacaagggcagagaggagagaaggagcctactgcagccccttgttccccacaaaatgaaatgggcacactgggcgggctggctggcattggcccaagaaggccaggtatagaaccatccagcctgtgttgcagggaggaggaggaggaaagacatgtgttgggaacccagtgcttttttatttaaaataataataatgtgtgagagagatacaaattggcaagtatttttcctacctgtgtccagttcctgcacctccttccagctttctgttgtagaactgagttgttatatttaaaaatgtaaagctcacatattccctgaaacgcgctacataaacagaaaactcacacctactcatgtgttgaaggaaattgacactcgactccacccacttatttggagggagcagtattaccaatttcttcgctccctatgtgtgggccaggctgtgtcacataacctttctaccaggcaaggagctgtgcatgtccttctgagaacaggtataatccaaagtatgtggttattttttaaaaaattaatgaggaaataagaagaaaagaaaagaaaagctgacagtttctcactgcctttttagtcacactctcaaaatgtcatattctatgttttttccagtggaggggtcatgtggtcagcccacacatgtaggtatttgcagatagaccccaaaaaaatcagtcacagtgggaacacacaatttatgaatttatttcagcaaaaatcctgatgcctcttttctgcaaattccattcagttcagcagatagctcggggcactgtggtggaattgagaaggtcagggaagtggaaggctggcgtaggtagacaaagaagttatggtcccctgacttctaggaggaccatatcttctgcctctcttttcctctcccttgtcccccgccctcacctcctttgttcttgttctttctttctaagtactgcttcctttccaatacctatgctttggtcctgctggggcacccacaagcactgcttagcttggctggtggcactaggatctgaatcactggtggtccctagtcataatccattcccaacacacggtccctctccctctcccctcaccacttctagcccttcagactcttggtgacctctgtaggatgcagccaaatctcctgtgtatagaacctcttatcttcaaggtgctttcaaacccacttgaagcaaaggtaaagggtgggcaaaggatcttgcttaaacccgcttcacagattaataaagtgggcttgagagaggacacaggaaagcacgcggcagacacagggcaagaactcaccttcctgaaacacaacctaatccccttttcaccacaccagagcctccctgaagtgggaaaggtaccaaatgcacaaaagggctgtccagccatgcagtgtttactcttgaatgactagttttccaagatccaaaaaagcctcgcagaaggagccctcttctggggagattgggggttgggtggcaacgttagagtgtcttcagttcccaggggaccccaactgtgcttgcagggtgctggtaactttggtacagtcaagcctcaaagcttcagaccaattagaagcccctcagaatcatggaaaagtctgaactgcttcagagggtatcatgagcccaactaaccatcaccaaagcgtttccagggttggaatcctgtaggccttgacttagcatgtagaccagatgcattttgcggttggcggcacagctgtctgtggcctggaagcaccgtgctccaaatgctttcatgtttacagattagacctccccctgctgctgagctgtgtgctgagccagctctttcattatggaattgtagggtctggctgaatgaggctttactgtacccgctccttagactagcgtgtagtgtgtggcatggggttgactcacccattctgagacttgccaggcttgacctctgccccatgcccctcgccccctggctcctttgcagagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagtaagggccagcgggaaggcaggctgggcagccaaaagccccagagggcagcgggtgggaatccgtggagcggggagccaccttggcctttatgccaggctcatggctaagccagagaacaggagagtgagtggcctccccgtcccttgctgggcttcccgtgggagtggagactggttgggagcagccactgctagggttccgatagaggctgaacacccccagtgtccagggctggagagggcattggccagattatggggctggggtaatggcaggtcactacacaaaatgatacgattcagtttttgactcattcattcactcattcattcatttctctcttcattcatcaattcattcactggcaaatattgattgagcatctatcatgtggccgtcaccatgctagccaccaacagtaaaatggagatctaaaatggactcaggccctgcccacatggagcttacagtttagagaagaaagagacatcaacaaacacacacacacagttgtgaaatagttgtttggttgggtgcctttaaggaatggtccaaagtattttgagagcctaaaatgtgaggattgcacctaggcagggagagacttctctggagaggacttgacctgagacccaaagggtgggcagagctaaatagccgaagctgcaagagaagaatgttccaggttcttctcaagtgcttagagggttggcttttgtttgtttgttttgtatttggatgaaaaatctatatgatttttacatttgccaaatgaatagaactgtgatttgtttaacagtttgcatagccggtttcatgggttttttgacagttctatcatattttgagaagtttccattttttttgtctctggaatttggtgtgggggcccattatgtaccctctccctagtgttctctcccacataaggtaacagagacaatcagaaccttctggtctgtgagaattttactgtggagagtagcctttgaatcgctgttcaaaaggagaaggaagaagggcagggagtcatgagctgtgttctagaggaggccaggcagggttcccagggaatacacaacacagaaacagctcacctagcaatgagtactcctgttcacaccagcaggctctagtttggccccatgcccattcccaggggtccctgaagatcagtgccttccgaggaggcatgccagctgctggtcccccccatacttgaggaaacatcaccctagcacccaccatcatctggaaactctaccagtctagaaagttctaccagttatgatagaggatggcctgaggcctgccccagggccctttacatttataaagaatcaaatgcagtctagaaaactgtttctaaaagtagctctcacagcagattagtcccacaggatgctagggagtgggtagggaatacatgttctgtggtcagcaaggtttggggaatgctgctctgacaaagttgagtggcttctctgtaagacttataaaacctttaaagcaggcacccccagcccccgggccatggatggatctgtggcctgttaggaaccaggctgcacagtaggaggtgagcagcgggagccagcattattgcgtgagctctgcctcctgtcagatcagcgggggcattagatcttcacaggccgtgaaccctgttgtgaactgcgcatgtgagggatctaggtagtgctctcctgaggagaatctaatgcctgatctgaagtggagcagtttcatccgaaagcatcctcctgaccccccatctgtggaaaaattgtcttccacgtaaacggtccctggtgccaaaaaggttggggactgctgctttaaaagatgtgcactgtgaatctccaagaaagaaaacagggcatgccccatatcccagacttctgtgacctttattcatggagcgttttgcacgacctgcccctggaatgcacttggggcctgctgcatgtgttctcagtttgcagatggatctgcaccctgtctagtttgacagctgccatccaagaccccctttcactaacagaggtcaaatagggaattgtagtaaatgatatgtaagtaacccactgccactggagagtttccagcctcagcattggctctgatgagcccttgactttgcaggctgcaaaggggagtggcagctgaagaaccccaggtagtaggccgagtgacccaaatttctttggtctcaaaatgtcccttaggatttagatgtgaacccacttaaagaggctgtttggggaacttgcaacatgaccatccaaagtgggaagatcgaattggggaggagatgaaaagcaatcacggtccccactctgtctcccagggcctctctgccgctcagctctggagactcacagcgccacctctcggactaatgcaaggctgcagcctaaacaactcagctgatctttctctgaacttcctgtctttctgcttactctgctggggtagagtggtggggcgggtggggatggtggtagaggggcagtaattacattttatgtgttaaagtttcaccatgcagctcatgctggactagagcaaatagagagtagtgaggtcaatagggggcttccttcaagcggagtggttgatgatagggcggctcggctccaggaaagccggctgtgtcactgcagggctggcacatggcagagatggggagaggtctgccttccctcccttcctgcagaaaattgcccccacagcgcctccttttggataaggcacaaaacaccctttcttaaagttgccggtgttctggggcaacggatgaaacatcctggagaagcgtacaagctaatattagccattagccagacatccatagtcccctaacaaaaaggacaggctgtgacaatgcggggagcaagagctctgggccctgaccccagccagattgaagcctgccatgtggcctagggcaggcaggaagccacctgcagacaggggagggagagaatgtaaaagaccagggtgcagaaaggggccggccccagcatctccaggctccaaccccaccatctgtttcaccagactcatactttttatttattttttttaggatttgcaataaagcaagcctgtcttaatagtcatcattcctccatgaggttatgcacggcacctaccagtggtggcttaggcagtatccctcatggtgccctcgatggccaagccagctgggctgtggctcagctgagcctgagcaggtcctctcatgtctgtcggatgcggaggcatcccagtcaacagtcatgggaacccatggggctcttgggctagaaggattttgaaaaccaccacctggcagtttacaaagcttcatcacatccattatctcaccccatattcacagtaaatgtctgggattgtaatagatgaacaaaatatggtgcagagtgattgagatttgctcagggtcacacggccagcaactggccacagattctttttactcaaaagtccggggccctgtggcctgtcccagggctcttgggttaaatgctgccttccagctacagcaccaccttgggcatgaggggacgggagctgagggaagctgccctgtggcatggtgagcccgggctgccctgggtggcagggggctcgctctctctgagtccttcagagtgctcaatcagagtgctctcctcctgatgagctctcagatattataacatcctcgggaattatgtaggcagaagaagatttttctggcctgttaaaatttccactttttaaaaaaattttctgattataatacagagaagagagtagcagtccctctattctgggatgtgcgctgtgaacattctgatacataatctccaagaaatttttctgtgagcaaggatttttaaaaaaatactgaactgactgggttcagacttgggctatgctgctaattagctgtgtgaccttgggcaagttacttaaccagtctgagcttcagtttcctcctgtgtgacatgagcataaaggtagttcctaccttagaagtgtgaggattaaatgaattattagggggcagggtttggattggtgctcagtgttagctattattgctattgctattgtcattcgtatttttgagtgcttactctgtgccaggggtcaggccaggctcttcacagggactgtatcatttaatgcactcatcaactccctgaggtccatattataattatctgccatttacaaatgaggattctgggggctcagagggatgagggaacttgcataaggtcacatagcaaggaagtggcagagccaggatttgaatccgtgtctgtctgactccagagcctgccctctttatcagtagtctgacctgcccttatgaaatctatttcctgtgcaaggcagcatgcaggggatatccacattggttctcccatgtggttataagacatcctgaggacttaatctccatccctgccgcgaggcttctggggaacctgcctacgaagggaagctgcttagcagacaggaaggacctgactccaggtctccagactgtgctgaccccagctccctctgtccccaggacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtgacctgcaggatgggccgcgccgccgtggcccgctgtggctcaccacggcccagggtggccttggtggcttccacgtgcttcccagtgaccctggccttggagggcagaggtccgtctgggagggtgtgtctgtgcagagctgaggcccgggcgctggctgcagctcacgtccagccatgggaatcccacggacctctcgcgtgtcaacagacgaccagaggagtgctggagctccagcagccccaaccacagcattccctaacatggaggcaaaataccacatggcttctcccgcatatcgtcactggaaacttcctctctcgacattctctctacatacgtatatgtgtgtgtatatcgatgtgtgcatatatacacatgtatacgtatgtacgtgtctgtaggtgtgtgtatatatatatatatttatgcatctatatacatatactagatctggacacacgcatactaagtgtatatagtatctcctttttctttttatgaaacttagatttacctcagatccatgccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatagatcaatgtaaaaacaaatacctaactgtacagtgagtgtgggggaaatgtagtaacctagttagtagtcttcaatataaccaattgtacaaggggaagtggtgtttacctacttgttcatcaccattattgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaa

SEQ ID NO: 759 - DNA, 63972 bp, Homo sapiens
acacacggagacgtgcgcgcacacccacttgtgcagagacacgcgcacgcagacacgtgcgcacagagacgcacacagacacacgtgtgcacacaggcaaacaggcacgcgcagagacgcacacagacacgcgtgtgcaccacaggcaaacagacacgtgcagagacgcacacacaggcacacgtgtgcacacacagagatgcaaacacagacacacgcgtgcacacactgacgcgcgcacagagagacacacgcgcgcacacacacgtctcccccgcgccagctccggctccagcagccttggggtccccgcccagacccgggctcctgactccctcaacgactgcatctcgcggggcgatcccggtcgggttccgcctgagccaaggccccgcacccaaaccgagacagcggatccagtagcccgaggcccgcagctgggcgaaggaaccgggactcaagagtagcctccggcaccgagccctccaagaaaagcagcccgggaccccgacaaccgtggacggagccagggtgggtcatagctcgaggcatcgtcaacggagggtccttaagagaccctgaacccattcacccgggcaccagagactctgccaaagcaccaattcgggcaggtggtagcctcgaagctgggaggctgcatctcaagcctcctcctagatccgcggtggaccctgggaaatgtagtccagagcaagccaccacctaaatgcgccgtggaccctgggaaaggtggtccctcgcaagtcaccgcctggacgcaggtaacctcctagatgcgcggtggaccacgggaaatgtgatccggattttctgggtgggcgtcgtaagcgcggagctttccgggtcgcagtgactgtcctcccttcgagcccgccagatcagaccctagaatgtccggcagcagcccctcggcttagaactgagctggggtcatacacgccctctaggcgcgagttggtgcacgcgttagagtctcaggggagggagaaaaccctgtagctctaaaccgagggagctgccaaagcgattcaaaggagcccaggggacccgtagcaacagaccccgactctgcgcaaatgcgaatccatggctctcgcaagggcagcgaggctcgccgggtctcaggctgtggatccctaaactcaaaagaaataaaacgtcacatgataaattaagagtttccaacagtttctagcctagccactgaacagtagggattcaagaaaacaaaacacaacaatgaaaattaccacataatacgagaaaaggtcccaaaactgaccgtcaacaagatacaagcctatcgagtaccaaccacagtggatgaaaaagacacgttctaatctaaggcgtagaattcgacaattccttttttttttttttttttaagacgtagtcttgctctgtcgccaggctggagggcagtggcacgatctcggctcactgcaacctccacctcccgggttcaagcgattctcctgcctcagcctctcgagtagctgggattacaggcgcatgccaccacacccggctaatttttgtatttttagtagagacggggtttcaccatgtttgccaggatggtctcgatctcttggcctcgtgatccaccggcctcggcctcccaaagtgctgaaattacaggcgtgagccagcgtgcccagcctcctttttaaaaaaaaattaataaactttttctttagggtcttgctctgttgcccaggtcggagtgcacgatcttgctcactgcaacctccaccttccaggttcaagcaattctcctacttcagtctcctgagtagctgggatgacaggtacccaccaccacgcccagataatttttgtatttttagtagagaagggtttcaccattttgaccacactggtcttgaacttctgacaactgattcgctcgcctcggcctcccgggattacaggcgtgagccaccgcatccggccttctgtcagagtttcagctgccctcccagcgcccccaacaggcacgttttcacaagaccagacctagctccactttgtggtgaggtggcaagaatagagagagagaaagagaggacaccccctgcccccagccactcagacacacagacatgggatcccatgggtcttttttcttggtttggttgacagctacggcagtggcagagcagcctaatgactggggctgttcttggtgcaaggccagtagagaaaagaagaaaaacagaaaaaagggaaggctgggtgtggtggttcacacctgtaatcccagcactttgggaggccaaggagggtggattcctggagttcaggagtttgaaatcagcctgggcaacagagtgagacccctgtctctacaaaattttaaaaagtagctgggtgtggtggctcatgcctctagtcccagctactcaggaggctgaggtgggagaatcacttgagcccaaggggtcaaggctgcactgagccaagatcgtgccacccccacccccagcctgggtgacatagcaagaccctgtctcaattaaaaaaaagaacccctctctcactctgtcacaccaggtcctcttttggactcctctggctggaaggaaggcatttctctcataatttatgctccctgaacccatcacacagctctgagacttccctccttccaaagccaaaagataaaggaggaaaatcccccagcaaacatatggtcatcgtgtccattcttctcgtttttaactcccttcacatctgcctgctattacttgtatttctgaatcttcaggtggtttctttttgtattcactctggggtgttaaatagaaatcagtgagagagatgctgaaatgtgcttatcccatcttggccagtaatggaagtctgccttccctgaggatttgaaattatccagtttgggcctggcacagtggctcacgcttgtaatccccacactttggaaggccgaggtgggtggatcacctgaagtcaggaatttgagaccagcctggccaacaggacaaaactccatctctactaaaaatacaaaaattagccgggcgtggtggagggcgcctgtcatcccagctactcaagaggctgaggcaggagagtcacttcaacccgggaggcacaggttgcagtgagctgagatcaccccattatcctccagcctgggggacaagagcgaaattctgcctcaaaaacaaacaaacaaaaagaccaaaaccaaaaacccaacatttactctcagataatctgaacagaacacagtcttagaaaataatacttaaaatgcactgggtgcaatctaaaattatttgaaatacaaagaactgggaaaatgtgatgaattatcaggggaaaagaaaatcagcagatgaccatgtcaagaagaaacagatactggacttacacaatgatttatgaacatcttttcatgtgcttgctggacacctgtatatcttttttggaaaaaatgattctatttatttgtccattttaattttcattttatttattttttcgagacagagtcttgctctatcacccaggctggggtgcagtggcatgatcttggctcactgcaacctccgcctcccaggttcaagtgattctcctgcctcagcctcccaagtagctgggatgagaggcacgtgccaccatgcctggtaatttttgtattcttagtagagacgggtttcaccatgttggccaggctggtctcgagctcttgatctcgtgatccacccacctcagccctctaaagtgatgggattacaggtgtgagccaccgtgcccagaaatttgcccatttttaataggttgttctttattttttttgaaatggagtctcgctctgccacccaggctggagttcaatagcttgatctcgcctcactgcaacctccacctcccgtgttcagtcattctcttgtctcagcctcccaagtagctgagactacaggcatgcaccatcacatctggctaatttttatgtttagtagagacaaggtttcaccatgttggccaggatggtcttgaactcctgatctcaggtgatccgcccgcctcggcctcccaaagtgctgggattacaggcgtgagccaccgtgcctggcccagatagatgatttctaaatattttctcccattctgcatgttgaacttcagtttcttgatagtgtctgatacacaaagttttaaatgtttacaaaatccaatttatctacttttgttgttcctgcttatactttggtattatatttggtattatatttacaaaatcgttgccaaatctaaggtcatgaagatttactcctatgttcctatgttttcctccaagagtttatctcttatgtttaggtctttggacacttttgagttaagttttgtatacggtgtgaagcaagagtccaaattcatctttgtacctcaattgtcccagcttttttttttttttttttttttgacactcttcttgccaggctggagtgcagtggcacaatctcagctcactgcaacctccacctcctgggttcaagcgattctcctagctcagcctcccaaagtactgggatgataggtgtccactaccacgcccagctaattttttgtatttttagtagacagggtttcaccatgttggccaggctgatcttgaactcctgacctcaggtgatccacccgcctccgcttcacaaagtgctgggattacaggcgtgagccactgcgcacggccccaacactttttttttttttttttttaatacagagtcttgctcttgtcacccaggccggagttcaacggcacgatctcggctcactgcaacctctgcctcctgggttcaagcgattctcctgccttaacctcccaagtagctgggattactggcccccgctaccacatctggctaatttttgtatttttagtagaggcggggttttgccatgctggccaggctggtctcgaactcctgaccttgtgatccgcccgccttggcctcccaaagtgctgggattacaggcgtgagccactgcccccgacatcattttttaagggaattattctttcctccattaaataagtttggcattctagttgaaaatcagttgcccacagtgtatcaattgatttgtgttggtataacagaatacctgagtctggttaacgtataaggaacaagaacatattggtacacagttctggaggctgggaagtccacaactgagagactgacatctggcaagggccttcttgttatgtcatcccatggaggaaagacaagagacagcaagtggggacaaaacttgcccttttatcatgacaccaatcctactcatgaaagtggagacttcatggacatctttttttttttttttgagatagagtctcattctgtctcccaggctggagtgcagtagcacgatcctggctcactgcaaacctctgcctcctgggttggagcaattctcctgcctcagcctcccaagtagctgggattacaggtgtgtgccactacacccggctaatttttgtaattttagtagagacggggttttgccatgttggccaggctggtattgaactcgtgacctcaggtgatccacccgcctcggcctcccagagtgctgagattacaggtgtgagccaccacgaccagccccttcatggccattttaagggtctcaacctttcatgccattaccatggcaattaaatttcaacattgagttttgggtgggacattcaacccatagcatttgtggactctcaattctcttcccactgatctgtctccatccctgtgtttttcctcctggttttgtttgttttcgacagggtctctgtcacccaggctgcaatatagtggtgcaatcacggctgactgcagcctcaaactcctgggctcaagcaatcctcccagctcaccctcccaagtggctgggactacagatgtgtggcacatgcctagctagaatcatctctagattagtcataatacctaatacaatgtaaatgctatccaaatagttgtatattaacatttgtatttttaaaattgttgtatattttaaacactttccatccagggttcgttgataaatggatgcagagcccatggatacagagggccaactgtatcataaagacaacacctttaaatgtgaaatatatgtgcaaacagggaaaacagagaaaaagatggggtacatcataatataaagggcagattcatttagacatttaagtatctaattcctccaaaaaggctaaaagatacagtgatgcagtgccatttaatgagttttttaaggtttcaaaatcaagctcaaatgctgtatattattgacattcaccattattcaagaaaacctttaataatattctttatattataatgtgatcaaagaataaaaaaattttcatgaagggctggtttacaaaatagaactctgtctagggtctgagccatttttctcatacccgtcccattctctctctgtaacagcagtgggaggagtgacagagctcgcaggttaagacagacacgcaggtgttggtatctaatgcactgaactgtggaagttatgggaagttgttttctctttttaaaaataaaattagctgggcatggtgactcatacctgtaatgtaatggcagcacttgaacaggccatggagaatcacttcaccccaggagtttgggactaatctgggcaatatacggagaccccatcgctacaattttttttttttaattggcacagcatagtggtgcgtgcctgtagtcccagctacttgggaggctgaggtcggaggactgcttgagcccagtaagcagaggagattgcagtgagccaagatcctgccatggtattctggcctgggcaacagagcaagatgggaaaaaaaaaaaaaaagatattatcaaaaatttaatatttaatgcacacgtttcccatggaaatatgcaggagaggaaaactgacattccaaaatcagcctaactgaaaaagaccaattatatgaagcctgtgcatgtatgaacaaagaaaaagttaaagttttctaagctcattctgcaaaatgttagaaatacgaagacagagatcatatagtgcagcggtccccaacctttttggtaccagggacctgtttcatggaagacaatttttccacggacggtttgtgggggtagaagaatggggatgggatgttttcaggatgaaactgttccacctcagatcatcaggcgttacattctcataagaagcgcacaacctggattcctcacatgcacagttcccaatagggttcgcgctcctatgagaactaatgccaccgctgatctggcaggaggtggagctcaggtggcaatgctcgctcacccgccactcacctcctgccatgcagctggggggagctggggaccccgatatagtgtgtatgccatgttaaaataattaaaacagatttggattgtgctgtccttttaaattttaataaaatagattaatttcatattacatagagagcaagtccatccattcatccgtgataaaattttagaaatattttctataaaatgtttagtatttaattggaaatgaatccagtataacatgacttccacagatacagcattcccatcctcactcccattcctattttgagaaattttaaaaatacagaaaagtacaaaaaataagacaagatatccctataccacaatccagaatcaatcagtatcttcttatatttacttgaagtcttttgaaagagaagtggatgtttatataaaaagctgaagtcccctttaaccaatacccatcccacctcccacactcattattttcccttctccactcttcacaggtgaccactatcaagagtttggtctgtatccttccaatccgtttcaaaaacatgtacatacatatatgcatccattaccaatagatagtactgagttttatgaggaaacttttaattcaaatttacaaaaaagtcattgtactatctgtatcattctgcaacttgatcccccctcaacaattctgggatctttctgttaatacatgtggatttcatttgttgcattttacagatatatagtattacataagaatttcccatattgttcgtgatgggctttctcagttgtttctaatttttggctactacaaatcaagccacagtaaatatcctagtgcgtatttcctgagcattcatactcataagtagaaccgctaagtatttctcaaattgttccaaggaatgtttccctattcccaaggtcatatgcattttagtacatagcttttccatatttctgtttttaatctctggattcacttttgtgtatagttcatggtctatttttcccccttggagaacaaactacctccacttaaaaaaaatagttccattatttcctcatttcctgatgccacttgtatcatattccaaattctaataaatgcataggtctttttttgaaatctcttctgctctgctcaatcaataccacaggagtcttaatattagttgtagatgaccatgtcatctatttttgtctgttcctttccaatatttacaacttaatttttcttgttactggcgaagatctccagatctatggtggtagcaataaaaaacaggcctccattttctgttcccacttttagtgaaaatgtgcctaaactttcaccattatctctgctgcaggtttctctgttggacacagggttttaatcatatgcatgtctttctcttcagtacaaattttctggtgtcccttaagtttttagtacttgttaaagttaacctcattcgtggtgctttgcttcagaaggattatttctggggcatgatgaggtgcaaatttctaatgaaagctttcccactttcaaggctttcatggggtttttagtgagtatgaattttctggtgtctaatgtggtgtgacttctggctgaaagctttcccacattcactgcactgataaggcttcttacctgtgtgtattctcaaatgcagagcaagggttgagaactgagagaaagctttcccacattcattacaaccatagggcttctcccctgtatggcttctcacatgcacagtgagagatgagctctgagagaaggcttttccacaaacattgcattcgtaaggtttatcacctgaatgaatcctcacatgtacaataagtgatgttcgctgagagaaggcttttccacattcgttacattcatagggtttctctccagtgtgaatgttctgatgttttatgaggtacttcttctggccaaaggctgttccacattcactacatttaaaaggcttctctccaatatggattttctcatgctcagtaaggttggatttgccactgaaggtttttccacactccttacatacaaagggcttctctcctgtgtgagttctctggtgtctgatgaggtttgacttctgaatgaaagctttcccgcaatctttacactcaaaaggtttttctccagtgtgaattttctggtgcgtaaggaggttttccttctggctaaatgattttccacattcattacattcgaaaagcttctcgccagtatgggtgttctgatgtttaatgacatactgcttttggctaaaggcttttccacactcgttacattcaaaaggtttctctctcgtgtgaaaatgctcatgctcagtgaggtttgatttgtggctgaagacttttccacataccttacaggcaaaggggttttccccactgtaaattctctgctggctgaggtgtgacatctgaatggaagctttcccacattcacaaggtttctctccagtaaaaatttcttgatgagtgaggatttacttttggctgaagatatttccacatctcttacatttataaggcttctctgtgtatgatctcccaaatgcagagtaagggataaggtttgagaggaaatgttatcatactcagtatattcaatgctttctctctagaaaaattttctaatattcaatgaagtattgctaccttcactagtttctctccagcatgaattttctgcttctcaatgagattgtcatctagctaagggcttgtcaatactccttagaagcacagggtttctcttcagcatgacttgcacgttcgacgaaatgcaacatatgagtaacagttcccccacattcagtaaattcatagggtttctctccagtatgaacactctggtaacagatgaggtacaaacgttttaaaccaaagacatttacacttaaagggggttaataccataaggagtaagctgtggtagagaagctcccaactaagtcccttgatgattctttcctacacaacctccctcatgatttcagtccaggttgtgtttcaaactgaaaacttcaaaaaggtgtggccttaaaacaaatacgatctgagaacagaggaagtattttttcttatattcaacgctctttttctcagtctttcctggagatggatcaacatgcctcccaagtcctggtgcctctcaagtcctggtgcctctctatctgtgcatcatcttctcaggcttcttctaaaatggagtacaaagaaccatagcacaaaggagttaaattcataaagtgcccagaaccatggctgccatatggtaagcccttcattttacctttatattactatcacttttatttgttaattttcccattactagcaataaaattttttgagattaactctggtagcccatctcccaatatgaaaataatctatattattaatgcttccaactaaattatgagaagggaaccctacttgaggtgatctaggtagaaaattaacattcatgggtccacaaagctgaaagtactcttgaaaaataacctttccatttcagaatttagcaagttgtataacaaataatgaagaattgccaaatagaagaaaaagatgaaaattagaaagtctacctgggatgctaaggaagaaaaataatgttcatctttctttcttctttttttttttttgagacggaatttcgctcgttatccaggctggagtgcagtggtgcgatctcggctcactgcagcctccgcctcctgggttcaagcaattctctagcctcagcctcctgagtaactgggattacaggtgtgcaccaccatacctggctaaataatgctcatctttctaagaaaaggaatagatcaaccaacaagtgcttcctcccaaaaccccattaaaattataaggagaaaatggtacaaattcccttattcaaaaggaataaaggatggtggctgaaaaaaaagtgtaaggaacagttgaacatgcactgtccagtcacgagaacaaaggactggacacaccttcatatgaaatggaagtttatcccctgcagaattttaatcagagctcaggggcattcagcaaatgagatgacaggaatgagctgctatacggaaatcagagattaaacccacatatatggtaagacctgcagcaccattctgcagctgaagacaaaagatgctggctggccgggcgcagtggctcacgcctgtaatcccagcacgttgggaggccgaggtgggcggatcacgaggtcaggagatcaagaccatcctggctaacacagtgaaaccccatctctactaaaaatacaaaaaattagccgggcgtggtggcgagcaaccagatgcaaagcttgaaccctgattacattctgtaattttaaaaaactatggaaggcattctggggacaattggaaaaatgtgaacatagactgggtagtctaatattaggacaacatggttaatcttctaaggtgtgaaacggtattttgttatatgggagagctccctttttttttgagacagtcttgctctgtcgcccaggctgtgtggggaaaagaaagagagatcagactgttactgtgtctgtgtagaaagaagtagacataagagactccattttgttctgtactaagaaaaattattctgccttgagatgctgttaatctgtaaccctacccccaaccctgtgctcactgaaacatgtgctgtgtcaactcagcgttaaatggattaagggctgtgcaggatgtgctttgttaaacaaatgcttgaaggcagcatgctccttaagagtcatcaccactccctaatctcaagtacccagagacacaacacactacagaaggccgcagggacctctgcctaggaaagccaggtattgtccaaggtttctccccatgtgatagtctgaaatatggccccgcgggaagggaaagacctgaccgtcccccagtccgacacccgtaaagggtctgtgctgaggaggattagtaaaaaaggaagacctctttgcagttgagataagaggaaggcatctgtctcctgctcttccctgggcaatggaatgtctccgtgtaaagctggattgtatattccatctactgagataggggaaaaccgccttagggctggaggtgggacatgctggcagcaacactgctctttaaggcattgagatgtttatgtatatgcacatcaaaagcacagcacttttttctttaccttgtttatgatgcagagacatttgttcacgttttcctgctgaccttctctccactattaccctattgtcctgccacatccccctctccgagaaacgcccgataatgatcaataaatactaagggaactcaagaggccggtcctcttgagaggtcctccgtatgcaggtcctccctaacgccggtcccctgggcccatttttctttctctatactttgtttctgtgtctctttcttttccaagtcagtccttccacctgacgagaaacgcccacagctgtggaggggaaacccaccccttcaggctggtgtgcagtggtgcgatctcgactcactgcaacctcggcctcctggcttcaagtgattcttgaagcctcaacctcccaagtagctgggattacaggcatgcatcaccacgcctaatttttgtatttttagtagagacaggatttcactatgttggccaggctggtctggaactcctgacatctggtgatctgcccgtatctgcctcccaagtgctggcactacaggcgtgagccaccacgcctggccaggagctgcttttcttggtagaaaatacatatttaattttttagaagtaaaacatcatgatgcctcagcacacaaaataaacacatggatacggacatacaaaagcgtggcaaaatattaattattcaatccacatggggggtacataagagattctttaactattccttcagcatttgttatatttaaaaaatgttcatatgaaaaaataattgaatggctgggcatggtgactcacacctgtaatcccagcactgtggggccaagagtttaagacaagcctggccaacatggtgaaacctcgtctctactaaaaatacaaaaaattagctggatgtggtggcatgctcctataatcccagctactcaagaggctgagacaggagaatcacttgaaaccgggaggtggaggttgtagtgagcccagatcgcaccactgcactccagcctgggtgacagagggagactatgtctcgggaaaaaaaaaaaaaagaaaaaagaaaaaagaactgatcagtatttccacacaaaaaattcatagattatttaacagcaactcatgcgttctcaaactactgatcagaaaaataaaacatggaccttccttttaaccggattataatgcagactatagacggcaaaatctaaaaccatgtttaaggtatcatttgctgagaacttgtaagttcctctggaaaatatgaagtaatggacaagcagagggaagaggaaaaaaggcagaagtaacaaacattttaatgaaaactgaattcaagtttatataagtagtacctacataagtagaatatttcataatcaaaggccaagattcaaaaattttataaagagaaagaaatatgttcatatttgtagtcacataatttgtatgttttttttttttttttttgagatggagtctcgctctgttgcccaggccggagtgcagtctcagctcactgcaacctccgcctcccaggttcaaccgattctcctgcctcagcctcccgagtagctgggacgataggtgtgcatcaccacgcccagctagtttttgtatttttaatagaaacggggttttaccatgttggccaggccagtctcaaactcttgacctcaggtgatctgcctgcctcggcctcccaaagtgttgggattacaggggtgaaccaccgagtctggcctttttttttttaaataaaaaagatacggggtctcaacacgctgcccaggctggtctagaactcctaggctcaagagatctgccgcctcgcctacagatgtgagccaccgtgcctggccctttgttctctattaaagagagcttagtgtgtctttttaaggcttgactgatcctattacaaagaccatgggaaaagaaataatccagaaataacatgaaactggtctgaggtaatctctggatctgaaaataataggatgaaaattttaatttgggtagcattctgacacaatgagaatgaaattagacagctgtctgtcccataaacaggtaaagttgtgtaaggcaagacagaaactctggagatgccaaaataagaattgatattatagttaattataacttaagaatgagtccaggtgtagtggctcccgcctgtaatcctagcactttgagaggctgaggcgggcagatcacttgaggtcaggagtttaagaccagcctggccaacatggtgaaaactggttaccaaaaaaatacaaaaattagccgggtgtggtggtgggcacctgtagtcccagctactcaggaggctgaggcaggagaatcacttgaacccgggaggcagaggctgcggtgagccacgatggcaccaccgcactccaacctggacaacagagtgaaactatgtctcaaaaaaaagaagaacttttgtatttttagtagagacagggtttctccatgttggtcaggctggtctcgaactcctggcctcaagtgatacacctgccttggcctcccaaagtcagttgtggtcacgtttacgcgtgtcacgtatatccttcttgaggtaacctaggaataagccagtatattatatctatgctgcaaatatatatacatataagccctagccaacatggtgaaacctcgactctactaaaaatacaaaaattagccggcgtggtggcaggtgcctgtaatcccagctacttgggaggctaaggcaggagaatcgcttgaacctggaaagtggaggttgcagtgagccgagatcgcaccactgtactccagcctgggtgacagagcaagactcagtctcaaaaaaaggaaaaggaaaaggaaggaaggctggccctctgttgggtctcccaaatcactcagaatcaatgttgaaacctgtgatttgacctgttacctaaccactgctactcttattcccttttgccctctctcttccagcccacggccctgatcactattctctgaacaggacagcaagcttctcctgacttagggcttttaacacttttgttccttctggctaatgatcttccacccaatgctgcacgcccactctcgcactcttcagatcttttttcaaatggcattcagtgagacctttccccaccaagctgatttaaaattacaaccccaactagccctctctataccggttttcccttactttattcttttccatagcacttatcactatctgatagtatacattttttaagtatttactcattgtctgtctccccattataacaccgtccctaggaggaagaaatttttgactgttttgatagctgacatttccctagcatctgaaatagtacctaatacatatcatgcaataaatacttgtaggatgtgaatatatcagcttggtagaaacgtaaatgggtttacttcttttgagagcaatgtgcttatctcaattaaatttataaacataactttgaccctgtattccacttaaaaagtaaatgctatgtagttgtttctgcatatttctgcaaagcaatataaacaagtatacacacttgtgtcttcaatagcagaagcctgaaaacaacctaaatgcccattagtaggagacaggttaaattatgcgttagccaggcgcggtggctcaaacctgtaatcccagcactttgagaggccgaggcaggcagatcacttgaggataggagttggagaccagcctggccaacatggcaaaaccccatctctatgaaaaatacaaaaattagccaggtgtgatggcacatgcctgtaatcccagctactcgggagcctgaggcacaagaatcacttgaccccaggaggcggaggttgcagtgagccaagactgtgccactgcactgccacctgggtgacaaagcaaaactctgtctcaaaaaaatgaaaataaataacaaattatgtgttgacagagaattctaagaaaaaaacttatgtacataatagaatatataatataccaccatttatatgaaaaggaaaaattagggcttatatgtatatatatttgcagcatagatataatatactggcttattcctaggttacctcaagaaggatatacgtgacacgcgtaaacgtgaccacaactttgcaaaaaaactgcaggactaagagtcaagagttaagaggagattttttcgggagtctgaggcaggaggaccacttcaggccaggaagctgaggccacagtgagctgtaattgtgccatacatatagacccccacacataaaagtagcagagggaaaaactgatttctaggtcaacaacttatgacagaggtacatgggagcagaagaaaggtaggcagaggagtccatggatctacgatggcagagatgagtgagaagacaacgggaagtgtgagaacaggtgtaaaatataattctgaggcattcagccactagaaaggatgagagaaggtagtaacaaaaaggaacctgaatatcagacaatatgtaaggttttacaaagtataaaggacaatgtgtgaggacaggaaaaggtatgtggatgaaggagaacagccaccacagtggcggcacagacgaagcaggaaggctgacatcagaacagcaacaggaggggcgcctggcccctctagaatctggtgaaagaagaagaataatgaaacacacaaaaatgatgactggaagcgtcattcaggaatctaaaaatctcataccaagcaatactctatatgtctacagcctggaagaaaacatcctttgaagcacttcagaggactcaatgctgactgaaaaactgtggcctgcctgtcatttactcacccgcgcagatccttcccacttctttctccaccatacagtttgtcttcttgcttcaacagaggatcatattaactattgggaaaatgacacagtattacaatgttaatgctgggtccaaagtaccatcctagaactcaggctgagccctggggtctcctggccttctgaagaatgagggtgcaacttccaaagatgcacagaacaaagtaatgaccttctgccttagtgactaaagcacacacaatcatgtgggcaaagggactagggccattagaatcctaaacttcaaagccatgctcattaaaccatttaaagtctacacacatccagaaatgggagaaagggagaattacctttcagaattttacttacacaggagagctgttcacaccttgtgtgagtgattgctgtttttctctagcaccacactcccactcagggtcctgagaggattttaactacagcccttattcgtggatgaattcaacacccatgtctgactttaacacgttcccatcagaactaaagcacatgggcacaatgtgaagaagttgttctgacagtactcaagaataaaaactcaaacattttcctgaagtcctatttaccctctttgcattatactgagagtgaaattctttctttttttttttttttttttgagacagtttcactcctgttgcccaggctagagtgcaattgtgcaatctcagcccactgcaaccaccgcctcctgggttcaagcaattctcctgcctcagcctcctgagtagctgggattatgggtgtgtaccaccacacctggctaattttgtatttttagtagagacagagtttcaccatgttggccaggctggtctcgaactcctgaccttaggtgatccacccacctcagcctcccaaagtgctgggattacagatgtaagccaccgtgccgtgtcctatttcatattagagatgtcctggcccaggtgcagtggctcacacctataatcccaacacttcgggaggccggaagtgggtgaatcgttttgagtgcaggagttcaagaccaggctgggcaacacagtgacacaccgtccttataaaaatacaaaattagctgggcgcaatggtgtgcgcctgtagtctcagctacttaagaggctgaggtgggaggatgacttgagcccaggagttcaagatggcctgacagagtgagaccttgtcataaaaaagaaaagcaacaacctggaatacaggttcatccattagttcaaaaaacatttttaagccaggtgtggtggtgtgcacatgcagtaccagcttctcaggaggctgagacaggaagatcactcgagcccaggacttccaggctgcaaatacatgatcatgcctatgaatagccactgcactccaaaagaaaaaaaaaaatctttttttttttttttgtgacagagactcgttctgttgcccaggctgggagtgcagtgacgtgatctctgctcactgcaacctctgcctcccgggttcaagccattctcctgcctcagcctcccgagtagctgggattacaggcatgcgccactacacccagctaatttttgtaattttagtagagacagggtttcaccacattggccaggctggtcttgaacccctgacctcaggtgatccgcccacctctgcctcccaaagtgctgggattacaggtgtgagccactgcgcccagccaaaaaaaaaatttttttttttttgagatggagttttactcttgttgcccaggctggagcgcagtggtgcgatctcggctcactgcaacctccacctcccaggtccaagtgattctcctgtctcagcctccggagcagctgggactataggcatgcgccaccatgccccactaattttttattttcagtagagacggagtttctctgtgttaggctgaactcccaaactcccgaccacaggtgatccacctgccttggcctcccaaagggctgggattacagttgtgagccactgcacgtggcccaaaagaatttttttaatcaatagcagacattattgggatgactgaccaaatttgaatatggactttggattaaataatactaatgtatcaatgttaaacttcccgattttgatcactgtactgtagttatgaaaaagaatgtttttgttcttgcaaaatgcatgctgaagtatttatagataaaggaagcatgtccacaactggtttcaaatcgttcaggaaaaaaaaatcatacacatttggagaaagagagaaggaaaaataaaacaaccaaaatgtaaatgattggtgaaattgggtaaaggatacatgggacttctctgtactattccaactcttctataaagttgtaatcatataaaaaagcataatcataaaaaatttaagtttcacatatataccccccatccactatgtatgttgaaaaagcttgatcacccaattcctaatggggtgtgtcagagatataaggcttagagcatgatttaaaccgaaacatacatgacagaaacacgagaaggtgagttggctggaagcaacttgcaggagggagatcaagtttgagactctatacattcagagtgtaggtttctgaacacatgcaggcagagagatcgattaggcagttggatatacagatcaggagctcagaatagggctagaacagaaatgggaacttgccagttgtcagactattactgctgctgaagacacagggagaaatgttaccgtgggctggacgcagtggctcatgccactaatcccagcactttgggaagctgaggtgggcaggatcacttgagctcagaagttcaagaccagcctaggcaacatggcaagaccccatctctgcaaaaaattcaaatccaaaaattagcagggtgtggggtggtacatgcctgtagtcccagctacttgggagcctgaagcaggaggactgcttaagcctgggaggtggacgttgcagtgagccgtgatcatgccactgtgctccagcctgggtgacaaagcaagaccctgtctcaaaaaaaaaaaaaaaaaaaaaaaaaagaatcacaaagcaggggcagggcttggtggctcatgcctgtaatcccagcactttgagacactgaggtgggtagactgcttgagcccaggagttcaagaccagcgtgcttagcactaaaaaaaaatacaaaaaaactagccaggtatggtggtatgcacctgtagtcccagctacttgacaggctgagacaaaaggactgcttgagcctaggaggttgaggttgcagtgagccagaaaaaaaaaagtaagaatcacaaagcagatgaaaactgaaacataacaaaatgaacttaagacacaaaacttttaagaaggaagcaaagctataaatagaccacaaaagataaacagaggaaatgagtaaagaaacagtcacccaaaagaagggaatcgacagaaaacagaagaataggaatagacatcttatttttgtcccatttgattttttgtttaaggatgcaataacgaaattttgagggattgttgtttcctcaatcaacagattttccctggttgttgcaccttggctattagcagtgtcctcagtctttctgctcacactcccactgacccaggcagcatgggtaatctatatttatataatcataatctgtatctgaccacaaaagccagtatcttatctaatgtaaaaacactgaaaagcaaatcatgataataaaagtaatagaaaaacactgaaggcatttctattagattctaaacagacaaggatgcctactgcctcaattatataatctaattacaaataactaaggaaagcagggaataatattagtatgtagaaatcaacagcttcatatatgccaacaatgactccattcatagcaacataaaacaaaacatccagaaataaacttagtaagaagtgtccaaacctgtatgaaaaaaattttaaaacaccctagaggacccaaaaagaaacgagaatacgtatcacgtacataaagaggaatatttaatgtcataaaaatgtccctattcccaagttattttataaatttaatgcaatcccaataaaagtaacaaactagttctaccttttccccctctggaacgagacaagctaatcctaaaatttacaaagaaaaataaacaggcaagaatagccaggaaacactgaaaaggacgagcaattaagagactagctataccacaaagtaaaacacaatgataaagcctcaatagtaaaaagataaatattttccctggttgttacacctgggctatagcagtgtcctcagtctttctgctcacacccagaaacagaccaaataaatgtgagaatttagtatataatcaaagtggcatcctaaaaatagtaaacataagacctttttttaatgtgtgtgagatggagtttggctcttgttgcccaggctgcagtgcagtggcacaatctcagctcactgcaacctccgccctcctatgttcaagcgattctcctgtctcagcctccgaatagctgggattcaggcatgtgccaccacacccagctaatgttttgtatttttagtagagacagggtttctccatattggccaggctggtctcgaactcctgacctcaagtgatccacccaccttggccttgcaaagtgctgggattgcaggcgtgagccaccgtgcccagccaggtaagaccttttaataaatgatgtcaaagaacgtggtagccaattggaaaaaggtaaagctggatgcatatctgatagcatacaccaggataaaatctaaatggattataaattaaaataaaaacaaaatcttaaaaaaactattgctctgacttgggaagccaaggtagcaggatcacttgggcccaggagtttgagaccagcctgggcaacacagggagatcttatctctacaatttttttttttttaaattagcgaggatatgaaggctgcagtcagctgtgatcacgccactgcaccccagcctgggtgacagatcaagatccaactctaaaacaatcaaacaacaaaaaactgtaactttataagaatttgaaaatatcggtgaaacttaagagtggaaaagtctgataaccataaaagactgatgaatcagccacgcgcggtggctcacgcctgtaatcccagcactttggagggccgaggcgggcggatcacgaggtcaggagatcgagaccatcctggctaacatggtgaaaccccgtctctactaaaaatacgaaaaaattaaccaggcgtggtggcatgcgcctgtagtcccagctacttgggaggctgaggcaggagaatggcgtgaacccgggaggcggagcttgcagtgagccgaaatcgcaccactgcattccagcctgggggacggagagatactccatctcaaaaagaaaaaaatgtaactagatttttttttttttttgagacggagtctcactctgttgcccaggctaaagtgcagtggtgtgatctcgtgcaccacaatgactggctaaattttttgtatttttagtagagacggggtttcaccatgttgaccgggctagtctcaaactcctgacctcaagtgatctacccgcctcagcctcccaaagtgctgggattacaggcgtgagccatcgcgcccagccaaaagttttgaaaataaaaagaaaaccatagcagcatggtggtgcactgcctgtagtccccgctacttgggagtctgagacttgcttgggcccaggggttcaaggccagcctgtgcaacacagtgagactgtgcctctaaaaaatacatgaataaaaaggtctttggtgtggtgcggggatgtctctgtgctcaccaaccacagggggctcattctaagcacggctatgtaaaaaaagaaactattattactaaattaaaacaaaacctcttatttctgcaagattaaaaaaaaaagaaaccactgtgaacaatgtccaaatgcaaatgaaaacttcaaaaaaaaaaaaaaaaaaagccaccactcatttcatacagggctaacctttctaatttataaacagctcctctaaggagaagacaccccatagaaaaatggtgaaaaggatatgaatagacagttcctagattaatacatacaggcctttaaacatataaaaaaaaattctcattcataagaagggatgtaaatgaaacctacactgaagttcagattgtctcttatgtccctagcgaaataccaaatattcgacactacactcatggtgagtttaaggggaagacgctctcgcacatggcttgtgggagtgtaagtacttacccactgggcagcgccatttgtattaatagcagtctagtttagagctactcctgtgtcagtataaaatggcgcacataaaaaaattattcattactgcattgttagcaacagcagaagactggaaacaatccaaatgctcaacaacgggattaactgaatcaaccatggtgcatccaaataatgacatcttatttatacagcagctgaaaaaaaaatttcttttaaagattatgattaagaaggaacaccttggctgggtgcagtggctcacacttgtaatcccaacactttgggaagccaagagaggaggactgcttgagctcaggagttcgagaccaatctgggaaacagtgagacctcatctctacaaaaagtaaaaaagccaggtgtggtggagtgtgcctgtggtcccagctacacaggcggctgaggcaggaagatcacttcagcccagcagttggaggctgcagtatgccatgttaacaccattgcacaccagcttgggtgacagagcgagactatttcaaaaaaaaaaaaaaaaaaaaaagaaagaaaaaaggaagggctatctctaggacatactgttattaaagaaagtgagatatagggaggtgcatgtggtatgctatcttttatgtaaggtggagggaaacaggagtgaagagaaatatataatagtgacagaacaaaaaacaaaaaacccacttgaaggataaacaagaagcaaacaaaaaaaaacaagacatgtttacataagacaaagaagaatgtgactgggggaagggagcagaatgagatatctctgtgagatagatctttgttgaatcacagaaatgcattacttacttcaatagtaatcaaattcattttttaaaaagtagtgccttggccaggcacggtggctcaagcctgtaatcccagtactttgggaggctgatgcgggtggatcacgaggtcaggagatcaagatcatcctggctaacatggtgaaacctcgtctctactaaaaatacaaaaaattagccgggcgtggtggctgacacctatagtcccagctactcgggaggctgaggcagaagaatggcgtgaacccgggaggcggagcttgcagtgagccgagattgcgccactgcactccagcctaggggacagagtgagactccgtctcaaaaaaaaaaaaaaaaaaaaaagcagtcccttaacctgaaaacaacaaatgaacccaactgtatgttaatttagtaacataattcctcagaaaaacgatttcaaatgactttagaacagagttctttgactacatacatctttagtgagatgcattttaaaagctgggctcagtggctcatgcctgaaatcccagcactttgggaggccaagacgagtaggaagtcaggagttcgagaccagcctggccaacatggtgaaacgctgtctctactagaaatacaaaaattagctaggcgtcatggtgggcacctgtaatcccagctactcaggaggctgaggcaggagaatcgctggaactggggaggcagatgttgcaagtgagccaagatcacaccactgcactctgccctgggcaaaagagtaagacaacatctcaaaaaaaaaaaaaagatgcattttaagaacaaaaatagttacatatattaaagaaagaattttttaacatgatacagtatgtttatggttactactagtatcagcattgttactgaaaccattttctttatattgcaggataaagcaaacaaaataagtacttataacttgtttcatattttttactataaaatacaactaggaggccgggcgccgtggctcacgcctgtaatcccagcgctttgggaggccaaggtgggcagatcacctgaggttaggagatcgagaccatcctggctaacacggtgaaaccccatctctactaaaaatacaaaaacttagctgggcgtggtggcatgcacctgtagtcccagctactcgggaggctgaagcaggagaatcacttgaacccaggaggcggagattgcagtgagctgagatcgtgccactgcactccagcctgggcgacagagcaagactccgtctcaaaaataaaataaaattaaattaaaaaaaagaactaggagctaagaaattaggtaaaaatactataccatttaaagtgaattagaaatacgaatatggactcatgatttttaaaaatacattaaaaatgtattttttaaatgctctgcaatttaaaatggccttaaaacaatgttacccctgggcaatgagcacacccttgatcttgtctctaataccattctccaataaaaggaaccagagctccttggagaaatggtcaattccaagtctgggaggaagatacaagcctgcagtgcaggaaaactttccaagatcaatgatgtcagccaaaatgagacaagaatgacctgaaggggtatccactggcatcaaaaagtgcagctgattctagaacacgctaaatatacacaactttaggatgatgtttaagaaagaaaaagccagggggaaaaaaagatacaatttgatgtaacaatgaaacaaatgtaaaaggaatgaaaagacaagagaaattaagactatacttccagggatcatttctagtttgttcccagaagtttctcttaacgtatagactactacatttttacacaaaacaaacaaacaacaacaacaaaaaaaacagaaaatcatcactttacaatacctgtagaaatttactcatccagccaagaattatgtattggttttaaaaccatccactaaatgactgatggagaatgaaccaaagtaaacataacattttggtcaaagggaagtaacaatcaccagccatctggtatatctctcctaatggtatgcaatttgaagtatgtaagatcacctctgatgtattctggccaaaaatcaatcacaattagaattaaaaaaaaaatcatcagagattctgaattagaaccatgcaaaagtaatcatagaaatcaaagaacaaatcttccaaaggagcggataatgatgactttctaaagataaacataactcaaacacagaaatctaacttccagcctgggcaacatagtaagactccatctctacaaaaaaaggtttaaaaattagcaggtcgtggtggcacacacctgtagtcccaaccactgcgggggtggggctgaggtgggaggatctcttcagcccaggaggtggaggctgcaatgagatgtgatcgcaccagtgcacccagcctgagccagagtgagaccccatctcaaaaatcaaaaaacaaacctaacttcctgattccagttaaaaaaggaaatatccacagaaaattttaagtggccaggcgcagtggctcacgcctgtaatcccagcactttgggaggccgaggtgggcggatcacgaggtcaggagatggagaccatcctggctaacacggtgaaatcccgtctctactaaaaatacaaaaaattagccggacgtggtggtgggcgcccgtagtcccagctacttgggaggctaaggctggagaatggcgtgaacctgggaggtgaagcttgcagtgagccaagatagcaccactgcactccagcctgggcgacaaaccgagactctgtccccccctccaccaaaaaaaaagaaaattttaagtaaaaaaattaaaatatagaaatattaggccgggcgcagtggctcacgcctgtaatgccaggactttgggaggctgaggcaggtggatcacaaggtcaggagatccagaccatcctggctaacgcggtgaaaccccatctctactaaaaatacaaaaacaaaattagccaggcgtggtggctggcacctgtagtcccagctactcaggaggctgaggcgggagaatggcatgaaccagggaggcagagcctgcagtgagccgagatcaggccactgcactgcagcctgggcgacagtgagactccatcaaaaaaaaaaaagaaatattaataacaaaagtgcatctacatatcttattctttcagaaattcctaccagacacaggactataatattttctgaggaagcattttttttgcagctagtaataaaaagtactagtatttaacattaatcaagtacttactacacactggggactattcttagaactttacatgtattaacttctggagctacacaaccaccctttgaatcaaatattgctattatttctatactatgaaatgagcaactgaggcccaaggtttaagtacctacctgaggtccccaaggtaaaaagtggcagaggaaggagttaacacaggaagtctggctccttggcctatgtcttcctttaatttaaaaaaaaaaaaaaaaaaattagctcatgcctgtaatcccagtactttgggaggctgaggcaggcagatcacatgaggtcaggagttcgagaccagcctggtcaccatggtgaaaccccgtctctactaaaaatacaaagcctttgccctgtctattccagtacccccaccccaacagccagttttattatttcgtatgtatcttttgaatttttttttttttttttgagatggagtttcactctcgttgcccaggttggagtgcaatggcgcaatctctgttcactgcaacctccgcctcccgggttcaagcaattatcttgcctcagcctcccaagtagctgggattaacaggcatgtgccgccacgcctggctaattttgtatttttagtagagacggggtttctccatgttggtcacgctggtctcaaactcctgacctcaggtgatccgcctgcgttggcctcccaaagtgctgggattataaatacatattcttattaccccttttcttattccaaatgcatcgtgtatcatactctacattctgcaccttgctttctctcagttaacaatacattttgaagttatttctgtctcagtatataaagagcttcctcctcattcttttgtacagctatgtattattttgttgtatcgatgtacaccaatctcccactgatgggcatgaactgtttttcttttctttcttctctctctctcctttctttctttcttaagacagggtcggccaggcaccgtggttcatgcctgtaatcctagcactttgggaagccgaggcgggccgatcacttgaggtcaagagttcaagaccagcctggccaacatggtaaaaccctgtctctactaaaaatacaaaaaaagtagccgggtgtggtggcaggcaactaatcccagctactcgggaggctgagccaagagaatcgcttgaacctggggggcagaggttgcagggagcagagattgggccactgcactctagactgggcaagagagagagactccatctcaaaaaaaaaaaaaaaaaaaaaaaaagacagggactggctgtccaccaagctggaatgctgtcgccaggatctctgctcactgcagccttgacctcctaggctcaagtgatcctcccacctcagcctcccaagcagctaggactacgggagatctcactatgtcgcccaagctggtctctaactcctggactctagccatcctcctgccttggctcacaggtgtgagccaccaagcccggcctgaggctttatatttaaaatgtgttgggtccccatctccccacacctcaacgccttttctttctcagtctgtactggctcttgcagcttgtctctttccatagtaagtctaggatcagttcccctagttccaaaagagaaaagcctgtccatacttttattaggatcacattattactattattgagacggaatctcgctcttgtccaggctggagtgcagtggcgagatctgggctcactgcaacctccgcctcccaggttcaagcgattttcctgcctcagcctccgcggtagctcagattacaggcgcccgccaccacgcccggctaatttttgtatttttttattttatttttttttagtagagacagggtttcaccatgttggccaggctcctctcgaactcctgatctcaggtaatccacccatctcggcctcccaaagtgctaggattacaggcatgagccaccgcacccgaccaagatcacagtaaattaatacattcacttaagtttgcgcacacttcttaatgtcacatggtatatttatttgttcacatttgttatgccccttagtagtattttaaagttctttcctaatagttctgaacctttaagtttcttccacaatactttatctttttactgctattgtaaatattagttttcttcaactatgtattctaactgatatttgtaaattagaaggctatttatttatagatattaacttggtacccaattactttatttaactttttgtaatttaaaactatgtcaatgacgacagcgggggcggggtgatttccttagaaaacgcatctttggagacgtcagtagcattctccattacttcacaaaatccatacaacctgagaacgcctcgactcattaaggaattaagacacctaggatttagtccagactcatagataaacactgcaacaattaagctttcttcaaaaaatgaggataactgtgcctaacctaaaaccgttgactccctcatcctgggcgccgttatatgggattgcttctcaaagcgtacaatgctgtttagtctagggctttgcttaacagccctatttaagtaccccaaagatggggatttgaatagtctgaagtaggcaccccgaaactaaagttccttcgaaacactctcgtttaattaaaaaaaaaagtcacggtgatttgcatgccactccaattaaaaagaaatgcttttatataaaaactcgttttaaaattattcaccacttagcttttccaccccttcaattttcaagtaaaaaagacgctccaggaagatggcaccgttataattatcagcactttcgacaagggaagtgcagctcaaacgttatacctcaatgctggtctcctacatctccctcttaggcacaatcacacacaatcccgcacccagtttcacattcactcaacaatcccaaacatcaggtcaaactttgaggacaaactcggtcacactcgctcaaacccgcctcagaggcccccatctccgccccgcacgtaggccagaagctcttacacccactccctgccctcgcgccgcgcccctaaagatcaggaatcctcccctttaacctccccggtccgaccgacccgagacgcccagatcccacctcctactttcgcgccacgtggacccaggggccgtactgacccgcggacaaagaccaaaatgtccactcggtgcgctgcgcttgcgcactcggagagcgaggaagcactcccagaagtctccgcgacgcggcccgcctcggtcaccgcggccaggcccaggctggtactgaattaccttctattaccagcaacgtcgcttctcaggccttggactacatttcccttgaggctttactggtcgactctctgtctcctcccctccccccgcgaacttggccgcctccttctgtgacgatggagctcttgaggtaagtagtcctttagcgtcagatgacttcaagcttgctggaaggtctggagtggcgacgccctctccgaagactcgtgggcgcaaaaatgtcaaaacgagccaggccccgactcagagataagagaacgccattctgtccgtggccgatctagctctggactacaattcccagagcccacagcggcctgacgttacgtcgttcttgacgtcgtggcgagctagttagctccgcaaggacccggacgcgaccaggggaggcagaaggtgaggggtctgggagtcctgggcggggccggggcgtgtccggagcctcgaatctgtgcgcgcaggcgggagctggctgcggatgcgccgttctgaatgtgtctttgtggctgtgtggctgggtgtgggtgtctgcaactgtgcacgtgtaaccgcctgtctccagggtgtctggtggtttttgtgtaaccatgtgtgatagagagtatcggggtgcagggtccttgtgaccgggggtgatactgcgtgtgtccccgttgtatatgtggcctgttcgccctgttcctggggtgtgagtacagttgtgactgtgtgaccactgcgggtgtgcggttgtgattcatgtctccaaggtgtgtgcgtggttttggttgtgtgacactgtggccgtgtgcaattgcctgtgcctgtgactgtgtggtgacgccgcttgtgtattcctgtatcccttggtgtgtgtgtttgtgtgtatgtgtgtggtgctgtgtatgcgggagtggggtgccactgcttgtgtgggttgcttgtgtgagtgtgactgtgtgtatgtccacagtgaaagttcagttgtgactgggtgccgtaaagtaccagtgatggcgtgtgtcccctgagtgggtgtgtgactgtgactatatgaggcatttgtgggtgttggtgtgtggggcttgtgactatacgggagtaactgtatcacagtggagagtagattgtgtgactgggtgtgtcttagcgggtgtgtgattgtgactggaaagatattgtgactggaaaggtatagaggtgtctgtgattgtgtcctgtgtctcaggagtggatgtagggccgggtgtggtggctcacatcagccctttgggaggccgaggtgggaggatcacttgagcccaggagttcgagaccagcctggcctgtacaaaaaaaaaaaaaaaaaattaatggctggcacggtggctcacacctgtaatcccagcactttgggaggccgaggcgggtggatcacctgaggtcaggagttctagaccagcctggccaacacgataaaaccctgtctctactaaaaatacaaaaattagctgggcgtggtggcaggtgcctgtaatcccagctgctcagggggctgaggcaggagaatcgcttgaacccaggaggcagaggttgcagtgagccgagatcgcgccatcgcactccagcctgggggacaagagcgagacttcgtctcaaaaacaaacaaacaaaaaattaaaaattatctgagtgtggtggcccacacctgtggtcccagctacccgggaagctgaggtgggaggatctcgagcttgagaggtcaaggctgcagtgagccgtgtttgaaccactgcattccagtctaggtgacagagcgagaccctgtctcaaaaaaataaaagagtggatgtgtggttatgtttgtgtgacactgactgtatgtgcagcaccaagtgtgccagtgactctagtgcttgacccatgcagaacctttgaagttaggacagattctggccctggacaggagtgacctcagccttctgagtgacactggatttaggcagatgcctggtgttctgtgaccacacttccctatatggtaggtaaggaggatggtggttcaaaaatgacctggttgttcatgattccttgctcttaacccttctccaagaaaggtgccaagttcaagtacatcaggttttattcttatttctctgaaatccttcttgtttttcaggacatgcttttctttccttcttctgaaacttcagaaccaccccaccaccaccctcacccctaccaaagtaacctggtctccagtatttgccataggagtaatttactgcgtgccttggagatggactgaaaggcctatatcctccctgctccctgcatacctaatgttcttttaaatttttttctttacttttcattttgaatttaagactttaaaatgtagcaacaatagaattcccatttgctctttttttttttttgagacggagtcctgctctgtcacccatgctggagtgcagtgctgtgatctcagctcactgcaacctccacctcgcaggctcaagcgattctcctgcgtcagcctcctgagaagctgagattacagacaaatgccatcgtgcccagctgattttttgtaattttagtagagacggggggaggggggtttcaccatgttggccagactggtctcgaactcctggcctcaagtgatcctcctccctcagcatcccaaagtgctgggttagagatgtgaaccaccatgtctggtctccattttcctttttgtaactcctttgacacgcctagccaattttttgtatttttagtagagacagggtttcaccatgttggccatttgttttgtagagtctgcagtgtagaatgttcctctctttggaattgtctgatatttcctgttgattaaattcagattctgcctttggggcaagaatactccgaaagcgatgtacccttctcggcgcatcatgccagggacccacgaggtcaattcgttacactatgagtggtattaattttaaccgcttggttaagacggtgattgccagatttctctgctgcaaagtcactgtttttcccattataattgatacatgtcttgtgaagaaatactttaagcctatgtgaatatcccgtttcttatcctcctttcatctattagtcttatccgttgatgacgcttgcctgaaaaagttgttaccagctatttgtcaaatggtggggttttggggtttgtttccatcatcacttctatgtttattttttcttctttttttttttgttttttttgagacagagtcttgctctgtcacccaggctggagtgcagtggcgcgagctcggctcactgcaagctccgcctccctggttcatgcgattctcctgcctcagcctcccgagtagttgggactacaggtgcctgccaccgcgcctggctaattttttgtatttttagtagagatggggtttcaccgtgttagccaggatggtctcgatctcctaacctcgtgatccacccaccttggcctcccaaagtactgggattacaggcgtgagccaccgcgcccggccacttctatgtttattaattagaattgtgtgtgtgtgtgtgtgtgtgtgtgtgtgtgtgtgtgagagagagttggagtttggctcttgttgcccaggctgggaatgcagtgacatgatctcagctcactgcagcctctgcctcctggattcaagcgattctcctgcctcagcctcccaagtttctgggattacaggcacacaccaccacgcccggctaataattgtatttttagtagagatgggatttcaccatgttggacaggctggtctcgaactcctgatctcaggtgatctgcccaccttggcctcccaaaatgctgggattataggcgtgagccacctcgcctggccttattaattagaatcttactgttagaaagatatttttcttctttcccatttttttatttactaaattatttctataagtatagactggaatttcttctataggttataatctcttttattctataggttatatattcattgctatcattttttttttttgctcaaattatcacacatttggccactgggagccccttcaagtcgattcctgtgtcctttcaatgtggcctctttatttactatttttattatttattttctggcaccacaaggtgttccacgttgatgtggtactttccctgccccagtcctggaatctacaaatttcccggggaccattggttccttttattagaaaatgattttttttcagccaggtgtggtggcgagtacctgtagtcccagctactcgggaggttgaggcgggaggattgcttgagcccgggaggcggaggttgcagcgagccaagattacaccactgcattccagcctgggtgatgaaacaagagcctgtctcaggaaaaaaaaaaaaatgattttttgaaaccaaggttagatatcttcattgcttctgagatgtcattgcttctaggtcctctcagctatgaaatgtgtttatatgtatgtatatacaaataattcatgagttcatatagtatctccaatttcagtgcaacactacagggttcattctagccttctctccatttccagatttttttttttttttttttttttttgagacagaattttacttgcccaggctggagtgcaatggtgccatctcggctcactgcaacctccacctcccaggttcaagcaattctcctgcctcagcctcccgagtagctgggattacaggcgcccaccacctcgcccagctaattttttttgtatttttagtaaagacgggttttcgtcatgatagtcaggctggtctcaaactcctgacctcaggtgatcctcctgcctctgcctcccaaagtgctgtgattacgggcataagccaccacacctggcctccatttccttttttttaaatataattttaagattttttgtagagacaagggcctcactatttgcccaggctggtcttgagctcttggcctcaggtgattctccttcctcggcatcccaaagttctgggattatagatgtgaaccaccatgtcttgcctccatttccctttttgtaactcctttctttgacattgaaaaatgtggctcacattaaccataatataatttatttattaaccattatatgtattaatatatataaatatatttgctcagtcctgtgtaaaaagtaatttaagaattgctgacttccatgtaccatacagttctttttgtctttagtcttacagtatatagtgaaaatacagttttctaaaactactttcttccctaaaccctttgtattcataatatttatgtgtaatatagattgttcatttattactgtttgtattttattttgggttcccctcacatcctggttgaatttaatgatttttctgagtatgtgaaacaatcacattgttctaaaagtcagaatcagacaaaaggatttactgagtcatcatttcttctctcccaatcccattgcccattgttttttgttggtttgttttttgttttttgtttttgtttttgttttgagacggagtcccgctctgtcacccaggctagcgtgcaatggcgcaatctcggctcacagcaacctccacctctcgggttcaagcaattttcccacgtcagcctcctgagtagctgggattacaggcatccaccatcatgcccagctaatttttgtgtttttgtagaaatgggctttcactaagttgccaaccgcctcggcctcccaaagtgctgggattgtaggtgtgagccactgcgcccagccccggttctttgttctttctacccagttcccacttacctatttcagtaaccaataatgttactttcttggttttatggttaaataaacataacaaagaatttaccattttagggtaaattacaggcgtaaatgattacgcctgtaatcccagcactttgggaggtcgaggtgggaaaattgtttgagcccaggagtttgagaccagcctgggcaatatgacgaaaccccatctctacaaaaaattaaaaactagccagacgtggtgatgcacacctgtagtcccagctatttgggaggctgaggtaggagaatctcttgagtctgggaggtcaaggttgcaatgagctgtgatcatgccactgcactgcagcctgagtgacagaattagaccctacctcaaaaaaataaataataaaaacattgggaaaaaggcttttgttagagtttttactcagagtgattgctttttcaggaagagattactaaggttaagatggagattcctgtacctgtctagctcccataacttggccaacttatctcagcccctgagcctaggcccttgtgatgtgggatcccaggccctaaagaatgtctgtgaattgcagagatggggaacatttaggcacgtagcttcaagttttactaggtggtgtagagatagctcaactttccagaaggatttgtacaaagttttgatgttggagctctaaaacagcatggttttgctgggtcagaatcaacttgttggctgggcacagtggctcacacctgcaatcccagcattttaggaggctgaagtgggaggatcatttaaggccaggagttcaagaccagactgggcaacatattgagaccctgtctttacaaaaaattttaaaattagccaggtgtagtggcatgcctgtggtctcagctacttgggaggctgaagtgggagaatcaccttagcccaggaggctgaagctgtgattgcgccactgccctccagcctgggtgagagtgagatcctgtccctgccctgccaaaaaaaaaaaaaaaaattgtcctgtaactcataattcacattttgtttcacattatgggtttgtgaaaaatccctttgagacatatagagctggaatcggacagctctgctcttatttctgaagcttcctctttttaaaaattgctctttctcatattgaccaagcgtctgagtctgaatttttatctagtcaaagtatggcctaatttgtgtactggttaggacaggctaagttatgctgtggtggcaaacaacccctgaatctcagtggcttacagagtcacattttatttctgctcatgtacatgtccagtgtggatcagcagagacagggttccacaccaaagaaggcccgccacctttagctgcatcatttgaaaaacagatggtcaccacatgcatgaagagaaaaattggagaattgtgcagtctttctggtgtctgtctctaactgaagtgacagtcatcacctcagctgagatttcattggctagagcagtgcatggccctacctaagtgcaaggggctggaaaatgtcattttctgtgtgccccaaactggataatggtgaaacatagtaatgtcttccacactggctaagacccatttcttttcttttcttttctttttgttgttgtttgtttgttttgttgtttgtttgttatgtatttttttttttgtttgagatggagtctcactctgtcacccaggctggtgtcagtggcacaatcttggctcaccgcaacctccgcctcctggcttcaaacaattctcatgcctcagcctcccgagtaaataggattacaggtgctcaccaccatacgcagctaacttttgtatttttagtagaaacagggcttctgttgaccaggctggtctctaactcctggcctcaggtgatccgcccaccttgatcttccaaagtgccaggattacaggcgtgagccactgtgccccgccccttttaaatataaatcagattatgccattccttggctttaaaagtttcgtaccttcctgttttccttaagaataaaatccaaagttcttacagtggcttacaagctccttgtgatctggcttctagctctctctctgaccctcttcgtctcgcatgttccatcccagctgcccttgtctccttcctcttgttgatcgaggaaagcctgctcctgccttcagacccttgcaattgccgctcctggtgcaaggcgtgcacttccccagatacctgcatttctcactcatccattcaggctgtgcttacctgtcaccttctcagaccaccctctcttcctccaaaactccctctccccttaatcttctttgtttttatctgtaggacatttgccacctgacatctatatatacatatgttgttattgttgttgtttgtgacagagtctttgttgcccaggctggagtgcagtggcacaatatcaactcactacaacctcttcctcctgggttcaagtgattctctcacctcagcctcctgagtagctgggattacaggcatgcgccaccacacccagctaattttttgtatttttagtagagacggcatttcaccatgttggccaggctggtctagaacttctgacctcaagtgatccgcgtgcctcgccctcccaaagtgctgggatcacaggcatgagccactgtgcctggccccacctgacatataattaggaatatcaatatcatgtctatggccataccaccctaaatactcacatctcatcttttttcttttttttttcttcaaattttttgtagagatgggggtcttactttgctgcccaggctggtcttgagctgctgacctcaagttatcctcctgccttggtccctcaaagtgctgagatgacaggagtgagctactgtgcccagccctcaatcccatctatctccgtatgtcagtgtttgttggttgtctcttcccataggatgtgaggtccagccagacacaatggcccacacctgtaatcccagcactttgggaggctgaagtggggatatcacttgaggcaggagttgaagaccagcctggccaacatgacgagtccccgtctctacaaaagttacaaacattagcagagcatgatggtgcacgcttgtaattccagctacttgggaggctgaggcaaaataattgcttgaacccaggaggtggaagttgcagtgagccgagagctcgtcagtgcactccagcctcggtgacagagcaagattttgtctcaaaaaaaagaaaaaaaaaaaaacagaatgtgagatcaactgggacagggacttgaattattttctttcctcgttcctagaacagtgccagttgacacaggagcccagtaaatatgaaagaattctgacttccttttctctgcctccatatgtgtcagatgccagagcctgttgatttaatctcatctacattttgaattcatctctctcctcctcttttctgctgccaatgtcctgggtcaggccctcttcgtgcctgaaaaagtgtaggggcaacccacccctacatctgaaaagtacaagtacctctcagtcaatctttctgactccaaggttacacctctccaaaataacctggccatattggtcctgtcacttctgtctttaaattcttaggtttccttccatttcattaataagtgaaaacctactttttctttcttttttgttttggagagagagtctcactctgttccccaggctggagtgcaatggtgccatctcggctcaccgcaacctctgcctcctgagttcaagcaattctccctgcctcaacctcctgagtagctgggattataagcgccccccaccatgccagctaatttttgtatttttagtagagatgcagtttcaccatgttggccaggctggtctcaaactcctgatttcaggtaatccgcctgcctcggcctcccaaagtgctgggattacaggcgtgggcaccgtgcccggctgaaaacctaccttttttaaaaaatagagatgagggctcactatgttacccagggtggtttcaaattcctgagcttaagcgaacgacacacctcagcttcccaaagaacctaacttttatgcatcagcctgtatttattggtcacctatgtcctccagacactgtggcaagagtgatggttagagtgatgatcagacccactggtccttgccctcatggttttttcattcatacatcttcattttcttttctgtttttttgagacagaatctcactctgtggcccaggctggagtggagtggtgtgatcttggctcactgcaacctccgcctcccaggttcaagcagttctcccatctcagcctcccaagtagctggataccggcacgcaccaccgtgcctggctaatttttgtatttttagtagagacagggtttcaccatgttggccaggctggtctcaaactcctgacctcaggtgatcagcccacctcggcctcccaaagtggtgggatgacaggcgtgagccaccacacctggcctatacaccttcattttctaacccctgatgtcatctccagcattatctgcctctagattctagagctaattaaatttaaattaaattaattaaaataaaataaaaactttagtttctcagacatactagccacatttcatatgctcaatagccatctatgactacaatatttatagcacagatttgaagatttccatcatcacagaacattatttggacagcactggtctagacctttcttcaaactacacaactcattccaaatcattcttagtctcccaaatacaccatttgctttcagtccagtgtttttgccactgcatttcactctgctcacaatattctctgtcccttttctgcctattaaacttccctgaggtttcagaacccaattcctattctacattttacagaaaagttttcttgacaccattcccattcattaagttagtcttccttagctgggctcggtggctcacacctgtaatcccagcactttcggaggccgaggtgggcagatcagttgagctcaggagttcaagaccagcctggccaacatggcaaaacccaatctgtaccaaaaatgcaaaaattagccaggcgtggtggtgcatgcctatggtcctagctacttgggaggccgaggtggaaggatcgcttgagtatgggaggcagaggttgcagtgatccgagattgtgccactgcactccagccttggtgacagagtgaaaccccatttcaaaaaaaaaaaaaaaagtatttcttttgacacaccccctacaggaagcttcttggacctctaattagatcagatttaatacccttgttaggccaggcacagtagctcataccctgctaaccccaacactttgggaggccaaggtgggcggatcacctgaggtgaggagctcaagaccagcctggccaacatggtgaaaccgcgtctctactaaaaatacaaaaaatcagccaggcgtagtggtgtgcgcctgtactcctagctacttgtgaggttgaggcgggagaatcacttgaacctgggagacagaggttgcggtgagctgagatcacacctctgcactccagcctgggcaacagagtgagaccctgtctcaaaaggaaaaaaagaaccctccttaaaactctgatttctcattcccttgagatgtatgccattcacaggacttcggactcagcaactgccagcctcacagtcaatggggaagtgatgttctgcagaaaagcagtagatggtcggaaggtagtgagttatctccattgattgttcacagtcagttatgaattgaactccttgttctattcttccccctcttctcactactgtacttgtctttttttttttttttttttgagacagagttttgtttttattgcccaggctggagtgcaatggtgcgatctcggctcaccacaacctctgcctcccgggttcaagcgattctcctgcctcagcctcccgagtagctgggattacaggaatgcgccaccacgccccgctaattttttgtacttttagttgagacggggtttctccatgttgattaggctggtctcgaactcccgacctcaggtgatccacctgccttggcctcccaaagtgctgggattacaggtgtgagccaccgtgcccagctgtctagttttaaaaaagaatgaaagcagtagggagggctcagatgagaaataaagagtgctgggccaagagacttctagaaattgagttcccatggagggcagtactctggatgtgcgggtatgcaagcaagatgcctgtattactgaggctttcttgctcctgtctggtgagtatagctggggctggagacattgacagagcctatggtatgcatggtgtagtcccattttggacttggaaggaggaagtggagccagtgagatgcccaggaggttttgcctgttgagcccagagaagctagaagacttcgtttagggatgtcttttactcaagatttggcctgcatagatggtctgtgttcctagcctgatggtgctgtcctcatccttaggggtcaagtgagtgagtctgagtcgtaagatccttgctgtaatttggagcaggtgggagccttctaggccccatctagggccaagtttagcatcactaagatgggggactgtgtcagctgtaatccctcccttggtggtgcctgggttctgtgtcagtgctggagcacatctgccttgaaaccatctttctgcttttgggttccttactttttaggaagggactgggttttcttaactctgcagtttttttttgttgttgttgttgttgttttgttttttgtttgtgtgttttgagatcgagtctcgctctgtcgcccaggctggagggcagtggtgcagtctcggctcactgcaacctctacctttcaggtttaagcaattcttgtgcctcagcctcccaaggtgctgggtttacaggcgtgagccaccatgcctggccaactctgtagttcttaatgttagttcttgtgtggtaggacatggagaggtgggagaagcagatccgagacattggaagtacaattcttttaagctcatctatttgggagtgctgaggcaagctcagtttatcagaggttaccccatctccccccattttgctttttcaggactctgcacttgtccaagagaagaatccagagaaatcagagcaggtcaaatagttctaaaagccatggcccaggtatgttgaaattccttctatccttagaatgatctgtcttcccgccagattatatggacactgtgttctttatcctggaacttccctgtatccttctcacagttggtccattccaggagatgagtaatggtgcccaagtccctcggtggccctctcctctccagcactgtccacgtgtctgtagtcctcttagcagagcataggctaggcgtagtggcacatgcctgtaatctcagcactttaggaggctgaggtgggccgattgcttgaggccaggagttcgagaccagcctggacaacatggtgaaaccccgtctctactaaaaatacaaaaattagccgggcatggtaccacacacctgtagtcccagctactcaggaggctgaggcaggagaatcgtttgaacccaggagatggaggttgtaggaagccaagatttccccactgcactccaccctgggagacagagcgagactctgtctaaataaataaataaataaatgctcttagcagagcaccagtacagtagaaataccttctcttgagagaaatatgagagtctcccttatcataactgtggttgaatggggccaaacatgaaataaagtagtttcatcttttccattgtcttgggtggtttctttcttctgtgtttttgttttgtttcgttttttgagacagggtctcgctctgtcacccagactggagcacagtggtgcagtcatggctcactgcagcctcaacctcctgggcttaagcaatcctcccacctcagcctcccaagtagctaggaccagagccacatgccaccactaccagctaattttttaagtttttgtagagaccaggtctcactgtgttgcccagactggtctcaaactccggggctcaattggttagcctcctagtactgggattacaggcatgagccactgctttattctttattctatttttaaatgtcaccccctctttaaaaagtcacaagacacttaataccgtcaaatatatatatatttatatggctgggtgcagtggtggtgggtgcctataatcgcagctacttgagaggctgaggtaggagaatcactttaacctaggaggccgaggttgtcataagcagagatcacgccactgcactccggcttgggcgacacagcgagactctgtctcagaaaatatatatatatgctgggtgtggtggctcctgcctgtaatcccagcactttgggaggctgaggcgggtggatcacgaggtcaagagatcaaaaccatcctggccaacatggtgaaaccccgtctctactaaaaatacagaaattagctgggtgcagtggcaggtgtctatagtcccagctactcgggaggctgaggcaggagaatcgcttgaacctaggaggcagaggttgcagtgagccgagattacgccactgcactccagcctgggtgacagagtgagactccatctcaaaaaaaaaaaaaatccaactttcttttagttggccagtcattaaagatatttacaaaaatgtaaaacaatgccactaaattttttgattttgacaatagagttatgtttcataaaatgtatgttactgatattaacaggtaacaggtttatttgttgttaaaatatttttaaaatttctcggctggatgcattgtctgatacctgtaatcccagcactttgggaggctgaggcagacagatcacctgaggtcaggagttcgagaccagcctgaccaacatgatgaaactctgtctgtactgaaaatacaaaaattagccgggcatgatggcgcatgtctataattccagctgctcaggagactgaggcacgagaatcgcttgaacctgggaggcagaggttgcagtgagccaagattgcatcactgtactccagactggctgatagaatgagactctgtctcaaaaaaaaaaaaattatatttctttcttttaatttctaaggtgggaaaatgttgatagatataaccatcattaagaaaagttctggccaggcccagtggctcaccctgtaatttcagcactttgggaggctgaggtaggaggatcgcttgagaccaggagttcaagaccagctggggtgagaccccgtctctacaaacaaaaatttaaatttaaattttaaaacacaaagttaggcatggtggctcacacctgtaatcccagcactttgggaggccaaggcaggtgaattacctgagctcaggagtacaagaccagcctgcacaacatgggaaaaccctctctctacaaaagatatgtatatacgaaagttagccaggtgcagtggcatgccacctgtagtcccagctactcaggaggctcagacaggagaatctcttgagcctgggaggcagaagtgcagtgagccgagatcatgccactgcactgcagcctgggcgacagacttagaccctgtctcaaaaaaaaaaaaaaaaaaagagaaagaaagaaattcatttaaaagggtgttatgttttacccattatcagggtgtttgcaatagaagcccacagccttctctctccacatagacatggtaggagttgtagtgattggtgttggtctctgtatgtggtaacatctgttttgtgagacctttaggaagggggctgtgattgggaacttcagtgacggaacactcttcagtcttgcaaggatatgtatgagatgaataaccataaaatggtccattttgaggttgaacatatgtgttggttgtgggccacatttatgtaactcaggtataccctccatcagctttctggtttcaggagcaaggaaaagtggacagtgaaggaatgtgaatattagcaagcgtataataaaccctgaagattttacacatcttgtgtttttaaatttttttaatttttaatttttgtcagtacatggtatatatatttatggagtacatgagatgttgtgatacaggcatgcagtgtgaaataagcacatcatgaagaatggggtatccaacccctcaagcatttatcctttgagttataaacaatccagttacactctttattttaaaatgtacatttaggctgggcatggtggctcacgcctgtaatcccagcactttgggaggccaaggcaggtggatcacttgagatcaggagttcaagaccagcctggccaacatgaggaaaccccatctctactaaaaaatacaaaaattagctgggcgtggtggtgggcacctataatcccagctactctggagactgaggcaggagaatgacttgaatcccagagcagaggttgcagtgagccgagatcatgccactgcactccagcctggatgacaaagcaaaactccatctcaaaaaaaaaaaatgtacaattaagttcttattgactatagtcaccctgttgtgctatcaaatagtaggtcttattctttctattttttgtacccattaaccatccccacctcccactcagcctccctctacccttcccagccttcagtaatcatccttctactctctatgaccatgagttgaattgttttgatttttagatccacaaataagtgagaacatgcagtttgtctctctgtgcctggcttacttcatgcagcataataacctccagttccattcatgttgcagatgaccagatctcattctttttgtggctaaatagtactctattgtgtatatgtaccacattttctttatccattcatctgttgacagacacttgggttgattccaaatcttggctattgtggacagtgctgcagcaaacatggagtgcagatatctcttcgatatactgatttcctttctttctttcttttttttttttaaacggaatttcattcttgttgcccatgccggcagtggtgcaacctctgcctcctgggttcaagcgattctcctgcctcagcctcccaagtagctgggattacaggcgcacgctaccatgcccagctaattttttgtatttttagtagaagtggggtttcaccatgttggccaggctggtctcgaactcttgacctcaggtgatctgcctgccttggcctcccaaagtgctgagattacaggcgtgagccaccacgcctggcctactgatttcctttcttttgggtagatacccagcagtggtatcgctggtccacaaggtagctccatttttagttttttgaggaacctccaagttgttctgcatagtgattttactgatttacattcccaacaaagtgtacaagggttcccttctgttcacgtcttcactagcatttgttattgcctctcttttagatataagccactttaacatacacatcttaattaagctaagtgcacgaaaataatggaatcgacgtatcttacaagacataacatacgatattatgcaaccaataacagtctctgtctttctgcctgcctgcctgccctcctttctaacttccttctctcttccttctttcattcttatttatttatttatattgtttttgagatggggtcttgctctgtcgcccaggctggagtgcagtggcgcaatctcagctcactgcaacctccacctcgcgggttcaagcgattctcctgcctcagcctccctagtagctgggactacaggcacgcaccatcatgcccagctaatttcttttttgggggttttgttgttgttgttgttgtttgtttgttttttttgagacagagtctcgctctgtcacccaggctggagtgcagtagcacaatctcagctcactgcaacctctgcctccggggatcaagttattatcttgcctcagcctcccaagtagctgggattacaggtgtgcactaccacgcctggctaattttttgtagttttagtagagacagggttttgccatgttgaccaggctggacttctttttttttttttaaacagagtttcactcttgttgcccaggctagagtgtggtggcacaaatcagcacactgcaacctctgcctcccaggttcaagcaattctcctgcctcagcccctcaagtacctggattacaggcacctgccaccacgcgcagctaattttttgtatttagtagagacaggatttcgccatgttggccaggctgttctcgaactcctgacctcaggtgattcacccacctcagcctcccaaagtgctggaattaccaccgtgcccagctggcaggctggtcttgaactcctggcctcaagtgatcaacccgtctcagcctcccaaagtgctgggattacaggcataagccaccacgcccagcctggactcatttttgaaagacattagatttgccaggcccaggtttgctgtgtgttttgtgtatttcactatttcgcttatttatgggaccccacttagctctttcctgatcattcccagaccatggaagatagaagtgtcctgctgtctgcagatagtttatgtgtagccacaggaatgctcaagaatatatagacctctagtcatataactgtgcttattatacttccttcatgccacaggcctgcagctgtagattctgtcatgcttcattacctccttcctccagtacccttcttcatctcctccaatgtccttggccgagtgcagtggctcaggcctgtaatcccagtgctttgggaggctgaggcaggaggatcacttaagaccaggagtttgaggccagcctgggtaacatagtgagattctgtctctaccaaacaaaatattaaaaatcaaaattaggctgggtgcagtgactcacgcctgtcatcccaacactttgggaggccaaggcgggcgtatcatgaggtcaggagttcaagattgactaacatggtgaaaccccatctctactaaaaatataaaaattagccaagtgtggcggcgcacacctgtaatcccagctactcaggaggctgaagcagaagaattgcttgaacccaggaggaagaggttgcagtgagccaagatcgtgccactgcactccaacctgggtgacagagcgagactctgtctcaaaaaaaaaaaaaaattcttcatcttctcattaagatatttcctggataaattagcttgtcaaaacctgaccctactcatcaattttaacctcatttaaaatgggtcaggtgggctgggcacggggctcacgcatgtaatcccagcactttgggaggctgaggcgtgcagatcatgaggtcaggagatcgagaccagcctgaccaacatgatgaaaccccttctctactaaaaatacaaaaaattagccgggcacagtggcacgcgcctatggtcccagctattcgggaggctgaggcaggagaatcacttgaacccaggaggcggaggttgtggtgagctgagatcgtgccattgcactctagcctgggcaacaagagcaaaactctgtctcaaaaaaaaaaagagaaaagaaaaaaaattgagaacactggggcaattagaatttaatctgttgactgggaaattattgatacttttattaagtatgataatgatattctgattattatgtgtttttctaagagaagttgttgataatctgttggatactaaagtatctgtgggtgaagtattatgatgtttggcatgtgggatttgcctcacagtacatggggaataaaagatagaagggaagagataaaacagggtacaccttgttaactgttgaagcagactggtgcatatcggggggccattactgtcaactattctctgtacttttgtgcatcttgaaaattttcataataaatgaaaaaagtttcttaatgtacactaatgcgtgggtttattgtttcagggactggtgacattcagggacgtggccatagagttctctctggaagaatggaagtgcctggaacctgctcagagggacttgtacagggaggtgactctggagaactttggtcacttggcctcactaggtaaggagattgtatcacacgggccagacggaaagcaaggcaacagggactacaaccatggggtgcagtttccatctctgcctaaatgggtgaggagaggaaactgtcacaggagacgctacaaactacagccatagagagaggcccggccagcaatagctgtagctacttccagagctcctgggtcaaaggagggagagaggagggtaagaaatgcctggtgctctctctcctcctgtccactgatctccagctgatgctttctgtctgccaaagccaatgagaagccatagggcatgggtaatgcagtccttacggtgagctgtcgggatcccagagctgggcacagaacaaggccaggagcatcaaggaatagattggaggggaaggaggggttcatggagagtgatcaccacacatttactccacataattcaggactacccttctggaatttctggtttcttcattatgaatttctagggcaacttacaagtttctgactgaatttctggtgactgaaaaattgttttgtgctttgtggaactagaaacaagtcattctgctgggcagctcggtcttcctatcctttggacaaccttccacctaccttgtaattgcgtcttttccatggtgaccagggaactgggtttggattttggagcggtctgatcacaccccatttcttttcctgtaaacaggactctccatttctaagcctgatgtcgtctccttattggagcaagggaaagagccctggatgattgcaaatgatgtgacaggaccatggtgcccaggtaagcgagggccgatttcgacaggggaaggtccctggatgagtcgactgacaggagtaacttgagttactgtgggaagttccctcaaagccctactgtggaagaaaggcctgaaacgtgaagatgtggcgagtaaagactttattagcgtcagcttccaagagaaccttggcctactcccattaattcctctctggtctctgttctctcacattttcctttctttttaaaaagagatgtacctatttcttccccagtggccaactttttacctgtactttgtatcctttttctttaagagacaggatctcactctgtcacccatgctggagtgcagtggcgtgatcatagctcactgcagcctccatctcttgggcttaagcgatcctcccactttgggaggccaaagtgagattacaggtgtgaaccatggtacctagccagatccttttttctacaagtgtcttcatcccttagaaaaacttatttttggccgggcgcagtggctctacgcctgtaatcccaggactttggaaggccaaggcgggcggatcacgaggtgaggagatcgagaccatcctggctaacatggtgaaaccacatctctactaaaaatacaaaaaaattagccgggtgtggtggtaggcgcctgtagttccagctactcgggaggctgaggcaggagtatggcgtgaacccgggaggcggagcttgcagtgagccgagatcgcgccactgcactccagcctgggcaacagagcgagactctgtctcaaaaaaaaaaaaaaaaagaaaaaagaaaaacttattttcttggccaggtatggtggctcatgcctgtaatcccagcactttggcaggctgaggtgggtggatcacctgaggtcaggagttcaagaccaccctggccaacacggtgaagccccgtctctactaaaaatacaaaaattggccagacgtggtggctcacacctgtaatccctgcactttgggaggctgaggcgggcggatcacgaggtcaggagatcgagaccatggtgaaaccctgtctctactaaaaatacaaaaaattagctgggtgcggtggcagacgcctatagtcccagctactcaggaggctgaggcaggagaatggcgtgaacccaggaggcagagcttgcagtgagccaagatcacaccactgcactccagcctgggcgacagagcgagactccatctcaaaaaacaaacaaacaaacaaacaaaaaacttagctgagcatggttgtgggtgcctgtaattccagccactcgggaggctgaggcaggagaatctcttgaacccatgaggtggagattgcagtaaaccgagatcatgccattgcactccagcctgagcgacaaaagtgaacgtctatctcaaaaaacaaaccaaaaaaaaaaccattttattggctgggcacagtggcccatgcctgtaatctcagcactttgggaggccaaggtgggaagatcacttgaagccaggagttcaagaccagcctggccaacatggtaaaaccccatctctactaaaacctccgcctcccagattcaagtaattctcctgtctcagcctcctgagtagctaggattacaggtgcacgctaccacacctggataatttttgtattttcagtagatacagggtttcactatgttggccaggctggtctcaaactcctgagctcaagtgacctgcccacctcaaccttccaaagtgctgggattacaggcatgagccactgcacccagccagctgatcctcttaatgagtatttttttgtagattgtctctcactttacgtttgtctaatgttttctcacagtgagattctgcattttagcaagaatatcacagaagtgatgttatgttcttctctgtatatcacatatcagacatcaacatggcttattactggtgctgttcagtttgatcacttggtaagataggtgctgttcacactttgggaggccaaggcgggcgaatcacaaggtcagcagttcgagaccagcctggccaatatggtgaaaccccgtctctactgaaaatataaaaattagctgggcgtggtggcgggtgcctgtagtcccagctactcaggaggctgagacaggagaatcgcttgaacccgggaggcggaggttgcagggagccaagatcacgccactgcactccagcctgggcaacagaaaaaaaaaaaaaaaagataggtgctgttcagtttgatcacttggtaagatagggcctgtcttgtttctcccctgtgaagtttccatccgtaattgataaatatcttatggcgaaatactttcacactaggcaaatgtgctgcttttcctcctcccactccgattttggcatccatcactggaccttgtctgcaccagttattactctgtcacttgtctaatgttgattttctgtgtcccttattccttcaccatttattaattggaattcttcaataaggaagaactgtccctagccctcttccattcacttgttcattcaatgatttctttatatcacgatgagttcgtgggtatttattttattctatgggctgtagtcactactttcattgtttatttcattgctcgaatcgttcaggctttggcccttgaaaactcgttaagcttggctcctgggttctctcaacacacccacattctcttttatatacttccacattttctggtaccacagcatgttccatggttatttcagatttttcctgcctcagccctgaaatcagccagttctcaaaagaatgctggttccttttattgaaaaatggttcaggaggcagaggtagctgagagccgagattgccccactgcactccagcctgggcaacaggagtgagactccatctcgggaaaaaaaaaaaaaaaaaagaaagaaaaatggtaggaaatcgatcatatctttgaactttttctgagcaaagcaagaccttaacatctttaccataccatcttttacttccctgtgccctagaccaggggtcggcaaactgcaatctgtgggtcaaatgcagtccataaccagtttttcatacagccctagagccaagaacagttttgatattttgaaagtgttaaaaaaaaaaaaagaatatgctgtagagactttatgtgttcaacaaaccctaaaacatttaccattgggcccttcacagaaaaagtttgtttttatgtgtttttttttttttttttttgagacagagtctcactctgtcacccaggctggagtgcagtggcacgatctcagctcattgcaacctcagcctcccaggttcaagcaattctcctgcctcagcttcccaagtagttgggaatacaggagtgcgccaccacgcccagctaatttttgtatttttagtagagacaggatttcgccatgttggccaggctggtctcaaactcctgacctcaagtgatccacccacctaggcctcccaaaactcccaaagtgctgggattacaggcatgagccaccgcacctggccttcccactttcacttccaaggacccttgtgaatacattgtgtccacccagataaactgggataatctcgccatcttgtggtggtcaactgattagcctttttttttttttaattttttttttttgagatggagtttcgcccttgttgtccagactggagtgcaatggcgagatctccgctcatcgcaacttccgcctccctggttcaagtgattctcctgcctcagcctcccgagtagctgggattacaggcgcccaccaccacgcccggctaattttgtatttttagtagaggcggggtttctccatgttggtcagactggtctcaaactcccgacctcaggtgatccaccctcctcggcctcacaaagtgctgggattacaggcgtgagccactgtgccctgccctgattagcaatctgaattccaactccccttgctgtgtgacaacattcataggttccaggaataaagacacagacatctttgagtgccgttatcccacctaccacattctgtatgtattttttttagcaaagttaattgaatatgcataaattaacaatgtatggacgggcgcggtggcacacacctgtaatcccagcactttgggagaccagtaggtggatcacttgaggtcaggagttcgaaaccagtctggccaacatggtgaaaccccatctctactaaaaatacaaaaattagccatgtgtggtggcaggtgcctgtaatcccagctactcgggaggctgagacaagagaatcgcttgaacccgggaggcggaggttgcaaggaaccaagatcgatcgcgcatctttattccagccttggcaacagaacaagactccatctcaaaaacaaaacaaaacaaaataaaacaaaaacaactttatgggtacgactctactgtaattccgtattaaaatattaagcctattgctgttgattccataaaagtgttcttgtctttcacagaatatttggttggtgtgttttctaatttcttgcagttctgaaaaataataatcttttatttattagatttttaaaaattgtgataaaatatacattacataaggggccgggtacagtggctcatgcctgtaatcccagcactttgggaggctgaggtgggcagatcacctgagatcaggagttccaggccagcctggccaacatggtgaaaccccatctctatgaaaagtacaaaaaaaaaaaattagccgggcatggtggcacatgcctgtaatcccagctacttgggaggctgaggcaggaaaattgtttgaacccgggaggcggaggttgcagtgagccaagatcacaccactgcgctcccagcctgggcgacagagcgagactctgtctcaaaaaaaaaaaaaattacataatatttatttatttatttttgtgagacaggttctggctctgttgcccaggctggagtgtagtagcacgatctcggctcactgcaacctctgcctcccagtttcaagccatcctcccacctcaggttcccaagtggctggtgctacaggcacatgccaccatgcctggctaagtagataattcagtggcatttagttcattcacagcattatacactctgcttccagagcttatgcatcatcccaaacagaaactctgtacccattaaacaataactctattttccttcctccagtccctggtcacctctgttctactttttgtctgtatgaatttgcctattctaggtatctcatgtaaatcatccagtatgtggccttttgtatctggcttatttcactaaggataatgttttatccaagttgtagaatgtctctgaattttattctttttatggctgaataatattccattgtatgtgtgtatgtagatgtatacatgtataaatactaatatacatgtgtacatattatatacacactttgtttattcactcatctgttttttgttgttgttgttgttttgtttttttttttttttgagacggagtctcactctgttgcccaggctggaatgtagtggcatgatctcagctcactgcaacctccacctcccagatgcaagagattctcctgcctcagcctcttgagtagctgggactacaggcacccgccaccatgcctggctgattttagcatttttagtagagacggggtttcgccacattggccaggctggtctcgaactcctgacctcaactgacctgcacgcctcagcctcccaaagtgctggggttacaggcatgacctaccacatgcggccccctcatctgttcttggagttgtttgttttttgtttttaatttttttttctctctctcttttatttttccttgaagcccttgagtctcactttgtcgcccaggctggagtgcagtggcgggatcttggctcactgcaacctccgcctcccaggttcaagtgattctcctgtctcagcctcctgagtagctgggactacaggtgcacaacaccatgccaggctaattttttgtatttttagtagagacgggtttcaccgtgttagccaggctgggctcgaactcctgacctcatgatccatctgtcttggcttcccaaagtgctgggattacaggcgtgagccactacgcctggcccctaaatttatattctttataaatttttatcatcttggcctatttctgagaaaggtgaattgaaatctccaagatgacgattttgttaatttcttcttgtgtgtcttttgaattttgcattatatgtttggaggctgggccaggcgcggtggctcacgcctgtaatcccagcactttgggaggccgaggtgggcagatcatgaggtcaggagatcaagaaaatcctggctaacacagtgaaaccccttctctactaaaagatacaaaaaatcagccaggcgtggtggcacacggctgtagccccagctactcgggaggctgaggcaggagaatcacttgaacctgggagccagaggttgcagtgagccaagattatgccactgcactccagcctaggcgacagagcaagactctgtctcggccgggcaccatggctcatgcctgtaatcccagcactttgggaggccgaggtgggcggagcacaaggtcaggagatcgagaccatcctggtcagtgaaaccccatctctaccaaaaatacaaaaaattagccaggcgtggtgacgggcgcctgtggtcccagctactcgggaagctgaggcaggagaatggcgtgaatccgggaggcagagcttgcaatgagccgagatcgcgccactgcactccagcctgggcgacagagcgagactccgtctcagaaaaaaaaaagagactctgtctcaaaaaataaataaaaataaatatatatattaggaggctattaggtgtatataactttagaaacataaatcttcctgctgaatggaattactttcttgattatagagctaccctgcttaacccaaaatgatgatttctgtttttaaagtctatttttttttttttgagatggagtttcgctcctgtttcccaggccggagtgtaatagcacgatattggctcaccgcaacctccgccccctgggttcaagcaattctcttgcctcagcctcccgagtagctggaattacaggcatgtgccaccatgcccagataattttgtatttttaatagagacagggtttctccatgttggtcaggctgatctcaaactcccaacctcaggtgatccacccatctcagcctcccaaagtgctggggttgcaggcatgagtcaccgcacccggccacaccttttattttcaaacaccttaggtcttcatgtcttaaagtgtgttacttgttactactgtgcacctagattttggtattttatccaatctgacaaatgccgtcttgtcttttttttttaaacaagttcttgctctgttgcccaggctggagtgcagtggcactattctcggctcactgaacctctgtccctgggctcaagccatcctcccacctcagccttctgaatacctggaaacacaggtgcctgccaccatgcccagctaattttttgtgtttttggtagagatggggttgcaccatgttgcccagtctggtttcgaactcctgagctcaagtgacccacctgcctcagcctcctaaagtgctgggattacaggcatgagccaccacgcccagctgggttggtttcaatggttagtgaaaaaggcagtatttccatctttggggaagattcaggaacaagaaaacaaacagaacagcagatgaatatgtaaatgaaaatctaattacaacaaaagtgttacagagtacaagaaatgggagaaaggataaaggcgtgtgtttagggctgtcaggctgagagctttcttgaaagtgtgagtttttgccgggcatggtggctgacgcctgtaatcccaatacttttagaagccaaggcggctggatcacgtgacgtcaggagttcaggagaccagcctagctaacatggtgaaaccttgtctctaataaaaatacaaaaattggccgggcgtggcagcacatgcctgtaatctcagctactcgggaggctgaggcaggagaatcgcttgaaccccagaggcagaggttgtggtgagctgagatcgcaccactgtactccagcctgggagacagagcaagaccccatgtcaaatattaaaaaaaaaagacaagccaggcacagtggcaaacgcccgtaatcccagcactttgagaggccgaggtgggcggattacctgaggtcaggagtttgagaccagcctggccaacatggtgaaactccatctctactaaaaaagcaaaaattacccaggcatggtggcaggcacctataatcccagctactcgggaggctgaggcaggagaatcacttgaacctgggaggcagaggttgcagtgagcgcctgggggacagagtaagactctgtctcaaaaaaaaaaaaaaaaaatagagagtgagttttcatctgagaccttaaggatgagaaaagcagcaaaaagcccaggacaggattcttgatagatggaagaacctgatgagagatctgagatggaaaaggcctagatttattttacatgctcatagatggctggtggttttgtacactgggaggaaaggggagaatgttcaatgtgaagaggccctgctcttgctgagacacagtggtgacaaaaacaagcagggatctgctttgccaagagccctgtgagccatggcagtgagtttgtaattcttttttttttttttttttgagacagagtttcgctctgtcacccaggctggagtgcagtggtgcgatctcagctcaccacaacctctgcctcccggattcaagtgattctcctgcctcagcctcccaggtagttaggattacaggcatgtgccaccacggccggctaattttgtatttttagtagagacagggtttcttcatgttggtcaggctgatctcgaacacccgacctcaggtgatccacccacctcagtctcccaaagtgctgtgattacagacatgagccactgcacccagcccttttttttttttctgagatggactctcactctgtcttccaggctggagtgcagtagtgccatcttggctcactgcaacctctgcctcctaggttcaagtgattcttgtgtctcggtctcccaagcagctgggattataggcgcctgccaccatgcctgctaatttttgtattttttagtagagacagggtttctccatgttggccaggctggtcttgaactcctgacctcaagcgatccatttgccttggactcccaaagtgctgggattaaggcataagccacctcgcctggcctttggaattaattcttaatgcaccgaaatgggaaggcagtgaaatgtttaagcagagattttcattttgatggacatcaactttatgtggtgggaagtgttgaaaatatagatgccttatttacatgaaatgtccagaataggcaaatttatagagacagaattagtagctctgtgccagtaatggttgccaggggctggagggaatagggaatggggagtgactgcttaatgggtgggggggtttctatttggagtgataaaaatgttctcagccaggcgaggtggctcacgcctgtaatcccagcactttgggaggccagggcgggtggattgtttgaggtcaggagttcaagaccagcctggccaatatggtgaaaccccatctttactaaaaatacaaaaattagctgggtgtggtagcagtgcctgtaatcccagctactcgggaggctgaggcaggagaatcacttgaacccaagaggcggaggttgcgtgagccaagattgtaccactgcattccagcctgggcgacagagcaagactccgtctcaaagcaaaaaacaaatttagaacccctggcttaatttgtcttcttgctcccttctggcaccatgtgagctcttcacatggtgtgctttcatctgcttttttgaaattgcataatatttgagatgtatataaggcattcactttttatggttatttatttttgtctccctgttctactatagttttttttttttttttttttttttatgagacagagtcttgctctgtcgcccaggctggagtgcagtggcgcaatctcggctcactgcgacctctgcctcccaggttcaagcgattctcctgcctcaacctccctagtagctgggattacaggtgcctgccaccaagtgtggctaatttttgtatttttaatagagacagggtttcaccatcttggccaggtgaactcccgaccttgtgatccacccgcctcagcctcccaaagtgctgggattacagatgtgagccaccgtgcctggcctctactatagaattttttatttctcatagagaaggatcacagcttgtatttatctttttcttatttttcagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaattcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtacaccagcgaatccacactggtgagaaaccctacgagtgtaaggaatgcggaaagggctttattcacagctcagaagttactcgacatcaaagaattcattctggggagaaaccctatgagtgtaaggaatgtgggaaggccttcagacagcacgcacagctcacacgacatcagagagtccatactggcgacagaccctatgaatgtaaggactgcgggaaggcatttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatctggctcagtactaggtaatttttaatgtagtgtaattaatgtcagaaaacacctgtcacttccatcatagaacatcagaaaactcacacccaaagaaaattaaataaatgtgggaattctttttgcctc

SEQ ID NO: 760 - DNA, 22240 bp, Homo sapiens
gggagacagaacttgaggactgaggagagaggaggcccaggacagaaccctaggaacactgccactcaaggtggcagctcagcttcctggcaggcagcaccaccctgggctctggagtcaggcagagacagtcttgaaagcgggctctggagttctggggctgagcgctcttggcaaagtcgggtaccctctttgatcagctgtcacacctggcgataatggcatcagagagagataccctgcgaggatgccgtgagatgcgccaggtaaagcacctggggtcagaaagccaccccctcctcctcttctccgtgacccccctttgctacacaaacacaccccgaccccgaccgtccccagcctcccggtccttcggggttggatggtgaggtgggtcaggcaaggggggccgagctcgggtgacgcggcgctcacgtgacccgccgggcgcctacgtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtcagtgtgaaggtgggcgctgccggcggaaccacggaaggggtggaggtggctggcagtaggagtagggaggggcggagaaaggatccgggagactggtgaggagggggaagcggagcggtcggaggcaagggcgggggagcctggcccgccttctcgacgaccccctgcactgagccgtccatccattttagtactggaaatggagtacgggggggcaaccccgcagtgcaacagtgaaacgtagacatattctggaaataaccgcctctcacaatctgctcccatggaaacatctgacctccgcaaaaacggggtggcgctgggacaggttgcctccaggggaaggggacacagagacaaacgcagtttggaaagcatcctggtttggtgcccgaggcctggaaagaaatggcggctggggtgcgggggatgtaggggaggaaaacgttgggtaagcagggcctggactcaggaaagggaaccgagtccctgtgagaccgctgactgcgcagcccctacccctgtctcctgtctgtccgcaggtctgcgcgtctgttcccagcgctctgcgaggcctaaaaaggaggagcaacctgtccagaatccctgcaggtctgtgaaggtggttgtgggggagctcaatggacagggccctataagggttgagagtgtggagggcccggccagggccgaactggggcccctgcccatcccccactcacatgaacacacaccttaccaggctgaaccagtgcagagaaggtggcagggactgccagggaatggctggctcacgtgtgtgggaggagtggcaggctacgtggtgggcagaaggccctcttgggggccctgccagcttaggggaaccctcaccaggggtgagatgcaagtactatccagacctgcattccaccccatgccctcagtctcccatgtctcttatttgtctcctcttccctccattcccatcccccaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgcatatacagtatcagcccgtttttataaaaatgtaaatgtttgcataatgcatttgtgcacaaagaaaactctgaaagcatgtacactaaaaagcagccaatggttattcctgaatggtatccaaaaatgagttcaatcacttgctgggtaggtacctccatgccattctgctgttgttgtgcccatcctcatgtcttccctaggtgtaactacgtgagtgggcactgctaccccttctcctgggtcctttaccatcctatggctcccccataggatgcgattctttttcttttctttgctctcactcatctctaccttttcttaaaggatatgtccttttgtcataacaataattttaaaaactaaacgagaaaacaatacataaacaattgaactgttcaatgagcttatgagggtaataaagacacttaaaatttctgttgccagaacataaaatgataagtaaaattcatattacctctgagactaacagctagaggtatcaacctggcagttataacaaatccattgctgtaagggtcagtcttgccatctgtgaaatggggataatacttatctcacaggactgcccagtggatcagatgaggtattgaacatgtgagctgtccttacaggagcaggacccagcaccctgtcagacacttaaaagaagagctgaaggtaggtttcacctgtccccaggaacaactccaagcagctgagtagagggtgccatccttctctggatactatcatatctgctgggcacttctgttctgctatgccctgtatatgtactgtctgctgacagccactgatataatggagtactcatggtgacaaagcccttctgattccctacagtccccaaagggccacagtcccaattgcaggtggttctactctagggcttcttggagcccactgtattacacagttcttagcaaagtagccattaacatttttagttcattttatatttgcttacagcttcatttctcttcttaggatttgagacattttgggtctacttgggactgtgtcctgagtctaacctattggctagataatgaactgtgtttgcaccaaacaccctaccccagtaccacaggtgaaccctatctaaatttttatacctttctaagtgtgagttttctctaaaaagcctcattgactggcctactatacaaaatcaagggacttatccatatataatcacagagataaccctgtgtgaaacatcccttcccattctaaaccacttgcaactgaaagaggtacagtgctcttaaaaatattaaaaactcttaggcatttttatttagcccaccagtatattcccttatcaaaacagacttttaaaaaattcatcctgatatccgttgcactgtacttgacacatatatttaacaattacttgattatgactgagtcaggagccttgagtttttgacccagtgtatccttgggcaagtaatttcacttgtcaaaaatacaacttgaaattcaaaaataaataatacaggagaagtgataattctaaatccagctcataaaccattttaacaatgtataaaaatgatttttttcaaaatacgttcaaaatatgttaaacgactccctgggaacctccctggtccctggcacaaacccagaatttctaggaatatggctctagaacctgcaatttccacaaactccccaggtgattctgatgtacagtgaagttttacacattgcatgatctcaattacattaaatataaaccataaaaaagtaggaggaagtataaggaaatgtttatctgaattcagtaggcacaaagcacatatgtaccaacatgttttaaaaaatcaaactatgtgctagatttgtacattgacaactacaaaacattgatgagagaaattaagatttaaataaatggaaagatacattgttcatggattagaatggctgcaaagaaacagtggcacaggactccctcaaggtggatgccctaaccaaggttctgcctgtttttaccttttgggagggtcttgaaatctaaagactaccaggccacattcccttctaaatagtccatatctgtttattcaggtagtgagtgtacccactgggggcatccactgcagaggcaactatcaataattgggaggaaaaaatgaccatctctgtagatatcattcagcctccccattcccctgccactgctatcccaatgtttgctcaatgggcccttgtacaaagtggccacagaaacagaaatagaactatgtgagagctcaacaatattgacttcccataccaacctgatctgactactctcatagctgagtatgaaacctgccaacagcagaggccattgctgagaccctaatatggtatcatttccagaaggaatgtcgattacattactttgtgccctataaatatatacaattataaattgtcaattaacaataattatttaaactatgagaaataatacacaagtacaatgtagcaagatgtaatatcaatatacaaaatcaattgtatttctttatagtagaaattaacaatctgaaatgaacttaagaaaatgattccatttacaatggtatcaaaaagaaaaacaatcttgggaataaatttaacaaaacaaatgccagacttgtatatggaaaagtacaaaatgttgtcaaaagaaactaaagacaacctaaataaatggaaataaattcaatgttcattgattgaaagacttaacattgttcagatggcaatattccctaattgatttacagacttaaggcaatcactatcaaaatctcccctggcttctttgcagataataacaaagtgatcctaaattataatgacccaaaacagacaaaacaatcttgaaaaacaataacaaatggagttcttacactttctaacttcaaaacttaccacaaagcaatagtaatcaagacagggtggtcctaccataaggatagatatataaatcaatggaatagaattgggaatccagaagtaaactctcacttttatgctcaatggattttcaacaagtctgccaagacaattcaaagggaagataatagtttttaaacaaattgtgatgaaaccattagatatccacatgccaaagaatgaatttagaacattatgtcacaccctacatcaaagtgaactcaacacagatcataaatataaatgaaagagctaaaactatacagctcttagaagaaaacatatgcataaatattcatgaccttgagttaggcaattttacttagatacaataacaaaatcatatatgacaaaagatacattctacttcatgaaaatggaaacgttttgtgcttcaaatgataacatcgagaaaatgaaaagatgatccaccagatgggagaaaataactgcaaataatacatttgataaggagctaatttccagaatatataaaaaactcttacaactcaaccattaaaaaaaaagagaacccaattttaaaatgggcaaatgatttgaatagatatttctcccaagaagatatacaaatgtccaataggcatatgaaaagaagctcaactgtattagtcactagggaatgtaaaccagaaccacaaagtgataccacttcacacacagtaggatggctaaaacgaaagagatagaaaataagttttggtgaggatggggagaaacaagtcctcatacattgctgatgggaatgcatttgcttgggataacaaattggcaattctttaaaatgttaaacataatgtgtcatatgacccagcaattccattcctaggtatatacacaagagaaatgaaaacatacagtcatgcaaaatgtatacacaaatgttcatagcagtattgttcataatagccaaaatatagaaaaaaaatccatgaactggtgaataaacaaatatggtatattatacaatgtatttggcaataaaaaggaagaagtactgatacatggcatagcatggatgaaccttgaaaacattatgctaagtgaaagtaggcagtcacaaaagaccacatagtttattatccaatttataataaatggacatatcaacaaatctatagagaaagtagattcgtggttgcatggggcttgcagaagggcaggaatgaaaaatggtaataggaaggttttctttaggggtgatgaaaatgtaaaattggatagtggtgatggttgcccacctccataaatattctaaaaaccattgaattgtgcactttacatgggtgaattataaggcatatgaattatatctcaataaagctgttaaagagaaataattatctacaataaaaataagaacaatgtgttacatggcttgtaacatatgtagaagtaaaatgtacaatgtggtggttaatactgagtgtcaacttgattggattgaaggatgcaaaatattgttcctgggtgtgcctgtgagggtactgcctaaggagattaacatttgagtcaccgaactgggagacgaagacccaccctcaatctgggtaggcactatctaatcagctgctagcctgactaggataaaagtaggcagaggaacgtggaaagactagaatggcttagtcttctggcctacatctttctcccgtgctggatgcttcctgccctcaaacatcagactccaagttcttcagtttttggactcttggaccttcgatcacagactaaaggctacactgtcagcttccctacttttgaggttttgggactcagactggcttccttgctcttcaacttgcagacggcctattgtgggacttcacctggtgactgtctgagtcaatactccttaataaattcccctttatatatacatccatcctattagttctgtccctctagagaaccctgactaatacgtacaacaatagaaaaaaagatgggagggggaatgcacagttgtagggttcttcgattatccatgaaatcatttacagttgacccttgaacaacacaggtttgacctgtgttttttgatgtggatttttccaaccaaactgagatggaaaatactgtacttgtgggatgtgaagtctgcctatagcgagggctgacttttcacaaagatgggttctgcagagccaactccaggacccacctaggtatacatagatttgtatatcctggggagtggtgggtcctggaaccaatcccctaagtatactgagagatagctatcatattatttgaaggtagactgtgataatctatgatacatattacaaataccagagccatggctcagagattttgcctgagggaagggagggaagcaggatgtaaaatggagagttctaaattttttcccaaaggaaaggaattcatttgcaacagaatatggagaagtccaagttcaagggagctctcaaaaacagtggaggctctggtgcatgatatattaaaatatatattacagtatatatttggtcaatgtccccagttcctggcacagagctcctaaaacctttgggattttctgaatgataggagtgtcttttgttattcataatgagccccttttgactactcctgaatttatgctaatgaggtgacttagggtaagacccctagatagcttcaggatggggactggacaccagaaagaccaaatacatgattacaggatgggaactttctgccttgctcctgacctccagggattggagaggggataaaaattgagttcaattaccagtggccaatgattacataaatcattcctatacgataaaacctccattaaaatccctaaatgatggggctcgggagcttctgggttgggaatacattgatgtactgatcagatggagcacccagaaaaggcatggaagctctgtgccaaatataccccatatcttaccttatgcatgtcttccattaggctcttcctgagttgtatcctttacaataaactggtaatagtaagcaaagcacttttctaagttctgtgagtcattccagtaaattactgaactcaagaagggagtcatgagaactgtgaataaaaaatagactctcaggaccccaaactcactatggcaaaagggaaattaagcttgggaactgagtcatccaaaaactgccttccatttgttcccaaatagctgtaatttcacatgcttactttatcttatgtaaaatgtagatgtactgagcatgagatgaatgcataattgacttttcctctactcctttctttttacatgtaaaatgtagattcactgagtgctaatcagagcctcacaagaatgtaaccacttgcctcattgcctacccatcctccttttttttcttcccctcttgcttgctctttctcctttaaatactgaagttcccaaagccctctgtgggaaaaccacaggtcaccaatcctactgtgacttgtgtttcattttcctaggtgtgtcctcaaccttggcaaaataaacctctaatcaattgagatctgcctcagtcactttttggtttacagaaccctcaaatttgtactagcccaggctgaagtgtgggtaggttgggcaccccatttgcagctgccatctgaagtggagggcagtcttatacttaaaagcccttaaactgtagggtctgcactaactctgaggaattaatatcagaattaaattgaattgtaggacacccagttggtgccagagaatcagagaattggtaggtgttagaaaacaccacacatttgatgtcagaaatagtgccagaaaacaccacacgtggtgaaaggcaattgagaggacattggtagattcattggagatgcagactaagctgtaggcccactagtttgctggagacaacctgggacagagaaagctgggaggagacccactgggattagaacaaatctgtctgtggaatcatttatgccccagggcattgttgaaaacaatagggcaatcagcaggtaattagtggagctaaacagctgggtatggtcagggaaaaaaacagtcaaggaaagccctgccaaaggtgactgtgggcacaaccaaggctgagccttctggtgagcaacataacaggcttcacattgtgcaagcacagagtttactaaaataatctagctaatcactaaataaataaatatgcaaatatcagtaaaaagctccagatggggaagaggaaaatagtacccagaggtgctacaatatattatccaaaatgctcagttttcaacaaaaaattatgagatttgcagggaaacaggaaagtataacccatataccagaaaaaggcagacactaggagctccttgtgagagtggccagatgtcagtttgaacaaagacttcaaagtagctattattaatatgttcacagaactacaagaaaccatgattaaagaagtaaagaaagatatgatgatgttgcatcaaatataaaatatcaaagacatagaaattatttttaaaacaaattgaaattctgggattcaaaagtacaataactaaaatgaaaaattcagtattacacttgaactgccaaaagaatcagtaaacttgaaggtaaattgatagaaattatgcaatctgaataaccaagagaagaaaagactaaatacaaatgtacagtgcctcagagaaatgtggaacaccattaagtattacattagcaaaggaattactcccaacaagaaatccataggaaccaactgaagagatctaaaaatgatatctaagaaggtcaaaacctattaacatatactcgttctcctctcttctctcagcttctttaaaatacataagttcatataaagcaataattataataatgtattgttgagtttgtcagatgtatagttgtaacatacataacaataatatgacaaaaatggagaaggaaatagaatgatatagaaataacatttctatatctcactggaattaagttagtataaatctgaagctgattctgataagctaatatgtatatggtaagtctagagcaaccactaaggaaataactaaaaaatatggtttaaaaatcattttaaaaattaaaacgctatattagagaatattcagttaatgcaaaagaaagtggtaaaggaagattcgaggaagacaggagacctacagaaaacaaaaagtaaaatggcaggtataaatccaactaaatcaataataacattaagtctgaatgggttaaactatccaataaaagacagttgttaaaatggaaattaaaaaaccaagatcaaaccatttgctgtctatagcagacaaacttcagattcaaagatacaatagactgaaagtaaaaggatgaaaaaagatacatcattttgtctgattttactatagccagctttctggagtggccacagtaatattagacaaaacagagtttaagaaaaaaaaaagtgttagtagagataaagaaggacattgtataatgataaaagggttaatccatcaggcagatataacaattataaacatatatgcacctaacaaaagagcaccagagggctgggcacagtggctcacacctgtaattccagcactttgggaggccgaggtgggtggatcacctgaggtcaggagtttgagaccagcctgaccaacatggtgaaaccccatctctactaaaaatacaaaaattagccgagtgtggtggcacacacctgtaatcccagctacttgggaggctgagggaggagaatcacttgaacctgggaggtggaggttgcagtgagccaagattgtgctgttacactccagcctgtgcaataaaagcaaaactctgtctaaagaaaaaacaaaacaaaacaaaaacaaaggaaaaaaaccacaccagaatacctgaagcaatttacagaaatgaagagataaatagaccactcaacaataatagttgggatagttggggactttcaacttttaataatggatagaagaactaggcagaagatcaacaaggaaatagaagacttgaacaacactataaaccaactagaccaaacagacatatatggaacattccacccaacaaaagaatatacattcttctcaaatgcacatgggacatactccagaatagaccatatgctaggcaataaaacaaaccacaataaatttgaaagattagagataattctaagtatttcccctagcatagaatgaaagtaaaaaacaataacagaaataaatttgggaaactcacaaatatgtggaaattaaacaacacactcctaaatcactaacggatcaaagataaaataaagaggaaaattagaaaatatgttaagactaatgaaaatgaagatacaaaataccaaaccttacagcatgcgtctaaaccaatgcttagaaagacatttatagctgtaaatgcctacagtaaaaaagaaggctgggcacagtgacatgtgtcagtagtcccagctacttgggaggctgaggtgagaggataacctgagcccaggagtttgagaccagcctgggtaacgtaacaaggctctatcttcaagaaaaaaaaggaagaaagatctcatatcaataacctaaccttccaccttaagacactgaaaaagaagagcaaactaaacctaaagcaagcagaaggaagggaataataaaaactagagtggaaattaataaaataaagaatagaaaaataataggaaaagtcaataaaaacaaaagctggttctctgtaaggatcaacaaaatgaacaaacatttaaattgattagcctggaaaaaaaaagagaagactcaaacaactagagtcaaaaacgaaagagggtacattactattgactttacagaaataagaggattatggaggaacactatgaataactgtatgccaataaattacataacttagattaaataaatggattcctagaaagacactaccaaaactgactcctggataaatacagaatctgaatagacctataacaaataaagagaatgaactaccaatgaaggaacatccaggccaagatggcttcattggtgaattctaccaaacatgtaaataaaaattaatattcgcttttcacaaacttttacaaaaaaagaagaggagagaacatttctccactcattatatgaggccagtgttactctgttaccaaaactatacaaagacaccacatgaaaactacaaggcaatatctcttatgctgtagatttttttgaggatgcaaaaatcctcaaaaaatatttcaaacaaatccagcatcatatagaaagaattatacaatatgaccaagtgaggtttatcccaggaatgcaaagttgatttaacattcaaaaatcgatcaatgtaatacaccatatgaatagaataaagcacaaaaactacatgatgatctcaaaagatgaagaaaaaaatgttcaacaaaattcaacatcatttcatgataaaaacacacaacaaatgaggaatacaagcaaaattccttaacctgacaaagggtatatatgaaaaagacacagttaacaacatacttaatgatgaaagactggatgctttccccttaagatcaggaacaagacaagaatgtctgttctctccacttccattcaactttgcactagaggttctagccgcggaggttagaccaaaaaaaagaaagaaaagacatccagattggaaaggaagaagtaaaacaacctctgtcttagtccattcaggctgctataacaaaataccatacactgggtagcttataaacaacagaattttatttctcacagctctggaggctggaagttcaagaacatggtgccagcagatttggtgcctgattagggctgaatctctggttcacagatagcaccttctagctgtgtactcacatggtagaaggggcaaataagttccctcaggcctccttataagagcactaatcccttataatgctctaccctcacagagcacttcatcagacttgtaatttaccagaaataaacaatccaaataataacaagtattggtgaggatgaggagaaatggaaaccctcatacgctgctggtggaaatgtaaaatgacagttcctcaaaatgttaaacacggagtaatcatatgacccagcaattccagacctagttacatacccaagagaaaaaaaacccacaaatacatgtccacacaaaaacttacatgaatgtttatagcagcattattcataatagccaaaaggtgaaaagaatctaaatgtctatcaactgatgaatgcataaacaaaatgtggtatatttagatgatggaaaactatttggtcattaaaaataaagttttgatacatgctacaatatggatgggccttgaaaacattatgctaagtgaaagaagccaatcacaaaagaccatatattgcatgattccatttatatgaaatacagagaataggcaattccatagagacaaggagtagattaatggttggctagggttggggaggatggagggtagagagtcttaaccaaagggtataaactttctttatgaggtgatgaaaatgttctaaaattgattgtagtgatggttacacatatctcttaatatactaaaagccactgaactgtacactttcaatgggtgaactctatgtcatgtgaacaacaacttaataaaactgttttttttaaaaaaaaaaagaatgaaaaggggtcattattacagatcctctaagaacgtaagggacagtatggtagtattatgaataactttatgccaataaatgcaataatgtagataaaatggtcaaatttcttgaaagatacaaattaccaagctcactcaaaaaataaatagaaaacctgaacagaagagtggtgtttaaccaccaggtctctgaaagaaattaaaaaccctgattcatagagtatctgacttctaaagtgtaaaccatggccaattttaatcaatcaatgtatcatcactgaatgtagatttgataagagatagtgacaatcagctctcaatagctggcacaggccagttccagtatacaactgtctatatctttttttttttttttttgagacggagtctcacactctcgcccaggctggagtgcagtggcacgatctcggctcactgcaagctccgccccccgggttcacgtcattctcctgcctcagcctcctgagtagctgggattacaggcgcccgccaccacgccccgctaatttttttgtatttttagtagagacggggtttcaccatgttaggcaggatggtctggatctcctgacctcgtgatccgcccgcctccgcctcccagagtgctgggattacaggcgtgagccacggcgcccggccctaccactgtctatatctgtagaataaaattaatttgttattaaaaactttccaagaaaactccagacccagatgtcttcactagtgaattctatcaaacatttaaagctgaaataacacaaatgttaaacaaactctcagaaagtaaaggaaaaggcctcctctctacataatgaggcctgaattaccctgatgccaatacaaaaacattacaagaaaactatagacattatgtttatagatgcaaaaattcttaacaaaattttgggaatttgaatccagcaataaataaaaagtatatatatatttatcatgaccaagtgaggtttatcacaaaaatgcaaagttggtcaagtacttggaagtcaatttaattaaacatattaacaaaataaggagaaaaatatgaccacctcaatagatacagaaacagcatttgataaaagtcaataaaatctctcaggaaacaattagaaaggaacttccttaacctgaaatagggtatctattaaaaaaaaaatcacagctgacataacacttaatagtgaaagaatgatttcctcttatgataggggatcatgcaaggatgtcagttctcaccactgttattcaactatgtactggaaatcctagttagtgcaataaggcaaggagaaaaggtatgtagaggccaggcacggtggctcacgcctgtaataccagcactttgggaggacaatgccgaaggatcacctgaggtcaggagtttgagaccagcctggtcaacatggtaaaaccccatctctactaaaaatacaaaaaatagttgtgcgtggtcatgcgtgcctgtaatcccagctactcgggaggctgaggcaggagaatcacttgagcccgggaggcagaggttgcagtgagctgagatcgtgccattgcactccagcctgggcaacaagagcgaaactccatctcaaaaaaaaaaaaaaaaaaaaagaaagaaaaaaaaagaaatgcagataggaaaggaagaagtaaaaatgtattcatagaagaatcatgatcatgtacatagaatgccttaagaatctacaaaaagttattggaattactaagtgaatttagcatgatctaaagataaaaggtcaatatacaaaaatcaagtatatattttatatactagaaataaacaattagaagacaaaaaatttaaagtaccacttgcaaaggcatcaaaaagcatgaaataattagaaataaagtttattaaatatgtggagattttatattgaaaattataatacattactgagagtaattatggaagacctaaataaatgaagtataataccatgttcacgtatcagaagactcagtattgtgaaagtggcaattctcctcagattgatccatttattcagtgtaattccagttaagatcacagccaagaaaagcctaagacagcttaccaactaaaagtgatatagtattctagatggcatcctggaacagaaaaaaaggatatcaggtaaaaatgaagaaaatgggaataaagtatgggctttagttaaagacaatgtctcaatattggtttgttaattataacaaatgcaccatagtaatgtaagatgttaaaaatagaggaaacagggtttgggatatatagacactgtattattttctagattttttggtaaatctaaaactattctaaaaaaaagaattatatttttaaaataaaaaaacacgacgttaaaaaaaaggcaacaggagaaaaaaacgctttatattttattacctaaaatggtacttttttttcttgctttttgaatagaggccttgcattgtcttttacactgggccctgcaaattatggagccagccctgcctctgtcccagcctccttcccaggcctcaggctgaggttgttctgggtgcttgtaaaagtccctgaaaggccaaggctaagctgtggctctgttgcagcccagcagggaaggccaaaatagaatgagttatgtgctctgagcttgtctggattctgggaaatgcagcagcagccacagtccgcaggtggtccccactcaggccaaatcgtgttcgtaagcaaaggccctcccacctcagtatggtgggcagtatggaatcattgcttcctagagctagaagggacctcattcatggttctaccacagccctcgcccccaccatttagggagaaaaatgatacaaatagaggcaaggagaggggtaggaggctgccacacctccagagcctccagggagtgaatgacagcataagtcttgcccagacccaagcctagtactgtctctcttcagcccaggtctggacccaccttccctgtccctgtgcatttccaacagcctgagttgctacttagcctttcctcagagccccttccttgtttctctgagcatatacagggtgtgtgtgtgtgtgtgtgtgtgtgtgtgtgtgtgtgcgtgtgtgcgtgtgtgtgtttgagccccagttaggatgaggccacaagcagaaacagaaaagaggaggctcctgtcattgcttttcctacttgggaatttcccctggggcaggggtaggggaggagcccatgagagtcacaggctggacagggcctgctgcagtcaacaggtccaggtctgagagcaggtactgccattagtgccattaggaaagaatgcagaggcagcagccacagagggaacgtctgggctggagagggcagaactcctcaagtccaggcagacagagcctgcaaagtgaaaccaaggggactcgcaaagaaggagggttctgttcctgccacagaagtgcagcctccccagcaacaggaatccctggaggagaaacccaccctgggctttctcagatcccccagagaaaggccacaccacttggagactgttgtcatggcagcagctgcccagtgctgtgtgtaaatgtgggtggagcccactgcccaggagcagttttacatagtggttaaaggtacaatctctcatgccacactgcctatgttttgttttttttgttttcttttgttttcagatggaatctcttattggccaggctggagtacagtggcacaatcacggctcactgaagccttgagttcccaggcctctaacctcggcctcccaaggaactggaccacctgggaccgcaggtgtgcaccaccatgcctggctaatttttatcgtttctagagacaggatctcactatgttacccaggctggtcttgaattcctgggctcaagctattctcccatcatggcctcccaaagtgttgggattacaggcgtgagccactgcacctagccttaggttttaaatcccatctcagctacttactatcatctgtgtttccatgggaacaatttgtcacctcccagagctcagttgtcacacttttgaaatgggtttcaaaacaaacactcattagtaataatggaccaagcaatataccctcataggaccctaaatcaagggtatcaaatcaaatccatcagaaggacagccccaccccaaccccaaccctacacaaacaagtagcagatcacacttctttgtaacaaatgattgtcatttggtagcagaatcacctttaccttattccctcttgagagtcctttctcttaagggaacccgagatcagctactgctgggcagacttagagcccacatggagactcggtcttcattcctcctctcctgcttctatttcctcacacctccttatctgccctccatatttactaagttctcatcaaagtttaatttataccggtgcaggagctttcagggactatagtgtcttctattagcagcactagaaagcaagcaatctgagaagccacatgagagatgagaggaagggaactagctcggcagggcatactcctggtttcacatgcaataaggaaaagaaatttttttcacttggagtcagaactctctgctgagatacctatagatctttcccgagtttgctgactttatcaccctatttagtactagtggcatgctttaaattaatgatttgcagctaatatacagaatgatagaatctggattcaaagattgagggagtgaatctaatgagacaaaatttaacccagaaaaaattagaagcttctatacttgagttaaaactaaaaagatttacagaagtggattaacagcttgaagtatgaaataagggaggggtctagttgactgcaacttaaactggattcaattgtgtgatatggcattcacaaaatctactataattttaggatgcatccatagatgtatagcacctattctaaaatgaaggaggtggtaagatcactccattctgcactaggcagtatattcagtgttttcagagacatttacacattcaggaatgtgtagaataatgaatgactttgaaaaaatatgtcacatcagaaatggctgaaataactggggaggttaaaccccccaaaaaagtcttggtgagaacataattctttaaggattatgtgagatggcatattgaaaatacttagtgcaatgcctggcataaagtacacaattaatcttaatattaaaaggatgttaattagtagtattgttagcactgtgtcatactattattattactattattatagttaatgcttatagagtgctttctatgtgctaggctctattccagatcctttacataggttgactcattgactcagttattcctcttacaattctatgaggtaggtactattattgtctccaatgttgtagatgaggaagctgagtcacagaagattgagtagattgcctagtgtgtctcacagaatggaaggggaaagaaccagaatagaagctgtggcaattttaagctgtcaaggatgaaaggtacttttattattttatacctgttctgtaccactccacagggcagagccaggaccaatgtgtgtaaactactgggaggcagattttaactcaacagaagcaaaaatcaattaattaattaattttaaaactctgaatgattagaactttctgagatttcagtgagatatcttataaggcagtgagttctccatcacaggatttaagaagaataaggatagaaatgaatgaaatgggacttctctaggaaagaaactatacaaatgagaaaccaacccttgatgaaaaaataagaaggcatagtgaaacttggttttaaagacacatctcacagagaaattggaaagtaaaacagttataaaaaagatatgaaggtaaactaatatttgtctaaatgctatctcaacacaaagttaatcagatatcagagaaaagcaacaaacagttcttaaaaggggaaatttcacatgaatttctgttcagaaacttactaaacagcctggctttaaaacaaaatcccaggatcctcacagatcagatggtcatctaccctgaaagtgtaaaacacagagggaagggaagtagtatgctctgtaggggaaagagcatctgcataagaaagtagcatccaggctgatgtgagtagatgagaggcaggcataaggttaaagatcataaaatactgttagataaaaaaaaatacatattgcaatgacaattgaaaatgctagcataattgtagtcctgctattcagtatgtggtcaacagaattattgcatagtttaatatggaatgccctccctgctgcatctatcttttggggtccagcagtcccagaactcaaatatttgttgatttagtgaattaatataaacttcctcaaccagaagcaccaagaggtggctggttaaggattgagagtcccagtaaaatctatttattctattatgaataactactgaataatttatatatatgtacacatgtatataaatatattttataatctattcagtgtgtatacatgcatatatatgcgtgtatatatatacacgcatatatatgtgtgtatatatatacacacatagagagaataatgccaagctctccaccaaggactatcccatttcagataataagtgttctggactgtttgtacttagatggacaaatacgtatttgatttatgaaaatcaaagtattcattctttttagatctacaaactttacaaactcaactctttctacaggtctcgaactgaatgattaccaatttagatctgggggctcaaaaaaacaaaatgtgatgtcaagaaaaagtgaaagattgtctcccatgaaagtgacaagagatgaaacatgctgaatgagcctaaatggacatgatggagatacggatgtggattaaaactgagagtgttgggatataaggatataatactgatttatgaaggtgaacagtcaaacgtcagtgcaggatctgaactgcaggggaaataaggggccttggtggctaaggaagggaggaggggagaaagaggtggtactaggggaagtagcacagaggaagaggcaatactacccgagactagatgcggaccgtctctggcaaccaggaaaaggcaaatacaaagagaggtgagtgacaatgcctggtgtgtctcgggtcagagaacactagcaggcactagcaggtggctgcggcagggccgcagatcaaagtggtaactggggatctgagttcggcagtgacgcgcgtccctcacgtgaccaggagcctctatgtgcccaagtccctctcgtcccggtcttttttttgcctgtccaccatctccctattaccctttggtcgagagggaaagcagaagaagtaagttccctctaccctcttaaatcggtgtgagtgtcggcgctgcctagtaacccggggaatggggttgacagaatcgggatggcggagtccaggcctttccctaagctccagccccgccccccgcgcccacatttctgtgcaaaatatggtggtctttggggcggggtggggaggcgagtacctcccccgtcccccgggaggggggtacagacatttggaaatagtttctaaaaatgcttcgcttccacttctcatctgaaaagaaatggcaagctttgcggggtggggaggtgggagcacggaggacgaagcttgacgcaggggctgagacgaaaagagaacccgagagctaggggagcgtgcaggcagtggctggtgcccagaaagtggggggtggggggtgtcagtcagtccgtccctcctccccactccccgccccctaccctgtcttgcgtctgtgtgcaggtctgctggtcacagcggggcacctcgaggagaggacgactaggagcacacggcccggaaaggtccaggtcagggaaggggtacgcagtgggccgggactggggcgcgagggtggacgccgaaaggcatggagtctgcaggccgcactgtcccgcccctgtcactgcgggcgaggcctgtagcaaagcctgctggga

SEQ ID NO: 761 - DNA, 31387 bp, Homo sapiens
tttgactggccgtagagtctgcgcagttggtgaatggcgttggtggcgggaaagttgagtctctcctgcgccgagccttcggggcgatgtgtagtgccttccatagggctgagtctgggaccgaggtgagagccgccgggttgggagtgagggagatgggaacaaggccgccggtgggcgaggggagccgagggaacccgggggattgggaggcttggggcggcgcggcctggccgggctgggaccggcctctcggcctagacgcccgcgatgctggcaccctctgccacctctcacctgggccccaggggtccgcccctgggcagcctggagtcctccgaggtgggaggaccgggcggaggtggaggaagtctttctttggaagacttgctgcctgcccagatcgatataacatacgaggtctctcctcccaagagttatggtctaaaaacccctcacaaattaactaccgttggaaatgtcaagctatgcaagaaaagctagaaaaggggaggggtcgcccgttggagcatttggagcttttctggaacaggtggtgtttgcggaggttgcctcacctccctgtagcccacgtgtctctgcttagggcagctggccctcgccaccccctagtattcgtttccagcccaggtagctccagagccacacaagccggtggatgcccctcaagaattgaaccaagtgtccagcacttactgtgtgtcaactacgtgttaagggataggagtaagcaacaaaagacataacttctgccattaaagaactagtaagggaggctgctgtaagaattacagtattgcacaaaagtttgttgtccattagaggggcgggcatcatggaagatgcaggaggagatgactgaagtttcaaggaccatttgaaatggtttggcaaggagaggatgacattcagagcggagacagtcgggagtacatggattctgaattaagcaagagcatggctaatttagataactgcaagtatttctgtaaaattggaacaaagggagtgagggacaataggttgggaagtaagcgctgagcagtgggcagggtatgaaggatcttttatgcagatgagagaggaagcaatctcaaaagagtcagcaaacatttttgtggagggccatgtggtaaatatttaggctttgcaggccatgccgtttctgtcacagccactcaactctgctgttctaatgggaaggcagtcatagataaataaaggcacatggcagcgttccaataaagctttgttttttggatttagcctgctggccatagtttgataatccctgttcctaaagagtagaaccactgcttagtataagaacggctacagttataaaccatagatatatatatatttaaaaatatatttatatataatatatatttaaaaatatatttatatataatatatatttaaaaatatattatataaatatatatttaaaaatatatttataatatagattatatagaaagtatataatacatataaacatattttttatatataaatatatatttttttgagatgaactctcgctctgttgcccaggctggagtgcaatggtgccatctcagctcactgcaacttccgcctcccgggttcaagcgattgtcctgcctcagcctcccaagtagctgggattacaggcacacgccaccacacccagctaacttttgtatttttagtagagacagggtttcgccgtgttggcgaggctagtttcgaactcctgacctcaggtgatccgcctcagcctcccagagtgctgggattacaggtgtgagccactgcgcccggccaaaaccttatatttaaatgattatttgaaacccaggttaaggtccgatgatttttgcaatcagaacaagccttgtatccaaaaaatgagagtctagcacagttaagtcatggaacaaagaatttaacatcatatcctttgcctgccttgtctgtgtggcaatcctaagcctagctcatactactctggagtggagtggggtggaatggtgaataggaagctaggcaattggcgctgctctattttcctttttattaacaaaaccagttaagccagtctctttccctttaagtgtcttgggaactatgtggccactgccaaatttgtttgaactctagcttctttgcacattcatctactttgaatttacttggagggattgtgttgaggaatatatctgaagccataagctaacccaagaaactgaaataaactactttaaatttttggttttttttgagacaagagtctcactctgtcgcccaggctggagtgcagtggcgcgatcttggctcactgtaacctctgcctcccgggttccagcaattctcctgcctcagcctcccgagtagctgggactacaggtgcacgccaccatgcccggctaatttattttttatttttattttttagcagagaccgggtttcactatgttggccaggctggtcttaaactcctgacctcatgatccgcctgcctaagcctcccaaagtgctgggattacaggcatgagccaccacgcctggcctgctttaaaattcactagaattagaacctaataaaatagttaatctttcttgtgagtatcaaggaaaagacatttcatatgggggtcttcaagaaaataaagttgtaagaatatttttttaggctgggtgcagtggctcatgcccgtaatcccaacactttgggaggttgaggtgggcagatcacctgaggtcaggagttagagagaaaccctgtctctactaaaaataaaaaaaattagctgggtgtggtggtgggcgcctgtaatcccagctacttgggagggtgaaggaagagaactgcttgaacccgggaggcgggggtttcagtgagccgacatcacgccactgcactccagcctgggtgacagagcaaaactctgtctcaaaaaaaagaatatatatttttttagcagattctagggatgaagtttatggtaagccaggtggagagtggaaaacatatgtgcccttgatttaaaaaagacaagcatttgactacagtttacaatagaacaatccatttttccctttgcacagtagcaataggatttttacttttatatctcactgagattgtgagaaaagatccagtgatttgggcagtattttggtatcatccaccaaatggcttcatttgaatacagttgttaaataatggtgtactttgcattttttcaagaatgctaatatgccttgaattttaaaataattggtaaataaaaaattggaagtgtctgtccagttttggttgctatgcacagcataccatgttttttttctttaaaaaactaactccattatatttattattaaagcagttcatgtacatggcagaaaattccaatagcactgaagtgaaaagtaggaaatgtctccactcccattatcattacccaaggatagccctgtgaatatctgcacattcttccaggaattttctaatgacgtattttggaggctgagatctagagaatattggactggaagttcagaaaccttggttctgccaggagcaagcattgtgattttggataagtcatttaacctttgctgtacttttgtgaaatgaaggtggtagactgatttctcagttcccttacagctcatatacttctttgtatcctttgaactaaacacagtgtctgcatagtaaatgtaaatatttactgataataaaggttgattttcttaaaaagaaaagctacagggtggtctttgctagaggcaaatattacataagacaaatatttaatgtttcttgtaaaataataattggtgttgtataatcacagagttttagaataatgcttatcaccttttgtctttgcttcccttttacccagaatagaatcccatgttccttcattataattattccattatcattgccatcaaattacttgcctcttaacacctctaagctatttacctacgcatggtgaaaaccaactgtctacttccactcagctgaatattactagagaaaatcacaactaggctgacttgattttattttaaatttatatatttattttcatgttttagagaaggggtctcactctgtcacccaggctggacagcagtggcacgattacagctccctgcagccttgacctcctgggctcaagtgattctcccacctcagcctcccgagtagctgggactaaagggacacaccactacgcctggctaatttttgtattttttgtagtgatggggtttcgccatgtttcccaggctggtctcaactcctgggctcaagtgattcacctgccttggcctcccaaagtgttgagattacaggcatgagccactgtgcctggctccattttaaatttataatcatcattctcaaatgggcacccggtctaactatatttctctagtaattcactttctcactacaaaacatccaaccttatcctggaattccagactcatgttctatcatcttgacatcactatgtgtatgtttaataggcatcccagatttaacatatttatcctcaattgcgtctagatccagggaaaatataataaagagtataggtataagagaagagtattgtatgtatcaatgttaaatttatgattgtgattgtaatgtgactatgcagaataccttttacctcttttttgagtttattttggttttattttttgtttctgtttctttgttaggaatatctttttgcttaggagatacatattaaagtatatgaggggaagctgttcaacaaaagttaactcaatttggcaaaatgttagcaatggtggatctaggtgaaggtattggttcactgtactattcttacgctttctctggaggttttaaatttttccattttttaattttaattttaattttttttgagacagtcttactctgtcgcccaggctggagtgcaggggcatgatctcagctcactgcagcctccgcctcccatatccaagtgattctgctgcctcagtctccctagtagctgggattacaggcaggtgccaccatagctagctaattgttgtatttttagtagagatggggtttcaccatattggccaggctggtctcgaactcctgacctcaggtgatctgcccgccttggccacccaaagtgctggaattactggcatgagccatcacacccagactagtgtaagcttttctaaatgatgtttaaaaacatctgtatgggctgggcgtggtggctcacacctgtaatcccagcactttgggaggctgaggtgggcggattacctgagttcgagaccagcctgaccaacatggcaaaaccctgtctctactaaaaatacaaaaattaccgggcatggtggcacacacctgtaatcccagcaactcaggaggctgaggcaggataattgcttgaacccgggaagacagaggttgcagtgagctgagatcacaccactgcactccagcctgggtgacagagtgagacttggtctcaaaaaaaaaaagcctatataatatgtattctactaaataggcgatatactgatgccctaaaacagggcaatgttttgtttgtaccttgatggtagtcataaggatgtgtactcacggacttctgtgtaatagaggtttgcatcaattatccaaacctgaacttctaaatagttggaggttctttacactccccattcttctcccagttctgcctgtgcatgccttgtttgcctgtagtttactaggcagctattaagtttctgccaagcataaagcattgcattttggaattggtaacaaagccaatattgatctctttccttttaaatgtttatatccagatgagggagagtggctagcaatgtgttcttaaggacagtaatagcttcatggagggaaggaaccttgaagaatgcccagaattttcattcattcagtagggaatttagttggaggaaataggctaaagatattccaggtagaaggaaaaaaggcatttctctctcagtacacaatttatatttacctgaaagaactatgtactaaaatctgtcactcaaaattaaaagtcactctcacgcagattagaattggccaactctcttttatgccctcacaatgccccatgtgtatttctgttacagcacctgcctaactttattgtacttttttttttttttacagccttttgactgtttagtttaaataggttacactatgttgctagccttggcccaagcatcctttcacctcggcctcccgaagtgctgggattacaggcatgagccacgatgcctggcctccccatcagttttgttgaaaacagcaactgtgttggctacatctttatatccctagcacttacctcagttcctggaacatacttgacttgcatgaaatgttcaccggtaagtggccaggcatggtggctcatgcctctaatcccagcactttgggaggtcggtgcaggcagatcacttgaggtcaggagtttgagaccagcctggccaacatggtgaaactccgtctctactaaaaatagaaaaaatagccgggtttggtggtgggcgcctgtaatcccagctactcaggaggctgaggcaggagaatcgcttgaacccaggggcttgcagtgagccgagattgtgcctctgcactccagcctgggcgacagagtgagactctgtaaaatgtttaccattaaatgtctgtataattgagcattatctcttttgcagactaaatgcttgctccagcaatgctgctgctgctgaagacatttgggacaccttgttagtgttcaagtttcaactaaaggaatggttgaaagaagtcagataatcgcccagacaggacctcagatggctttcctcctgttttttaatttttaacttttatttctctgtagaggtgggatctcactatgttgcccaggctagtcttgaactcttggcctcaagtactcctgcctcagcctctcaaagtgcttggatgacaggtgtgaaccactgcacctggcctgattttcagtttaataggtccaaaaactcagtttagtccttgtactcatatttgattagtctcagtgatactgaggttgtatagcatagtagaaaaattccaggctttgagaatcacagagatcttgattaaatcctggccctgacatttactagttttctcatgtgaaaaatacaatagtaacaaatagggttgatgtaacaattaaaggacataatataaagaatgtactgctgatcccacagtaagctcaaataactattattagatagctattgttacgataatagaacttagcagatgctgatttacaatccaagtatcaaatctattgactcacaatattagtgaaactgtcaaatagattaaaattattatgtccactgtgtattcttttctagttaggaaattttgcctcggaaaggttgcttagagaattaagagaaacagtttgtcataatggctatcatcaccaagctctgatgcctgatgtattagtcttccctaagaggattaaactgtcatgtcaagcagaatttacttgggttccctttaccctggacacttaacaaactcttctttcgcttctgaaactgcaggttgaccataccttgcttctattgactctttccttgaatctggacatcattaattttaattttctgtaataggcctatgtcagatttttggagtacctcttttcttatccatggaggatatgttccaagacccccaatggatgctgaaaccacagatagtagtgaaccctatatacactatgttttttcccatacagtaatgaacaggtagtgtgtacagcatggatatgctggacaaagggatgattcatgtcccacgtgggacagaacaggatggtacgatattttattatgcaactcagaatgacatgcaattattgaaaacttgtgtatttatttctagaagtttctgtttaatagttccgaactgtggttggctataactgaaaccacagaaaatgaaactgcagataaggggggaccagtgtattttctgcctatgtttagaagtttctttttttttttttttgagatggagtctcgttctgtctcctaggctagagtgcagtggtgtgatctcggctcactgcaacctccaccttctgggttcaagtgattctcctgcctcagcctcccgagtagctaggattacaggcgcccaccaccatgcctagctaattttttgtatttttcatagagatgggggtttcaccatgtcagccaggctggtctggaactcctgacctcaggtgatccacctgcctcagactcccaaagtgctgggattatgggtgtgagcaacaattacaattgttaattgtaatattaacaatttgcttggcttgtgaattgttaatattatccattacttgtaaatttaaatctatttcctatttctgggaggttctttcaccccctttataattcagtatactctgctttgacgttgtaaaacgttgctttggatattctcagtggtggacagtttttctcctttgaaattaaatttgattttctaagtaacagtggaaagtctgatgcagattgcctaatccttgtgggtaactaagaggagtaataccatcttcgcccaaaagagtcccgtcaataaaattataatactttttttctttttttttttttttttttttgagacggagttttgctcttgttgcccaggctggagtgcaatggcgtaatctcggctcaccgcaacctctgcctcagactcaagcgattcttccgtctcagcctccccagtagctgggattacaggcatgtgccaccacgcctggctaatttagtatttttagtagagacagggtttcaccatgttggtcaggctggtctcgaactcccaatctcaggtgatctgcccaccttggcactcccaaagtgctgggattacaggcgtgagccaccgcacctggcctataatactttcttgagtactattttgccaggatttctcaggggtgaggattctacagtgttttgagaaatgacagtaagagtaaacaattggagtgtcttcccaagttaatctaatgaggatgttattcattcgtatacatgcctttgaagatattttatagttgtttccacgtgctctttcttgtccatgaaagtctctctgtcttgctgggcgcagtggctcatgcctgtaatcccagcactttgggaggctgaggcgggtggatcacctgaggtcaggagtttgagaccagcctgaccaacatggcgaaaccccatctctactaaaaatacaaaaattagccaggcatggtggcacacgcctgtaattccagctacttaggaggctgaggcagaagaatcgcttcaacccaggaggtagaggttgcagtgagctgaacttgtgccactgcactccagccttggtgacaaagcgagactctgtctcaaaaaaaaaaaaaaataaagaatctgtatttttctttgagttatactctttcagtcttgtagcccagtggttcttataggttttagtcttaggactatgtaacacatttaaaagtgggagattccactgggcatggtggctcatgcttgtaatcccagcactttgggaggctaaggtgggagaactgcttgagtccaggagttcgagaccagcctggacaacatagggagaccctgtctctgcaaaaagtaaaaaaattagctgggtttggtggcacacacctgtggtcccagctactcaggaggctgatatgcaaggattgcatgggcccaagaggtcaaggctgcagagagccatgatgtcatcactgcacactccagcctgggtgacaaagcaagaccctgtctcaaaaaaaaaattattgaagaatctaaagagcttttctttatgttatatgtgtccatgaaacaaatttaaaattttaaaatatttacattcatgtacagtgacacacacattgaatatttttataaaacatatttttatgaaaaaagctgtatttttctaagaaaaaactgagaaaaatgatgttgttttacatatttgcaaatctttttaatatctggcttaatggaactgggttcttatgcagtctgttatcatatgttggttgggttaaagtatatgaagaacatccatcctctcagagaaagtcacgttgggaaagggaggagtattttaagaccttttcacagaattatagatattcttcttggttactgttaccaaagcttgacaagtagtagttttcctaaaggctaactacaatgtgggatataaaatcttaagaccttggccaggtgcagtagctcacacctgtaattccagcactttgggaggccaaggcaggtggatcacttgagcccaggagttcgagaccagcctgggcaacatagtgagaccctgtctcctaaaaataacaaaaaaaattagctggacatagtggcacgagcctgtagtccagctacttgggaggccgaggtgggaggatcacttgagcctgggaggttgagtctcatcgtgccattgtactccaacctgggtgacgggagtaagaccctgtctaaaaaaaaaaaaaaaaaaaaaaaggtttgtcttacagttggagtgaaatcttttacccaggaatgatttcacaccatgcatcttttggatggttcactgagttatgtgttaggcacagttttccagaggagaaacacaaccaacaaccaataggatacatgtagatatataagaggaaatttattatggaaattggctcacattgttaccagggcagcaagtctggttggggtccacagtccttagttcttgtcttcttggaagaaagaattcagccaagacagaagtagattcaaggcaggactgaagggtttttgaagtaacgttcacttggaagggaccaaatgggcaacttgaaatattgaatgcccctatttcctgatccttcctggtctcctctcatccttctccttggatgggctgctggctaattgcctcatgtgcagtgacttgccagcatctgaaaggggccacgactgccatttggtgtttggagttctgtgcatgctcgtgtagggcaattttcccgtactggtctagtgctcccagagaaaggtcatatactggtcacactccaccattttgctccctactgcacattcctggacatgtttgctcaattcctaggatcttatcaggaagttgttgcccgtaagcccaagatgtttcctgttaggaaattttcccctccctggtgccagctgcaaccagttatcattcctgaagaggccacctggacattccttggggcctgtcttgccccactcacacctgtctgtctacctactctaatagcgtgatgatggaggccaggaaatcccagacacaccatctgcaagctggagaaccagaaagcctgtggtgtaattcagtctgagtctgaagggctgagagccaggagagcccgtggtggaactcccagtccagggctttaaaggctcgagaatggtgtagggttgggggacaggcggcactggggtaagtcccagaatcaggggctccaatatctgagggcaggagaagatgggtgtcccagttcaagaaaagagggattggaggatgcccgtctgcattagtgaggatggatcctttttaatcagtctactgatgatgctcgtgtcctccagaaacaccctcatgacacacccagaaataatgctttaccagctatttgggcatctcttaacttaatctagttgacacatacaattaactatcacagccaccttcaggcttaataagtctctagaagaactcagaactcagtgaaagctgttatgctcatggttatggtttgcaacagcaaaaggatatagattaaaatcagccaagggaagagacacaataggacaaagttcaggaagttccaagtacagagcttccagctgtcctcttccagtggagtcatcaacagtgctaaattctcccagcaacaatgtgtgacaatagaatattggcaagcagggaatctcagctagactctggtgtccgaaggttttattggggctctgccatgtggacatagtcaaccgcctgcatagctgaccttagcttccagcacttccaggttggcctaacactgcatgacccaaagcccccaccataaatcacattgctgtgtggctcaaagttctcttgtaaacagagactatttttggggggggggggcagggggacagggtcttgctctgtggcccaggctggagtgcagtggcataatcttgactcactgcagcctcgacctcctggactcaagcgattcttttctgtcagccttctgagtagctgggactacaggtgtatgccaccatgcccagccaatttttgtattttttgtagagacagggtttcgccatgtttcccaggctggtcttaaactcccgggctcaagcgagcctcctgccttgtcctcccgagggactaggattacaggcgcgagccactgtgcccggcccaaagacacttttatcaggcaagacattccaagggtttagaattacctctcaggagccaaggacaaaaaccagacctccctttgggcaaggttaaattattcactacacagtatgtttctcatgtcatcacaaagaatattttttaaagtgtactcaagggtcatgatttagtaaaagcagtctttttttttttttttttttttttttttacttcaaagacattcttacgtaaagctggttttgttctgcctgagtgcaggtagtgcttggcgatgtgtgctaatacatttccacaccactgccttgattacgctagctgtcagcaggtacccactattgcttttaggaccttagtatcaaactaggcaaataacatcttaatttttactttttctgtttacgaaaatagttttggccatgggtatgccctcagaacctctgctctaattaagcaccctgtaactttaccttgtattatgacataatctcatctagaggactgagactgcacattctttgagggtaggttgtcatcttcatctttgtagtcaacattttacctagcacagtgcttcatacgcaacagaaattcaacgaacgcctgttaaattaatgcatagaactttttcatcacttgaggaagtctttccacaacttgatttggtttaaaaaaatgcaaataaggccgggcgcggtggctcacgcctgtaatcccagcactttgggaggccgaggcgggcggatcacgaggtcaggagatcgagaccatcccggctaaaatggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatgcaaataaaaggtgactttcttcccatttgtgatagatttttttttcttttgtcatatagaagggttgtcaaatctgtgctgattcccaagaaacttgagaatcagttttgtctcccttgtgacagttaaatccttcaccgagattgccccctgtgatcctaatgacttccgtcatggtgcagacactcctcctccagactagggtgacaaaccccagccctctctccacgtatggttttaactctcctcacatctgtcccctagtaaccaccaagatgatctgtttgaaatgcagataggctgggcgcggtggctcacgcctgtaatcccagcagattgggaggccgatgggagcggatcatttgaggtcaggagtttgaaaccagcctgccccaacatggtgaaaccttgtctctactaaaaatacaaaaattagccgggcgtggtggtgggtgcctgtaatcccagctactcaggaggctgaggcaggagaatcacttgagcccagaaggcagaggttacagtgagcagagatcgcaccactgaactccagcctgggcgacagggcaagactccgcctcaaaaaagaaaaagaagtggataatatgccaggtactcttttcacatatttaatcctcatcagccttatgagggagggtgctgtttgttatcctcacttgacagatgagaagcctaaggacctcagtgacctagcaggtctggctctggggtcccaaatgtctactcttaactatgttctaaatacttctcagtgcttagtgtcacacctgttggctgttgtctacaagccaaagataagctcccaaacatggcgtctgagcccttccatgctctgacttctgctctcttgtagggcttccctgggtcctgcctgtttggtgctgttacagtatctaggagttcaaagctgctcacagtgtccctatgcacaatgctatttataacctctgcactgtggctgctcctgtttctgttagcaggtctactaggcctgcctgtgccccattcacctggcagtcttacttaggagagagcccaggtggtggctcctcaaggaagttctcctccacctttctcctttgtccccttccccagtgaaataaagagctcacaatgaatggggcagacaaatgaaggcagataactgtgtaacaagtgtggtaagaattaactgtgtgaaagttaattacaaggaaggtaaaaattttgccatagcagtttgtcttatatcctaaactagactatccattcctttgagggtacagactcattttatactgtcagtatttggtagataaacaaaaagtaaaatatctgaaaaataagtaaacacaacatttctcctaaactatatttcctatttcatattttcttccaaatccacaaaattatgaaaaaaattttttttgagatagggcctcactctgtcacccaggctgcaacctctgcctctttgactcaagtgatcttcccacctcagcctcctcagtagctgggattacagtgtgtgccaccatgcccagataatttttgtattttttgtagagtcaggtttcaccatgtcgcccaggctggtctgaaactggactcaagcgatctgcccaccttggcctcccaaagtattgggattacaggtgtgagccacagcacccagcctaaagttatgaaatcttacagactttcggaaaatggtataaatatagatgtctaggattttatatttttaaataatgagttttccttctctcttcttttataagctccttgcccgacttgaaggtagaagttccttgaaagaaatagaaccaaatctgtttgctgatgaagattcacctgtgcatggtaaaaaatacaacctttatataaataaatgcaaatctttataaaaggatttttcacataagctcacatgtatacacatactcctcacaagagtttatacaggttaaactgtacaattggaaaatgagacacaggttgtgacagaaagcttttaagctttcctcatcggtgtcagacaagtttgcttctctgcagtaaatcttcagaatatgccttgacctctgtcttattctcaacacacaatatttatgcaagtcctgttattatagtttatgttgaaattccttttctttagaagcttgcggagttgtagggaagtccttgggtacccacttgttagtatttctacaacagggaaaacttactaagggcgtgcgcttaggttgattttttttcttttaatgtggcggcttcatagagataaaattcacccaccgaagtgtgcagttaagtgatttttaggttattacacagttgtgcaaccgttaccacagctgactttagagcattttatctccccgtaaagaagctcatttctagtaatcatcatctcccatgttccccagctctaggcaactactaatctactttctaactatggatttgccttttctggacatttcatataattggaatcatgtaatatgtgatcttctgtgactggcctcttttactttgaataatttgcactgaattgtataattcagtgtcaccatttcataacacgtatcagtagttcattctttgttaaatatttcattgcatgagtgtacatgttgcttatccatttgttagctgatggacatttgggttgtttccatttgctggctgttgtgcataatgctgctgtggttatctgtgtacatgtttttctgtggatagatgtcttcagttctatcggataatacctaggataggcattgctaggtcatatggcaattctacatttaaccttttgagaaactgccagactgttttccaaaggagcttcacattttacttgcaccatcattgcattgccagcaattcccatattctgggaataattgttattgtctgtctttttgataatagccatcctagtcagtatgaagtgttatctctttgtggtttttgatttacattgtcctcacggccaatgatgttgggtatctttgcacaggcttattggcaaattgtatatctttgaagaaacgtcagatcctttgctcatttaaaaaatcaggttatagccgagcgcagtggctcacacctgtaatcccagcactttaggagtcttaggcaggcagatcacgaggtcaggagtttgagaccagcctggccaatatggtgaaacccccatctctactaaaaatgaagtatccaactgttattgttgaattgtctgtttctctcctgagttttatcattttttgcttttgtattttggggcttcatgtattgttaagcacatataactttttattttgtcttattgctggctgacccatttatcattataaaatgttcttctttgtcacctcacatccattaggaaggctactatcaaaaaaaaaacaggaaatagcaagtgttagcaaggatgtggagaaattgtaacccttttgcactgttggtaagattgtaaaatggtgcgaccattatggaaaacagtatggaggttcctcaaacaattaaaaatagagctaccatatgatcacataatctcacttctgggtattcatccaaaagaattgaaagtaggatcttggagaaatatttgcacactcttgtttatagcagcactattcacaatagctaagaggtaaaaccaacctaaatgtccatcaatgtgcttataatgaatccctggggggaaaagtatccatcaatggttgagtggtgtatacaaaatgtgatatatacatgcagttgatattattcagccttacaaaggaagagaattctgtcacgtgctacaacgtggatgaaccttgaggacattggtaaatgaaataggccagacacaaaaagacaaactgcttgattccacttatatgcagtttctaaggtagttaaattcacagaaaagaaagtaaaatggtagttaccaggagctggggaggcgggggaagggagtcattgtttaatgggtgcaaaatgggagttttgcaagatggaaaagttgtggagttctgcttcattgctttgcagcaatgtcaatgtacttcacactgctgagctgtacacttaaaaatggttaaagtagggaccaggcacggtggctcacacctgtaatcccagcactttgggaggccaaggtaggtggatcacctgaggtctggagttggagaccagcctggccgacatggtgaaaccccgtctctactaaaaatagaaaaaattagccaggcgtggtggcaggcgcctgcagtcccagctactcgggaggctgaggcaggagaatggcatgaacccgggagggattcagtgagcttgcagtgagccaagattgtgccactgcactccagcctgggcgacagagtgagactccgcctcaaaaaaaaaaaagaaaaagaaaaagaaaaattacccaggtgtgatggctcatgcctgtaatcccagctacttgagaggtcaagacaggagaatcacttgaacctgggaggtggaagttgcaatgagccgagattgcgccacttcactccagcctgggtgacagagcaagactccgtctcaaaaagaaaaagaaaaaaaaaaacaaagacaaaaagtttatgattgcattttgctgtctgttttttatatatgtcttatgtcttttctgtttctttctcctttactgttttcttttgtgttaaatattttctaatgtaccattttaattcccttgtcattgttttcactatatttttctgaattatttttctagtgattgccctgggattacaagtaagatcataatttctaacagtctagttggattaatacaaacttaatttccatattttgtaaaaagctttgtttactgtataggtattccctacatctttatacattgtatggtcatcagcacatttaatattattactgaattaaagtaattaaaatgatcacttaagaatactttctggccaggtgcggtggctcacacctgtaatccagcactttgggaggctgaggtctgtggatcacctgaggtcagaagttcaaggccagcctggccaacatggtgaaacctcatctctacaaaaattagctgggcatgatggcgggtgcctgtaatcccagctactcggggggctgagacaggagaattgcttggacctgggaggcagaggttgcagtgagccgagattgcaccactgcactccagcctgggcaacagagcaagactgtcgcaaaaacaacttccttcttaaatcagatagatgaaaaaacagttacaaatacaaaaacacgtttatactatcttttttttttttttagatggagtctcactctgtcgcccaggatggagtgaagtggtgtgatctcggctcactgcaacctcctcctcctgggttcaagtgattctcctgcctcagcctccccagtacctgggactacaggtgtgtgctaccacacctggctaattttttgtttttagtagagacggggtttcaccacgttggccaggctgctcttgaactcctgacctcaggtgattcgcccaccttggcctcccaaagtgttgggattacagaggtgagccaccatacctggcctgtactgtcttttatatttgcctagatagttacatttccctgtgctctttattttctcatttggatttcaggaactgtgtcctttcattcagcctgcaggactccctttagtattttttgtacagcagatttgctaaccaaaattctccataataaaacacaaattttgatcaaatatgtaagacaaaaaacagaatggtctttgtactctctctgtaaggaaggatattattaaggtgagccttatgaaactgacaatatgttaaaatgggtttgtggaacaacttctacattagaatattatattatagaaacgttgaaaaacaccatcatgttcagtaactaacaaaaaagtttactgaaaactactgaagatcctatagctgtaaaactagttagatgagtattccattggaacaatagcagatagaagactgggattataaagattatttatcaacaatagaagtttatcagagcttgttacagaaaagcttaagttgaagtagtaagatttaggggttatagagtctcaatgccattgtaaactttttttttgagatagagtcttgctctgtctcatctgtatttttagtagagatggggtttcaccatattggccaggctggtctcgaacacccaacctcagggaatccacccaccttggcctcccaaaatgctgggattacaggtgtgagccactgcacccatccgaacattttttaaaatttattttaatttaattttaaattctaggatacatgtgtagaacgtgaaggtttgttatatagataaacgcgtgccatggtggttggctgcgcctatcaacccatcacctaggttacttgtcctggctatttgtcctgacgcgctccctcccctcatgccttcagcaggccccggtgtctgttgttcccctccctgtgtccatgtgttctcatccaaacatttatttttatttttgttttgttttgttttgacacagagtctcactctgtcacccaggctggagtgcagctcgatctcggctcactgcaacctcagcctcccaaatagctggaattacaggcagatgctaccatgcccagcaaattttttgtatttttagtagagacagggttccaacatgttggccaggctggtcttgaactcctgacctcaagtgatccacctgtgtcagcctcccaaagtgctgagattacaggcatgagccattgtgcccagtgccaaacttttctttttgagacagggtctcactcttgttgcccaggctggagtgcagtggcgccgtgacggctcgctgcagcctcgaccaacccccgggctcaggtgatcctcgcacctctgcctcctgaatagctgggaccacagatgtgtgccaccacaccagactaatttttgtgtattttgtagagatggagttttgccatgttgcccaggatggtcttgaactcctgggctcaagccatctgcccacctcagcctcccaaagtgctgggattatgggcgtgaaccaccacgcccaacctgtaaacatatttttaatgcttttttggataggagttattcagtaccatgtaccaattcattacttctttacttctataatgattataatctgcaaattcaacatatttgttatataattggtaggctggtaccaagatgatagcttttttggcttttcctttcttttccttattttgaaggatctttagattcagaactctttctgacaatctgttacccaaactccttacagcgttctatttgtaagaggaactgtcaaggccaaatcatccagattttctgatttagtttaatatcttcaagtgccaaaccttagggatttttttactgcgagttgtcacgttccataatttggctggacaaggatgctgtagcagccacagaaacatatgagacggtgacttcaagtacattgaaaaggatgatgtcccttctgtaggacataatatttgattacaggttttgatcttgaggatcaaacagtaaatgtttataaaatcagtaaaactgatttcagttcatcattaaacatatttgtgaggaatttagttcaaggaccttaatgataattcatgtgtctcttgcaagtttgcagtgtcttcccggttgttataaaagccttttttatacctgctttgctattaatgtgtaaaagaaaaagagtatctcttaggcagggatttaaccttcaacttctttgcctcagtttcactcgtcgggaatccactctgtccttgctgttactctagaagcagtgaatgcctaggctagtgccgttgtctcctgtcttctgagtatctcagttttaaaagtttggttcacaaaatgagatgttaaatgtgcttttgcggactacacaattaatgctccaaggtcactattttggacaaactcagtgatcttttccctgctgtttttcattgtcatgacttttctgctatatttattatttagtagtttcattttcttgaaacattctcttttgccctgtaatgtttttcttcctggttttcctattaaatttctgttttagctgtcttctaatgcgtcttctaactgtggatatatctcaaaaatttagttttggccttaattttaggtccataatacccacccatcaaagagatttttgttttttctctattatttctgtgtggattactcccagtctgctataaccagccccttattacctaccatcttgaatctttttttttttttttttttgagatggagtttcactcctgttgcccaggctgaagtgcaatggcgcaatctgggctcactgcaaccctctgcctcccaggttcaagcagttctcctgcctcagcctcccaagtagctgggattacaggcacgtgccaccatgcccagctaatttttatatttttagtagaagcagggtttcttcatgttggccaggctggtcttgaactcctgacctcaggtgatccacctgcctcagcctcccaaagtactgggattacaggcgtgagccaccgcgcccggcttaccatcttgaatcttaaattttagtggctgtaggacattttcattttgtgacacctagagataacattttaaaaaacccataccattttgaaagctaaatttttgctggaatactcaatgtgaattatgtgaactaaaaatttctactttgggttgggtgtggtggtgcatgcctataagtctagcactttgggaggctgaggtaggtggatcacttgaacccaggggtttgagaccaccctgggcaactcagcaagactccatctctacaaaaaaaatacaaaaattacccaggtgtggtggcacacacctgtggtcccagctactcaggaggcggaggtgggaggatggcttgagcctgggaggcggaggttgcagtgagctgaggtcacgccactacactcttgcctgggcgacagaatgagaccctgtctcaaaaaaagtctactttatgtctgtatttgatttgtgcaggtacttccaagcctatctttgagaacttttaagtcaccacattaggtttacctgctgtattagtccatttttacgctgctgataaagacatacccaagactgggcaatttacaaaagaaagaggtttaattggacttacagttccatgtggctggggaagcctcacaatcattgcagaaggcaaggaggaacaagtcccatcctacgtggatggcagcaagcaaagagagcttgtacaggaaaattctcccttataataagcatcagatcccatgagacttactcactatcacgagaacagcacaggaaagacccgcccccatgattcaattacccccactgggtccctcccacaatacgtgggatttcaaatgagatttgggtggggacacagcctaaccatatcacctgcagaactgaggccctcaccacgctaagtgtgagcaccctgtggtctctgggcagcaggctccacacctggcagtttgctcctcttgctttgcctcctatgttggtccctgtgtcaaccctggtctaggactttcttacctgctgaactctgccaccaaagccacacactccacctgtcattccctaccagacccgcttccatttaaaatgccagtttcacaattggcttttaggcccttaaccctcacaaaccaagacttatatttttattctttagatgtctctcaagaggatcttgagaagaaggtaactgatgaagcacattcagaagatcctgggttttgtgctggggacagaatactcaagtcccaaccttagagaagctagcaggaaatgtaatcaagtaaatagtgattatatagtgtgatctgtgtgatgatgggagatgatagagtttgctttccctacctcagtgttattaggagcaaacaggatatgtctgaagcagcctctttaaggcatgcagtactctagaaaggtgagtagctgtgggtcggcctctctggctgcctctatgggagcaggagagggaggatttgctgtggtctgcttcttggtttccccgtctgcgcttctgcatggtcccttgttctctatcacatagggcagtaaaagatgcttggcaggagtggcgggttcagcatagctcctcagtaacatagtaagagagggcacactgaacatctgggtggaatacaggtttagttgctatgttaacttttaattagatggacaattgttaatatgaaaatagttttactccttgagcctagaatctttttttttttcttttcttttctttttagagacagggtctccctctgttgtctgggctagagtgcagtggcatgatcatggctcaccgtagcctcaacctcacaggctcccacttcaccctgagtagctgagactgggactgtaggcacatgctaccacgcccggctatttcttttttttaattttttgtaaaggcagggtctccctatgttgcccaggctcgtcatgaactcctgggctcaagtgatcctcccacttcagcttccaaagtgctggattacagatgtgagccactatgcccagccatgtgtagaattcttaaatacaaaagagaagtctatgagaactgataacatactatgctataagaaagctgaagccaggcatggtggctcatgcctgtaatcccagcactttgggaggctgaggcaggcagaccacttgagcccaggagttcaagaccagcctgggcaacatggtggaacccagtctttacaagaaatacaaaaattagccaggcatgatgacacatgcctgtagtcccaactacttgagaggctgaggtggaatcattttttaaatttcttcttaaggtaaatttagaattgcaagttgtatgtaagattatggtggaaatttggtgcagtcttggctcactgcagcctctacctcctgggttcaactgattctccaacctcagcttcccaattagctgggactactgatgcacaccaccatgggtggctttttttttttttttttaattgtagagttggggtctcactatattgaccaggctgatattgaactcttgggctcaagtgatcctcctgccttgacctcccaaagtgctgggagttacaggcatgagctactgtacccagcctagatttcttatacattatttgtgaatactccaatatacaacggtttgttgataataataagaaaggccaggtgcggtggttcacacctgtaatcccagcactttgggaggccgaggtgggtagatcacctgaggtcaggagttcgagaccagcctggccaacatggcaaaaccccatctctaccaaaaatacaaaaattagctgggcgcggtagcgcacgcctgtaatcccagctactcgggaggctgaggcaggagaattgcttgaacccaggaggcgaaagttgcagtaagccaagattgaaccactgcactccagcctaggcaacagaacaagactccatctcaaaaaaaaattaaaattaaataataagaaataaagtaattgcatttttttgtgtttttgtttttgttttttgagacggagtttcgctcttgtcgcccaggctggagtccaatggcgtgatctcagctcactgcaacctctgtctcccaggttcaagtgattctcctgcctcagcctctcaagtagctgggattacaggtgcccaccaccatgcccagctaattttttgtatttttagtagggtttcagtatgttggccaggctggtcttgaattcctgacctcaggtgatcctcccgcctctgcctcccaaagtgctgggattacaggcgtgagccactgcgcccagcccttgaatccgtatttagaccatcatttggttggggctaataattggcattttaacatagtgtttccaatcaggtagttcagccgtaaattaataatgacaagcaagagttgaatgccactgtgagtgcattttgaaaagctctggaagcaaggcaacttccccagtgttgtttgatttaacttgtgctgtccttagttattcgagcctagatagaaggagagttggagtctttaacgttcagagtagttgactttgatttttaatgctaggaaaataatttctaatgcagctggacatggtttccagagataattcaaatagcaaagaataactgaaggcagtttgggaacgtgtaaggttgttttcagttgaaggatgctgttggcatttagggtctgagagccatgggctcttgcctcaataatgtgtgaaaccacaaaatccagaattgttccccccataacatcaataacactgagaaacctaattagggagtgccttcacctgcgtgtcatagaagtccaacttagtggcttgcccaggtggaggcttgttttcctcacatcctgagtggcacagaggcaggctgtgcgtggctggtgggggctccgtgtgcccagagtcctgggtaccttctgtcttccacgccaccatcctaagggtgggtttcatcctcactgcttccagatggctgctccacccccacaggagggtgcggcagggcagaaggggtccctggataggaaagaatcatcaacagagagcagcctgcatctcactggcgacagctgtgttacctggtaaccttgcttttcaaaggagactatgaaaaatagttttaaagtggacacatttccctccccatcaaattgggttttatactttaggaagaagggaagaatggatatagtgtaatcaactaccagaaagggtgtgtactgtagtcatcagattttggaaaggccctagatctgtggctctttatttttgaatcttacaaattgaagtgggagtgcatgtgagcctggccggaggagagtcccctagcctcttccaaccttcccaccaggctctaatttccttatttattgtatttgcttgtacagctccattttggcaaaagtgaatttagattttctttcacattccagtaagtgtctttttaaacttttttgcagactttgcattttgtaacctacccttgagctactgcattttgactgagatttttaaattttacacaggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttctttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaagaacaaagctggaggcatcacgctacccagcttcaaactatactacaaggctacagtaaccaaaacagcatagtactggcacaaaaacacacgtagactgatggaacagaatagagaatttagaaatgagaccacacacctataatttttttgatcttcgatgaacctgacaaaaacaagcaatgggcaatggattctctattcaataaatcgtgctgggataactggccagccatatggaaaagattgaaaatggacgccttccttatgccatatacaaaaattaactcaagatggattaaagacttaatgtaaaacccaaaacagtaaaaatcctggaagacaacccaggcagtaccattcaggacataggcacaggcaaagatttcatgacgaagacgccaaaaacaattgcaacagaagcaaaaattcacaaatgggatctaattaaactaaagagctgcacagcaaaagaaactatcaagagagtaaacagacagcttacagaatgggagaaaattgttgcaaactatgcatctgagaaaggtctgaaatccagcatctatacgtaatttaaacaaatttagaagaaaaaaccaccccattaaaaagtgggcaaaggacatgaacagacacttttcaaaagaagacatctgtggccaacaatcctatggaaaaaagcccagcatcactgatcattagagaaatgcaaatcgaaacaacaacgagataccatctcacaccagtccaaatggctattataaaaatgtcagaaaataacagatgctggtgaggttgtggagaaaaagatatgcttatacactgttggtggaaatgtaaattaaattagttcagccattgtggaagacagtgtggggataaagacagagataccattcaacccagcaatctcattactgggtatatacccaaaggaatagaaatcattgttataaagacacatgcacgcgtatgttcgttgcagcactgcccatcagtgacagactggattaaaaaaatgtggtacatacacaccagggaatactatacagccataaaaaggaacaagactgactgggcgtggtggctcatgcctgtgatcctagcactttgcgaggccgaggtgggtggattgcccgcgctcaggaggtcaagaccagcctgggcaacacggtgaaaccccatctctattaaaatacaaaaaattagctgggcatggtggtgcgtgcctgtagtgccagctactcaggaggccgaggcaggagaattgctggaacccaggaggtggaggttgcagtgagctgagatcgcgccattgcactcccgcctgggcgactccatctctaaaaaataaaaaataaaatataaggaacaagatcatacctttgccagggacatggatggagctggacgctattatccttagcaaactaacataggaacagaaaaccagatactgcatgttttcacttataagtgggagctaaatgatgagaactcctggatacaaagaagggaacaacacacacacacacacacacacacaccctctcacagacttagaatacgtggcaagaaaagcatataatttgacattaggagcagaagaattagtgtgctaaggtccttgcattgtccgggagaaggggaaaagtatcaacattagacattgataaagggtctgcaccttttgatttcttaaccactcaaggatagaaaaggggcataactttaaaatgaaacaggaaaatggtgggctgatttttaaatttaaaagaaccgaatacagcaggacagatccaaagcacagaggagatggtgtatttaactccatccacaccaatcattacattacatgcaaagggactgaggactccagttaaaatgacagttttaggctggtttttaaaatacatatttgctgttttatttttagagacaaggtctcgctccgttgcccaggctggagtgcagtggcatcataactcactgcagcctcgaactcctgggttccagtgagcctccacctcagcctccaaagtagctgtgattacaggtgtgtgccaccttgcctagctgagtcccttgaattgataaaaggtatatacaaaaatccctcagtaaacattagttaatagtgaaatattagaagtgtctcttttaaaatcaagaacaagagtgcctgctattactacttgtattcaacattgtactgaaagtgtcaacacagtaaagcaaggaaaatgaaaaagcatgaaaaaaaggcatatggaagaaacaaaactgtcattctttaaaggttagatgattgtatgtatggaaatccaatatcatctataagcagattattagaattaagagtttagcaaatttgcgagctaaaacatcaacatttaagtttttctaagtaccagcaacagaattaaaaaatagaattttaggctgagtgcagtggctcacaactgtaatcccagcactttgggaggccaaggagggaggattgcttgagtcctaggagttcaagaccagcctgggcaacatagtgtaagaccctgtctctataaaaataaattttaaaaaagaaaatggaattttaaatatatataatatttaatcataactaaaaatataaagtttctagaaataaatctaataaaaatatgcaagacctttttggagaaaattacaaagctttattgtaagaagcagagtttaacccttttcccatttagaaaaaaaaagtgcagctcactgccagcgctcatttaattttacgtaaacacactcttggaggctgaagcaaatcttactgattttcaatgtgaaaataaaatataaaaactattcttggagttatttctaaacagaactaacatcagaatcatctgaatcatcagaatcatctctttcagaaaaatcggactcatcgaatgaatcttcggctaactgttgagaacgatgttaacatcacgtgtaggaatactacattttccaggatttgacattttcagcgatcaagaattactatgttttgtaaatggaaataccactactaaagacagaatgctat

SEQ ID NO: 762 - DNA, 89652 bp, Homo sapiens
ctcaaccatcaggttcggcagccggcggcgccgcctggcagctcctcctcttctccgccccgctggccgcgggcgcgggggacgtcagcgctgccagcgtggaaagagctgcggggcgcgggaggaggaagtagagcccgggaccgccgggccaccaccggccgcctcagccatggacgcgtccctggagaaggtgcgtgccgggagggggcgatggggacggtgctgcggcccggggctcccgcttccgaggcaactatttcccagtcgcgagctgccattgtgacccggacagggggacgcgggctgacaggcctcgcctgaggaggcctcgccgggagggcggctggggcccgggcgcgtcacggggccgggtgtctcttgggtccccgtgggccgaagaggctgggcggggttccgtgggggccgcgaggggcccggagcccaggactgggaccgcggggccgaccttgggccctgccgaggttccgcgagtggccggcctgagctcggctggccctttcggaggaccgggagctctccgttggcggccccagatgctcccggaaagaagccgcagttatttcagagccagctgcaaacctgtgggtttttcttggtctccgagttaggaatgaaaattgctaaagcagtggttttccaacttcagcctgagtgggaatcacctggggcctttggtaaaatgcggagattcagtcccggggtcagaacctctgggggcgggaccgggaactgcgtgtttaacagccaccgcccccctcccactccgccccacgcaggtgattctgatgctgagcctgcgatcactgggcgagaacctctgagttccagaaaggggtgggtgttgcgtagattgcgaattgagtttcggggatcgcagctgctccacaacttcctggttcccccattccggtggcgaggagggatccccgagtcaactcgaaatccactggtaacagagcctacctctggtttccccttgggggaacagcagcgtggtgtacctggctgactgctctaccatgtgaaacggattctcattgtcccagtgttagggcttgtaaatggaaaccggtttgggtttcttcacggattcctgctttcggtacctgacattctgccctccctcaaagcccttctctctgttccagcttgggagtctgcttgtccaatccagtgcatacccggtttttcatgcatgtggcattcaggagcaatgctcgtgttttaagacggctacattttaattttgagctggtaggaataatatattttgtcttttttcaaggcagcagctgctgtagattttgttcacttgtcactggagagttgaaggcaataattgtaaaggttgggccagatgtcttcatgtgctcacagtggtatagcctgctcctgggttgcttagcataaattgggtggaagacaagaaaaagataatatggttttcttgtgccatctctggggtgaatgttacgtattttcctggctgggaataaagtcttcccggtcgtctgattagcagggtgtctaccttttggtactttgagtttgtccagatgagtggttcttaaagcagggggcaatttatttccccaggggacatttggctatctctggacatatttttgattgtcacaatgggggcagggaggtgctgccggtacctagtgggtagaggccagggacgcctctaaacatcctacgttgcacaggacagccccccacgctggagaattctctggcccaaaatgtcagcagtgttggggctgagaaatcctggtcaagatcatgtttataacaccagcagttgagtacaaaatgatgcaaagtggtgttatcaatttcctaagaaggtgggtgggcttcatgtgattgtaattggaatcctgaagaactggggtgatctttcctccaggaataattagcctttataggaaaatctgcagggtgggtcagaatcctgctttaaatattacttttctggcatttgatcagtaggttacagtggttgctccctaagtgttaattgatgataaaagatcttaaactctctcaatgaagatctcaagagggactgaaattccagtgtgtttaatattggagcattcacaaaaattgtagtgatcttttaagaattcagaacatgtgggctggaggtttctgccttaggtcaatatgaaaattctgagtgtaagtttttcagaactatgggacttactttttttttttttttgagagggagtctcggtctcttgcccaggctggagtgcagtgaggcgatctcggatcactgcaacctccgcctcccggattcaagtgattctcctgcctcagcctcccgagcagctgtgactataggcgtgtgacaccacacccgactaatttttgtattcccagtagagatggggtttcaccatgttggtcaggatggtctcaaacgcctgaccttgtgatccttcagcctcagcctcccacagtgctgggattacaggcgtaagccactgcatctggccgggacttagatttatattccctgaagtaatacagggccttagatggaatgaacgatttatattggtgctaattgggcagaaaagaaaaagcattgctgtaatatgaatgttgatgactttatgttctgaaaaatagtctgggtcaaagtgaaacatttaattgtgttcattattcctgtttctttgaggaatagactatcctgcgttaaattctacattgttaatataaactcaagagctatgtgagcagttgtgaatgatcccatttaaactgattcttgcgtaatttatactgattacagaaaccacaatgttatttgatgctcaccctctaaaatttaaaataatatctctcactttaaaatgtatgtgaaaaaacaaaaacaaaatgtagtatgcgatcatcatttagtagaatcactcaatgatttggatttggtccaaatataattctgtcccttgctttttctgttatgtaaacgtgcagacctgtgataacagagccattttctcgtcacgatttgcttttcttccacaacagtatcagttttcttgtatctgagatcagtgatgtcccaataaatcagatgggttaattgaggaggcaaaggaaattcaaacttaggagagtaggagtaggggctttgcccctgtcccccactgtatgtccaaggcataaggaacaaggccctctagcagagtctcacagtgtgtacttatgttaatattcaataaagaaaatgccacaggaagtaatcactataatgatgaagattttaagttattaaacacaccttccagtaaaaacctgttatattattattatttttgagacaggatctctctctgtcacccaggctggagagccgtgctacaatctcggctcactgcaacgtccgtctccagggctcaagtgagcctcgcgcctcagcctcctgagtagctgggactacaggcactcacccccacactgagctaattaaaacaattttttttttctcgagacaaggtctcactatattgcccaggctggtcccaacctcctgggctcaagccatcctcttgccttagcctcccaaagtgctgggattataagcgtgagccaccgtgccaggccaaaacctgctactctaaacttgtagaatagcccagacctttttctgttggttaaaagatctcattcttcctgggtattatgtttaggcaaggtatactgcagtttgtttgcatttactttaattctgtccttgagcaaactttaagcagtttctcagcgtcagcactactgatattttgggtcagataatttgctgttatgggggctggcctgtgcatggcagcatgcttagcggtgtccctgacctctgctcagtagatgctagtcgcactccctacccccagttgtaacaataggaaatgtctcaagatgggggcagttgtcccccaaggggtagagggaattgcctgtcgttgaaagtccctaatttagggaatctagagctacagttccggtttggtcaccactagccatatttggcagtttacattgagattaaaattaaacacaatttaaaattcgtttcctcagtcatgctagccacatttcaagtgctcagcagccacatgtggctgatgtctgctacactgggcagcacagatgtggaacatttccattgcaaagaaggttccactggacagtgctaagagctggcaattcgtttttttttttttgagatggagtctccctctgtcgcccaggctagagtgcagtggcacagtctcggctcactgcaacctctgctttccgggttcaagcgattctcctgcctcagcctttcaagtagctgggattacaggcgcccaccaccacacctggctaatttttgtatttttagtagggatgggatttcaccatattgaccaggctggtctcaagctcctgacctcaagtgatccacctgcctcggcctcccaaagtgctggggttacaggcgtgagctactgtgcccggccaattacttgttatatctaattctcatctctgaaagaggcaactttgaccctgtttctgacctaaatcagcacaacttagcccatttttggttcttgaactcatcccgagctaagtgtttctttcctgctatttgggcctgattttagaaaattctttgtcaccttgctgttatgctagaggtttatagcagcatcaatggaacattcctgatcattacttactgataaggactccgagaatttctattcctgctccttccttaaaaagcatgagaaaagaacccctgttaggcaaggttgaaagagtgagaggagatgagaggctgtaattgtagctttcatataaagccaattccaatgttataatgtgagggttttgcatacagatgcatggtggctatggctgtaaatgattatctaatactggctgtcagggaaaactgatgggactcggccatagtacaaagttcctgatcctagatatttatggctttgttcattcttgatttattcaagattgcaggggaagtcagtggcagagctattgatggtcccatttccgtctttgctccactatatctaggattatatgagttataggtagaagttgcttgagcttgatttcatctgttgtcacctaaagcagaaacctgttttgttttataatttttttttgagacggactcttgctctgtcacccaggctggagtgcagtgctgcgatctcacctctgtgcgacctctgccccactgcaacctctgccccctgggttcaagcaattctcctgcctcagcttcccgagtagttgggattatttttgtgccacgcccggctaatttttgttttttttattttttatttttttgaggtggagtctcgccctgtggcctaggctgcagtgcagtggcacagtctcggctcactgcaacctccacctcccaggttcatgccattcttctgcctcagctgggactacaggcgcccaccaccacgcccagctaattttttgtatttttagtagagatgtggtttcaccaagtgttagccaggatggtctcgatctcctgacctccgcctcagcctcccaaagttctgggattacaggcgtgagccaccgcgcccggccaatttttgtatttttaatagagacggggtttcgccatgttggccaggctggtctccaactcctgacctcaagtaatctgcccaccttggcctcccaaagtgctgggattacaggtgtaagccactgcacccagccttgatttataatttttattaatcgaaggtgagctgtggtcaaagcccagtgctgagtgctgacagagacacaaggtgagtaagatgtggcccctgcaggaggtcgcgttctggtaagggagtatacttttttttggacaaatccttgtatagaaagggataaaaagcataggaattaagaaacaaattgtgagtgcaaggagcaagagaccaggaaagattatgtggaagagattctttaggcagaatatttagctcagaattatgcttttctagagtttaattgtaaatgtaatgcagacctttacgagtgtgcctcatattattgctggtagataagaaacaggaaaagcatttcatctttacctttctgatttgatcgctcgctaacaatccctgaacaaggtaaatcctgaatggtgataatcattcaaccttcatctctgctaaaagcatttcttttcctcccaggcaaaaacaaacagtgcctgctgtctagcactagttaaactagttaaacactgcctataaagaagcttatcttaaggaagagttataacagtatctgcttctgtttagcaattttctttttgttccggaataaaggtgtgattccaggtaaacagcaaagtttttagaaatagagcttccctatagtatgctatttttccatcagtttcattatctggaagtgtttactcatgttataagatctgtgtgaactgacactgcagtagtggtctctgggaacacaggtttttggaacacggagttggatctctagcatctccaacatatatctgagtcaagtgattagaggctttttccctccttcacatactgctctctgactgagatgtgatctgtgcagttaactttgctgcctcctttccactgttgggtatttttgtccttttcttttgtttctttttttttttttttttttgagatggagttttgctcttgttgcccaggctggagtgcagtggtgcgatcttggttcactgtaacctctgcctctgggttcaagcaattctcctgtgtcagcctcctgagtagctgggattacaggcgcccaccaccacgcccagctaattttttgtatttttagtagagacagggtttcatcatgttggccaggctggtcttgaactctgtacctcaggtgggccactgcacccggcctatttttgcccttttctttccgattttctgcctatcttcttgaggaatttgtaaggttaaatacttatagttacaccttatacagtacttggctaaccctttgcaactaggaaggttatgatgcttaatcttaatgagccagtaattacagtatgtcttcatattctcagacacactcaagcgtagagaccatgatggttaaaaataagactttcaaatgacaatatccagttcttagaagatgagaggagacggctgagcatggtgactcatgcctgtactcccagcactttgggaggccgaggtgggtggatcacctgaggtcaggagttcaagaccagcctggccaacgtggtgaaaccccatctctactaaaaatacaaaaattagccaggtgcggtggctcacgcctgtagtcccagctactcaggagattgtgccactgcaacagagtgagactccatctcaaaaaaaaaaagaagatgggaggagacaaaagttctggttcttaattaaataactatactgttgaatcaggcaaaaatacttacaaatgtagaaactgagactccaataagataaaccaggtttacaagtcactgtatcagcttggaggattcctgtcctcttctttcatccttggcccataaggaacattatgttcttgctgtggcttctcagtggtatgtattataatagacgtgtgtggtgtttggggaacttgtttaactagtgctagacagcaggcactgtttgttttcgcctgggaggaaaagaaatgctttttgcagagatgaaggttgaatgatgatcactattcaggatttaccttgttcagaaagctgtgggaggcaagagtagttaagttaggaacagctgtctggagctttacctcttgctttttatctcagccgaaagtaggtggtgattttttatatgtctaatgcatatggtataaactagcatctgataactccaaggtcttctaatatgagcagctggtttctctttagttagccctaagaggcctccgaaataagtcctaaaagtcccccaaataagaacattcctctcctgaaaaaaaaactttgttgaaacgaaagtattatatacttccagcactgatgaatgtttcaattaatatacttttaaaaataaattttagactttctttgttatagaggctgcttctcttaaaagccttctcttggccaggtatggtggctcatgcctgtaatctcatcactttgggaggctgaggcgggcagatcatgaggtcaggagatcggggccatcatggctaacatggtgaaaccccgtctctactaaaaatacaaaaaactagccgggtgtcgtggcatgtgcctgtggtcccagctaattgggaggctgaggcaggagaatcgcttgaacccgggaggcggaggttgcagtgagccgagatcacgccactgtactccatcctaggcgacagagcaagactgcgtctcaaaaaaaaaaaagtcttctctttgaaggcttagctctgtatctcttaaacagcagttattcatgtcagttattcatgtaccatctgtgaatttggccacatcactgtaccacctatactattatttgcttagtattttcttttaaatctactttacatcaatttacttcccctttatgaaaaattgagggacagtttacgtacaacaaatatacccattttaattatatagtttgtgttttggaagttgtatatagtgatattaccaccagcatgatcaagatacaaagcattgacctggtgcagtggctcacacctgtaatttcaacactttgggaggccaaggaaggaggatctcttgagcccaggagtttgagggcagccagggcaacacagtgagacccctatctctataaaaaataaaaacttagccaggcttgttggcatgcacctgtagtcccagctacttgggaggctgaggtgagaggatcgcttgagcccaggagggtgaggctgcagggagccacgatagtgccgctgcacttggcctgggtgacagagtgagaccctgtctcagaaaataagtcccctacccacccaccccaaaaaaggtacagagcatttctgtctccctgaaaatgtccctatgtccctttgcagtggatccctgccctgctttctgtcactctagccctctttacccacctatcccatccctgcacccccgccttttttttttttttttaacttagatttgtgctcaactgtaatgtctctaaattctgggatttgaggtgtgtgtttgtgtgggtttttttttttcccaaatcacataaaagtgagagagagagagagagagagagagagtgtgtgtgtgtatgtatgtgcatatatacatatatatatatatatatatatatatatatttttttttttttttttttttttcctgagacggactctcaccctgtcgcccaggctggagtgcaatggcgccatctcggttcactgcaacctccgcctcccaggttcaaacgattctcctgcctcagcctcctgagtagctggggttataggcacaccaccacgcccaggtgattttttatatctttagtagagatgggatttcaccatgttggacaggctggtctcaaactcctgtcatgatccgcccgcctctgcctcccaaagtgccggaattataggcatgagccaccgctgccggccaaatgtataattttttaaattcacactttggtgaactggtttaactgaggaaaagtgttgattagtgtgttttcaaaagatgagattttttttttttcccctgagacagagtcttgctctgtcacctaggctggagtgcagtggtgcattcttggctcactgtaacctctacctcctgggttcaagcgattctcctgcctcagcttcctgagtagctgggattacaggtgcccgccattgcacccgattagtttttgtatttttagtagagatggggttttaccatcttggccaggctggtctcgaactcctgacctcgtgatctgcccaccccggcctcccaaagtgctgggatcacaggtgtgagccactgctcccagcctaagatgaaaaaaattttaaagtgactagttcattaattcccaaatcttaggctctaaagacaccttttatttctattgtagttaccggttttggaagatatgataaacaactttttttttttttttttttttttttgagacggagtcttggtctgtcgcccaggctggagtgcagtggcacaatctcggcttactgcaagctccgcttcccgggttcatgccattctcctgcctcagcctccctagtagctgggactacaggcgcccgccaccacacctggctaattttttgtatttctagtagagatggggtttctactgtgttagccaggatggtctccatccacctgcctcggcctcccaaagtgctgggattacaggtgtgagccaccgcacccggccttgccaatttataattttccattagcttttttgaaaaattgagagttgctccttgacctcctttaccatcttactttgcatttgattcttgacttttcctccaacatttaaattgtcagaacttttaagcaattttaacattacatatgtaatatttcttctggtagtgagggagtattttaatatcccatactgtctgaaagtgataaaaatcacctagcataaaaacgattcttggccaggcactgtggcacacatttctaatctcagcactttgggaggccaaggcaggagaattgctcgtgaagccaggagtttgagatcagcctgggtgacatagtaggaccatgtctctccaaaaaatttttaaaaattagctaagtgtggtggcatgtgcctgtagccatgtctgctcagggggctgaggttagaggatcacttgagcccgggaactcaaggctgcagccagctatgatcacgccactgtgacagcctggacgatagagcgaggtcatgtctcaaaaaaaaaaaaaaagtttgtaaaaaatgctcatgaagatatgaatagtagggcttgttttataaaatgagctaactattaaagtctcagttctggctgggtgcagaggctcacgcctgtaatcccagcactttgggatgccaaggcaggcagattatctgagggcgggagtttgatccggccaacatggtaagaccccatctctactaaaaatacaaaaaaattacctgggtgtgatggcgggcgcctggaatcccagctactcaggaggctgaggcagcagaatcacttgaacccgggaggcggaggttgcagtgagctgagatcaagccactgcactccagcctgggagacagaatgagactccatctcaaaaaaagtctcagttctgtgacagtgagcatgcaattgaatggttcttcttaggaaaggagaattaaatcatacctatcatgcaactgtgttagataaaattgtagcaaaaatattgaacccacttcatttatacaacagaattaactgtacttgaaatataatttatgaatttgtagagaggtaaaactgtgtctaaattctcagcaattagtatctatcagaaaatgtgcatgtaggtatacccactctgtaaatgctttgttgcaccttttttggttttgggatttttgtttgagacagagtcttgctctgctgcccaggctagagtgcagtggcgcgttcttggctaactgcaatctccacctcccaggttcaagtgattcttgtgcctcagcctcctgagtagctgggactacaggcgcacaccgccacgcccagctaatatttgtatttttagtagagacggggtttcaccatgttggccaggctggtctcaaactcttgacatcgggtgatctgccctgctttggcctcccaaagtgctggttttacaggtgtgagccaccatgcctggccatgctttcactcttaaaaatgcttgggtttaagagttggtggaaaaagggaaaaaaaaaaaaatgccctgatctggatgatgagtttacggccatctagttgagactgttgtaaagtagaaattttccctgtaaagagtcagtttcttcccaggtgaaaacattaatcaagcaaggataatctttaaaattaaaccttagttctaaatatgatttttgagtacaagcttttttaaagtgttgagttgcttcatttacttacttgataaaattgagaagcagtattgcccagtggttaagagcactggtcctagaattttacttagttttaagttctggctctaaaatgtactatgatttggggcttgtgaggaagtaatgtgtgtagaggcgttaattattagcacaatgcctggaatatagtaagcaacccagtaagtattagtaattataaggatcataaatctgattgaatacttactctgtctgaccctgcactcagtgcgaagggattcagaaattatttgacattcttcccaggaacttgacatagaatactgtttttcctttgtttttttgtttttgttttttgagatggaattttgctgtcgcctaggctggagtgcagtggcaccgtctctgctcactgcagcctccgcctcccaggttcaagcagttctcctgcctcagtctcccgaatagctgggattacaggcaccccccaccacgcctggctaatttctgtatttttagtagagacggggttttgctatgttggccaggctggtctcaagcacctggcctcaggtgatccgccaaccttggcctcccaaagtgctgggattacaggtgtgagccactgcgcctggcctgttttttttttctgccaacattatcaaacagtttcctatgtactaactaatagacatctttatacatctttatacaatttaattcttcatttaggtttgtgtctggctgttgccctggtgttgtttattaatgttgatcatacagctattttttttttttttttaattgatcattcttgggtgtttctcgcagaaggggatttggcagggtcataggacaatagtggagggaaggtcagcagataaacaagtgaacaaaggtctctggttttcctaggcagaggaccctgcggccttccgcagtgtttgtgtccctgggtacttgcgattagggagtggtgatgactcttaacgagcacgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcggggggctgacccccccaccaccctcccggacggggcggctggccaggcagaggggctcacttcccagtaggggcggccgggcagaggcgcccctcacctcctggatagggcggctggccgggcggggggctgaccccccccacctccctcccggacggggtggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggctgggcggggggctgacccccccacctccctcctggacggggcgactggccgggcagaggggctcctcacctcccagtaggggcggccgggcagaggcgcccctcacctcccggacggggcggctggccaggcggggggctgacccccccacctccctcccggacggggcggctggccgggcagaggggctcctcacctcccagtaggggcggccgggcagaggcgcccctcacctcccggacggggcggctggccaggcggggggctgatccccccacctccctcccggacagggcagctggccgggcggggggctgaccccccacctccctcccggactgggcggctggccgggcggggggctgatccccccacctccctcccggacggggcggctggctgggcagaggggtcctcacttcccagtaggggcggccgggcagaggcgcccctcacctcccggacggggcggccggccgggcggggggctgacccccccacctccctcccggacggggcggctggccgggcagaggggctcctcacttcccagtaggggcggccgggcagaggcgcccctcacctcccggacggggcggctggccgggcggggggctgatccccccacctccctcccggacggggcggctggcccggcagggggctgaccccccctcccccctcccggactgggcggctggccgggcggggggctgacccccccacctccctcctggacggggcgactggccgggcagaggggctcctcacttcccagtaggggcggccgggtagaggagcccctcacctcccggacggggcggctggccgggcggggggctgaccccccccacctccctcccggacggggtggctgctgggcggagacgctcctcacttcccagacggggtggctgctggacggaggggctcctcacttctcagacggggcggttgccaggcagagggtttcctcacttctcagacggggcggccgggcagaggcgctcctcacatcccagacagggcggcggggcagaggtgctccccacctctcagacgatgggcggccgggcagagacgctcctcacttcctagatgggatggcggcggggaagaggcgctcctcgcttcctagatgggatggcggccgggcagagacgctcctcactttccagactgggcagccaggcagaggggctcctcacatcccagacgatgggcggccaggcagagatgctcctcacttcccagacggggtggcggccgggcagaggctgcaatctcggctctttgggaggccaaggcaggcggctgggaggtggttgtagcgagccgagatcacgccactgcactccagccttggcaccattgagcactgagtgaacgagactccgtctgcaatcccggcacctcgagaggccgaggctggcggatcactcgcggttaggagctggagaccagcccggccaacacagcaaaaccccgtctccaccaaaaaaaaacgaaaaccagtcaggcgtggcgacgcgcgcctgcaatcgcaggcactcggcaggctgaggcaggagaatcaggcagggaggttgcagtgagccaagatcgcagcagtacagtccagcttcggctcggcatcagagggagaccgtggaaggagaccgtggagagagggagggggagggggagggggagggggagggagagggagagggagagccatacagctattttggcattgcccacagctattgaggataagaaatgtgatgaagaaagtggtagctgccatcagtagaagcttatgaagacgctgtttttagttttaagggatcagttaatctacaacttttcatagagcattcattggtttagatcttaatattatcctgaaactggataatactttatattttgaattatccaattaatgcaacaaacacgtgagggtctatggcattggagtcattgttcacatttattcacccaaacttaactatcagtgctgcttttcctacccacccactcccccctgggcttactccctgaagagcaagaacgatttatttatttttatttaattttttgagacagtcttgctctggcgccaaggctgaagtgcagtgtcgcaatttcagctcactgcagcctctacctcctgggttcaagcgattctcctgcctcagccttccaagtacctaggactacaggcatacgtgaccatggccagctaatttttgtatttttagtagacacgggattttgccatgttggccaagctggtctcgaactcctgggcctcaggtgatccgtccacctcggcctcccaacgtgctgggattataggcgtgagccactgcgcccggccagcaagaacaatttaaacataagccagtttacatttacgtaaactgcatgtgcactccagagtcagagattcacctggggattgtgaatctgcatttccctcctgcctttcagtttaagcagcttgtcattacatgggattttagtgtttataaatgcatgttcacacaatgcggcttctaaactattttgtgtgtatatatatgtatatagatatgtatgtgtgtgtgtgtattgttgtcgagacaggttctcactcttttgaccaggctggagtgcagtggtgtgatcatggctcaccaccagagcctcaacctcccaggctcaagtgatcatcccacctaaacctcccaagtagttgggactacaggcatgcaccaccacgcctggctgatttttgtattttttgcagatatggggttttgtcatattgcctaagctgtattttgtctattttttttttgtttttttttttgagacaggttgttgctctgtcacccaggcagtggtacaatcttgtctcactgtaaccttgacctcctgggctcaagcaatcctcttgcctcagcctcctgagtagctgagaccacaggcatgcactaccatgcccggcttaatttttttgtattttttgtagagatgaggttttgccatgttgcccaggctcatctcaaactcccggactcaactgatcctcctggcttgacctctcaaagtgctgggattacaggcatgagccaccacacctggcatattttatctattcttaacggaaatattcattataattctgttgaaagaaatagctgtgttgcacttagagaacagtatgttgatatccactctggcatgccttcctaagggattttcaggttaatatgacaattggagaattgagctaactttagacccctggtctaaagagaagtcaaaattagtaggagtctgaatccttgccttcaagaagcttgtaatctaattggagagcacatttatactggaaagcacatctataaaacaattcacagtaaagggtgtaaggaatcatgaggataaatggcagctgcaacaactgcaagcattctgtcccattgtccccataaatacaaccaacattgttaagcaacaaatctagatttttggtttaggaaaaaaggcatcagtattgttagaggggatgggaaagagcaaaagtggctttatctgtaaaggcttcctggaattattgacttgtaattgaataggtgctaggagagagatagataaaagtcatgaggatgtttcagacaggatggtcgttgggagcatgaaggtgtgaatcaagccaaactgtttatcttatcatttggctaggtggtaggggacacatgggagtgtcacagcagtgaggatcgtcaggagcatcaccagctgactcaggggtgaagataaattctcttgaccatcatattcctcattctcctcactgtcagcactgaggcctttttcgagtgctttctgagccttctcatagttaaagtggtgaattttattgaaaacacttgttttaaaatttgtctattttatctaaaaatttggtcgtggctaaatgattaccttgtaagcccttgtgggagccagtgtgatataatagaggtcagaaacaggagtcagggaccccaggttttggcacctcattgtcatttattagctccatgaccataggcaagtcgcttaacctctctgcatcttagtttcctcacctccaaaatgttagaccagaatcagacgtttttatgctatacttttttttttttttttgagacagggttttactctgttccaggctggagtgcagtgacacaatcatagcttactgtagcctcaaactcccaggctcaagtgatcctcctacctctgcctcccaagtagctaggactacaggtgtgcaccaccacacccagctaatttatttctcactatgttgcccaagctgatctgaaactcctggcctcaagtgattcttctgccttggcctcccaaagaatttttttcttcttttcaatgacacttttttttttttaatttaaaaaaaaaattttttttaattatactttttaagttttagggtacgtgtgcacaacgtgcaggtttgttacatatgtatacatgtgccatgttggtgtgccacacccattaactcttcatttaacgttaggtatatctcctaatgctatccctcctccctccccccaccccacaacaagcaacagtgtatgatgttccccttcctgtgtccatgtagtctcattgttcaattcccacctatgagtgagaacatgtggtgtttgttgttttgtccttgagacagtttgctgaaaatgatggcttcaagcttcatccatgtccctacaaaggacatgaactcaccattttttgtggctgcatagtattccatggtgtatatgtgccacattttcttaatccagtctatcattgatggacatttgggttggttccaagtctttgctattgtgaatagtgccacaataaacatacgtgtgcatgtgtctttatagcggcatgatttataatcctttgggtatatacccagtaatgggatggctgcatcaaatggtatttctagttctagatccctgaggaatcgccacactgacttccacaatggttgaactagtttagcgtcccaacagtgtaaaagtgttcctatttctccacatcctctccagcacctgttgtttcctgactttttaatgattgccattctaactggcgtgagatggtatctcattgtggttttgatttgcattctctgatggccagtgatgatgagcattttttcatgtgtcttttggctgcataaatgtcttcttttgagaagtgtctgttcatatccttcgcccactttttgatggggttgttttttttcttgtaaatttgtttgagttcattgtagattctgtctattagccctttgtcaggtgagtagactgcaaaaattttctcccattctgtaggttgcctgttcactctgatggtggtttcttttgctgtgcagaagctctttagtttaatgagatcccatttgtcaattttggcttttgttgccattgcttttggtgttttagacatgaagtccttgcccatgcctgtgtcctgaatagtattgcctaggttttcttctagggtttttatggttttaggtctaacgtttaagtctttaatccatcttgaattaatttttgtataagatgtaaggaagggatccagtttcagctttctacatatggctagccagttttcccagcaccatttattaaatagggaatcctttccccatttcttgtttttgtcaggtttgtcaaagatcagatagttgtagatatgcagcattatttctgagggctctattctgttccattggtctatatctctgtattggtaccagtaccatgctgttttggttactgtagccttgtagtatagtttgaagccaggtagcgtgatgcctccagctttgtttttctggcttaggagtgacttggcaatgtgggctcttttttggttccatatgaactttaaagtagttttttccaattctgtgaagaaagccattggtagcttgatggggatggcattgaatctataaattaccttgggcagtgtggccgttttcacgatattgattcttcctacccatgagcatggaaagttcttccatttgtttgtatcctcttttatttcattgagcagtggtttgtagttttccttgtaagttggattcctaggtattttattctctttgaagcaattgtgaatgggagttcactcatgatttggctctctgtttgtctgttattggtgtataagaatgcttgtgatttttgtacattgattctgtatcctgagactttgctgaagttgcctatcagtttaaggagattttgggctgagacgatggggttttctagatatacaatcatgtcatctgcaaacagggacaatttgacttcctcttttcctaattgaataccctttatttccttctcctgcctcattgccctggccagaacttccaacactgtgttgaataggagtggtgagagagggcattcctgtcttgtgccagttttcaaagggaatgcttccagtttttgcccattcagtatgatattggctgtgggtttgtcataaatagctcttattattttgagatacggtccatcaatacccaatttattgagagtttttagcatgaagggttgttgaattttgtcaaagggctttctgcatctattgagataatcgtatggtttttgttgttggttctgtttatatgctggattacatttattgatttgcgtatgttgaaccagccttgcatcccagggatgaagcccacttgatcatggtggataagctttttcatgtgctgctggattcggtttgccagtgttttattgaggatttttgcatcgatgttcatcacggatattggtctaaaattctctttttttgttgtgtctctgccgggctttggtatcagaataatgctggcctcataaaatgagttagggaggattccctctttttctattgattggaatagtttcagaaggaatggtaccagctcctccttttacctctggtagaattcggctgtgaatccatctggtcccggattttttttggttggtaagctcttaattattgccacaatttcagagcctgttattggtctattcagagattcaacttctttctggtttagtcttgggagggtgtatgtgtcgaggaatttatccatttcttctagattttctagtttatttgcatagaggtgtttatagtattctgtgacggtagtttgtatttctgtgggatcggtggtgatatcccctttatcattcagtgaaactttttacaaataaaaactttactcaaaaccctgttatacaaaacagagctgatctgctagggagttagaagccccaactgcttacctaacccttccttctcagagtcctcccagggaccttaaggctcaggagaacacagctggaaaatccctggactagatcccttaggtcccttctagaatgtaacaatttctgaatcttatgttgataaatggagtggaatttcttaaaaacaattttgaggaggcaatgcagttttaaatatgtacgtattgtatgccatgctgtaagatattgctagatacagtgagcaataggaaaaggtaaacacagctcttcctttaagcagcacacttagaagagtaagaggggaacaaaagagctataacttatatatgatattatatgtattatatgtaatatatataatttattgttataacacaactcatactacatagagattgaagtcaacaagaattttctccctaaaaataactacagagattaagaatagagaaaggaaaatgaatgtgtatgttttaattctgcaaaaagttcgggcacagtggctcagcctgtaatcccagcagaaggataacttgagctcaggagtttgagaccagcctatgcggcataatgagacccttgtatctacaaaaaaattgtgaaaattagcaaggcatggtggcgagcacttgtattcccaggtactcaggaggctgaggtgggaggatcacttgatccctggaggtcaaggctgcagtgagccacgatcaaaccactgtaccccagtctgtgtaacagagcgactgtctcaaaaataatatttgtcaaaatagcatgtctttgtatcactgccacattgcttgtctgaagcgaagctgactcactttgttatcataagtgatcttaccaaagaccaagttgtccagttgccttggagtgtaggtcatgcgttgccggtaccctggggctgtgtacaatggccaggctgaggggaccttgtggttacccccatgggacttgtaacttgtcaagtgggaaggtggtaccaagtgaagaagggtagggtccttggttttggcctcacgtggttcttcccagaatgaatggtgaaaaaattataattctgcagaaaaatttaaattctattttgtttactttttggatgggagataggtgtacacatggcactaaaattcaaaaggaacttaaggaggccaggcacggtggctcacacctgcaatcccagcactttgggaagctaaggtggccagatcacttgaggtcaagagttcgagactagcatggccaacatggtgaaaccccccgtctctactaaaaatataaaaattagctgggcatggtggtgtgtgcctgtaatcccagctacttgggaggctgaggcaagagaatcacttgaacccaggaggcagaggttgcagtgaacaaggtcatgccattgcactctagtctgggcaacagagtaagactccatctcaaaaaataaaaataaaaacagcagcttcctctaggaagtggggctggaagacttttactttttctgttatacttttgtactattgcaggttttaaaatcatgtacttcacagtaaatccagaagaaattatgcacttaatttttctgggtgaattgtgttgtagaggtaatagaggattattaaaatttctttcttttttttttttttccccagatagcagaccccacgttagctgaaatgggaaaaaacttgaaggaggcagtgaagatgctggaggacagtcagaggtgagtaggacagaggtgaccctgttcaacgagttcagcctgctgtgaagccagtggctctgggttctttctgttaaaggtgcctcttggcttcacagtgtcacacacagcttcggctgacttgaaaattggtgtttgtcttgggtaaaaggtgccttgtaattaaaggattttgaaattgagaggaaagacttatactatttaattctgtctattaagagtttcatttacttaatatattgatttgactctataaatacttattatatattcaggtcatatagagcaccaagtaaacaagaagtgggtggaacttttttgttgcatattcttgtcttttccagaaattcaaacgatacctgaaactggaggcagggagatgtgataaatgtgtttgaaatcctgcctcagtcactgggaggttataggcaacatggtcatgtttgcatgttcaggcgttagaaatttggtatgatgaaacaaatgaacagctttttcttttctttaaattagaagaacagaagaggaaaatggaaagaagctcatatccagagatattccaggcccactccagggcaggtaggtggcactgaggatccatacctttagttaaggtgtaaatttttgtttgtttgtttctgagacggagtcgtgctctgttgcccaggatggagtgcagtggcgcaatctgggctcactgcaacctccgcctcccgggttcaagcagttctttgttgtgcctcagcctcccgagtagctgggattacaggcgtgcaccaccatatctggctaatttttgtattttcagtagagatgggattttgccatgttggccaggctggtttctaactcctgaccttgacctcaggtgatctgcccacctcagcctcccaaaatgctgggattacaggtgtgagccactgtgcccggcctacatttttcttaaaccagtgtcttatcatcattgatttatggttttagttttaatgaacacatagcaaatttaaatagacttatgtgcagtataacattagaaaactgaagtgtcgttggctggttggtgatattgccgcacctgctggcttctctccctctcccatttggaatttaatagaggctgagtacagtgggtcacacctttaatcccagcactttgggaggccaaggacggaggatcacttgagcccaggagttcaaggttacagcgatctgtgattgtaccactgcattccagcctgagtgatagagacactctctaattttgagacagagtctcgctctgtcgccaggctggagtgcagtggtgtgatctcggctcactgcaacctctgcctcccgggttcaagtgattctcctgcctcagcctcccgagtggctgggattataggcacccaccaccacgcccagctaatttttgtatttttagtagagatggggtttcaacatgttggccaggacggtctccatctcctgacctcaggtgatccgcctgccttagcctctcaaagtgctgggactacaggcataagccaccgcacctggccaaaaattttttagaaaaccaacaatttaatacaacctcatgactcaaaagtgatacatggagctaggcaccatggtgcacacctgtagtcccagctgcttgggagcctgaggcaggaggatggcttgagtcaaggagttcgaggccaccctgaacaacatggcgagaccctgtcaaataaaataaaagtgatatacaaattcatcattataactggtgtgtcatacttagttcactcttgaaacctgtcatctatttggtagactgagttttattctaagaggtattttaatttgataagatttattgttttcataatgtaaatgaaaggaaaatgtcaaattacttattttttggcaactgaagcaaatctgtcatgtttgagtagcaggaaaaatagcaaaaaagtaagtagctgactaaaattttcacaagacattagcagttaatctgggattagtatcccagcccagcttccctgagacaaacttatttttttttcctgttataaccaggaaactgcacataagtaaacagtacaactcccttaaatatcctttgacctgaatatagattgaaccaggttgcaaaagaaaagtatggaggaaggatcacagtgtgccaataacacgccgagatactaatactttaaaacagtcactcctattcgtagcatgaataatgctgatgtgaagctaggtgtgaagtgcattctcagctcagaacaggaggcgggtcctataaaatctcctcattccagccctactgatggaaaccaaaggttttaaggtttagtctcctaattccacggaagttttcccaggagagatactcccagcagcatctgtaattctcagccttaagccactcactaggaggattcacacttaggagtgctaccacccagcattcaagactagtaacatgccaggcacagctaagtgccataccttcactgtctgaagcctcccaaatccataacgtccggcttggcaagttggaatagcttgctcgaggtcatgtggcaggcagccagtgtgcctcaagggcccctgcctgctccgatctctacagtgtccaaggcccagagcccctctcacttgaagggcagcaccttggggacaattggtttggggacactgttttgatggcgcttcctttgttgaaagaggaaacctctttttagtctattctcattaacagacgaatagccctgcgttattcctgttgcaagttgccttgccattgcttgctacttcagccgttcgaattcttttcataactttccatctcctcatgtaatgagcatttcatagcagcgtatcttggatagaagtaaaatgtttttatactctaagcagatctcaaggttcccagcttggggaagagctggtaataaatgaagcttgcattgttagaggctgttagtccaaacggacaagatccctatggaggaaaattagatataccagtggcattggagtgttctgtgactgtctagcattatactatactaaggatgattatatattgtattttatataatatattttatataatgtatagtatataatacacttatatattataagtacatattataaggacttttggctcttattacatgcttattaaatattctctgtcttgtactccaagattcaaatgaaatgtgtagaaatgttgctagagcaagactggtggctgggcaaggtggctcaggcctgtaatcccagcacttttggaggctgaggcaggaggattgcttgagcttggtggtttgagaccaggctgggcaacatggcaaaaccctgtttctaccaaaaataaaaaaatggctgggcgtggtggctcatgcctgtaatcccagcactttgggaggccgaggagggtggatcacttgaagccaggagttgaagaccagtctggccaacatggtgaaaccccatctctactaaaaatacaaaaattagccgagcgtggtggcgcacgcttgtaatctcagctactcaggaggctgaggcaggaggatcgcttacacccgggaggcagaggttgcagtgagcccagattatgccacttccctccaccttgggtgacaaagtgagaccctgtctcaaaaaaataaataaaaataaaaagactggtgacatttattaaaatgaaactcataattaggtagaagatttatttaaccacaagtaagtttatatcagaattcattttataatttgagctttgttttttaaaaagcataaactatataccacgttctttctcttatagttgcttaagaaaaaaaaaaacttgaagcaacgccagttgaatgagggaagtagcgggagagtggcgggggatgtgtgctgttcccatcagcccatcaactcttttcattctgcagtggacaagatatggtgagcatcctccagttagttcagaatctgatgcatggagatgaagatgaggagccccagagccccaggtaatgaacctggcagcttctcttttcaagtgcatgtgttcttgatttcagtagtgattgcgctctgacaagttgctcaaataagaagctatatttcattgagttacatatgatattaaagcaatcctttttattttcagaaagacatttatattaatatatattttgtgaaatgaaggcatttattgaaattagatcccatagtttttatggtatcatgccttagagaggcgctggcagaaggactgaagagtgagtgtcgcatgtctttctgctgctgtgcttctgcttcctaagaattgctgtacttgtattcattaggtatttagttagttttctctttaattattttaaatttaatgttttgaaataagtaaaattgttctcttggttcaaaattcagacaataaaaaacgatatacaaagggaattttccttcctacctctatctccctaccgtgttttcttctctagagacagacattaccagtttcttgtgtattcttccagagagattttatatgtattatacaccagcaaaatgtctatgcccaccctctctaatacataattactacgcatatgctgtgcatcttgcattttttcacttatgtcttggagttcactgcatattaatgcacaggaactttctcctttgtcagagctatgtgttttactttgaacagatgaaccatattttattttattggtcccctgtcatgctgcactgttacaaacattgctgcagcaaacaactttcgacatgtgtcacttctcatagaagcaggtgtctggaggacaaagtcctgaaagtggagttgctgtctcagacagtgtgtgcttttgtaattttgatagatcctgccaaatttccctccatggagttgcggcatttagcagtcccaccagcaatgtatgagagtactttatttccacacttttcacctgcaaaggcgttatcagactgaaggatcattgataagtgatattctgatgagaaatctgataagtgagaaatggtgtttcagcataattcgaatttgcaggttttttaaattatgaaccaagtgacgtgtctttttgtatgttttaagacccatttatatttctaggaactgtctgttgcccatgatcctattaggttatttgtctttttcttattattcacagttaacaattttaaacttattccttcttttttacagttattctttataagggaaattagttttaattctatataaaacattttatataatcaattttaattatatataaaataatacctagtcccccatgaatttgctgtattattgcaataaataattcttatttgatgcatagacctgagatttaattcttttttttttttttttttttttgagatggagtcttactctgttgcccaggctggagtgcagtggtgccatttcggctcacttcaagctccgcctcccgggttcactccattctcctgcctcagcctcctgagtagctgggattacaggtgcccaccaccaggcccagctaattttttgtatttttagtagagatggggtttcaccatgttagccaggatggtctcaatctcctgacctcgtgatccgcccgcctcggcctcccaaagtgctgggattacaggcatgagccactgcgcctggccaggatttctttaaaaaatgctttcagctcattttaccttagctctaccctccacaattcttaaggctggtatttaatttttaaaatactttaataggaaattattttaaaactgtaggtactcaatttaaaaagggctatttatctcctggaactcaaattataaaaatatttttctggccaggagtggtggctcatgcctgtaatcccagcactttgggaggccgaggcaggtgaatcacctgaagtcaggagttcaagagcagcctggccaacatggtgaaaccccgtctcaactaaaaatacaaaaaattagccaggcttggtggtgggcgcctgtaattccagctactcgggaggctgagacaggagaatcacgtgaacccaggaggtggaggttgtagtgagctgagatcacaccactgcaccccagcctgggcatcaagagggagactccatctcagaaaaaatatatatattttttctccgtctcaaaaaatagaaaaacttctcaccaaactatcactactgtttatgcattgatttgccttctgggccattaagtagatttcgagtctgacagatatttctgtggaattctgtgtctctaagttctatgtccttttttatggtttgactctaatactttaattttgcttaacagaatccaaaatattggagaacaaggtcatgtggctgtgttgggacatagtctgggagcttatattttgactctggacgaagagaagctgagaaaacttacaactaggatactttcagataccaccttatggctatgcagaattttcaggtaaagacatgatgagtttccagtgaagacttttatgagtcgggtatagactgaaagatcttttttctggagctgtactacttgggttcagatttccttctccttgaaaggggtgtttaacctctcaatgtctgtttcatcatctgttagatggggatagtattaatacctatttcatagaagcgttgtgaggattaaatgagctaatggactaacgcatgtgaagggtggagaatagaagcacatatgtgtttgatagggtcagcagttatttatttgtggggtatctaattggcacatgtcagtagaagatagagcaatgatctagattcaaatacagttgtcccttatccttgggtgtccttgggggattggttcttgacctcccatcctcaccctatggataaaaaaattcatggatgctcaaatcccttatataaaatagcacagtattttcatgtaactgaggcacatcttcccatatactttaatctcttgattacatataatacctaatacgatgtaaatgctgtgtaaatagttgttacactgtattgtttagggaataatgacaagcaaaaaagtctgtagatattcagtacagaggcacccatctttttaaatttctgaagattttttactcatgcttggtttaatccacagatgcagaacccacaggttcagagggccagctgtgctttgaaaatattagcttgcgttttattagaaagaaaactctgaggccaggcgcggtggctcacgcctgtaatcccagcactttgggaggctgaggtgggcggatcacaaggtgaggagatcaagaccattctggctaacatggtgaaaccctgtctctactaaaaatacaaaaagattagccgggcgtggtagtgagcacctgtagtcccagctcctctggaggctgaggcactgcactctagcctgggcaacagagcgagactctgtctcaaaaaaaaaaaaagaaagaaaagaaaagaaaactctgtcataaggaagatgaatatgtgctatgaaactgaaatttgttttattctgtgataatcctggcagtactaaggaattacaacagatgaaggattcagtaggagacataggactagtggcattgggtttatgctgttacttttatggagaaggaatgtttgcctaacttgagacatttatcttgagagaccctcactttcagtgttgggaaagaacttggccaagcaggagtataagtttgcccaactttattaaaggagcagtgttctgttgttctagtaaaaatctattgcctgtaattgaaattgtccctcctcctctaggagatggagcctcagcagattatagtaaaaccaaaagctagcctgactagcttttttatttttttgagatggagtcttactctgtcgcccaggctggagtgcagtggcacaatctcggctcactgcaccctccacctcctgggttcaagtgcttctcctgcctcagtctcccgagtagctgggactacaggcactcaccaccacacctggcaattagtagagacagttgtttcaccatgttagctaggctaggctcaaaactcctgacgtcaggtgatccacccgccttggcctcccaaagtgctgagattacaggcgtgagccaccacacccagcctctgactagcatttttgacagttttatttactttggatgttttagggctgaaactctgctatgaactatgcctgtgttatccagtgctggccttagttcataataagctagaaccatgatcttcaggctttttatatctgagaattcctggtctctacttgttttcatagtttctgctctttatggaattgggtatggatggagggttattgtctcgctgcttggtaacctcagctgtaatgaggtgtcagccatctatgatgaggatgtttcacattcctgtcctctctgcctgataaaagtgacaattcctagcttgagaaaagaattgtctccatgattgtaaggttgacttatacaatccttaactagaaataagagcatattaatatgtatctcttaacagatatgaaaatgggtgtgcttatttccacgaagaggaaagagaaggacttgcaaagatatgtaggcttgccattcattctcaatatgaagacttcgtagtggatggcttcagtgggttatataacaagaagcctgtcatatatcttagtgctgctgctagacctggcctgggccaatacctttgtaatcaggtaatgtggtatcaggtggctattttaaagaaataatgttttattttgttctgaaagttttaaagttgacccgtttgtctagttgctgttcttgttgagtgaaaagaaagatggtcttatatgcttttgtcatatttgtaaaaattactgaatttagaaataaggaatatgtgatagattacccaagggcatccacagtcaacattttctcttttttcccagactttaatcgaagggggtgtgtttgtgtttatatggttgtatctggctcttttcacttactgttaaaacaggaatatatcattttaataataatttttcaacgtatagtttatttttaatgccttcatggtatttcttcaagtgaatatatagtaattaactgttgcctttttggacaactaagagtgtttgcattctcttgctttctgtgaccattttcacgtaatgttctttgtgtagtgctgttaaggacttctctgtgcataaagctcttcctgtattttatttagggttatggtcctcagatggattttcagagtcagtctagaattgctggatcaaagagcatgactattttttttttgttttttgtttgttttttgttttttttgagacagagtcttgctctgtcgcccaggctggagtgcagtggcgtgatctcggctcactgcaagccctacctcccggattcatgccattctcctgcctcagcctcccaagtagctaggactacaggtgcccgccaccacgcgcagctaatttttttgtattttttttagtagagatgggtttcaccgtgttagccaggatggtgtcgatctcctgacctcgtgatctgcccacctcagcctcccaaagtgctgggattacaggcgtgagccaccgcgcccagccgagcatgactatttttaaagttcatggtgcttctagcccaactgggaggactacatcgagataagacactgttaaccgtctttgccaagaacgtttaaaagcaaaaccgtagggttggaggattcctcttttgtaagctgtaggagtcccagggggatgtatgggagacacttagtgacttttaaattgattctgagctgtgatcactggtgttaagaaattatgtcctcttcttgaggggtgtacaaaatggggagtttaataataatcctctgaaacgtgaaatgaattacttagtgtctactgcatgccaggctcttgcggacacaaggctgtttggggacaacagtctaaccttcaaaagatgtgtaagagtgttctgttgggaatggcagcaggcagagcagcatatataagatggttatgttcacattttttaaagtgtgtgtatcctttatacctatgtttttgtacctagaaaaatacgtaaatttatacctagaaaatatctgaaaggttatgtattaaactgttaacggggtggattggtggcttatagggtagggggctaggcattttcacttctaatacctgtgtttttttttgaggatttgttttacttgggtgtcacgttcataatttttaatcctttaaggagaaaatgtgcttattaaatttttggtctctgaatgctaccgagtcttagtcatacagaacaatatgctgcaactgtttacaattcctaaaactgtaaactcctcaaggacttggaggctaaacatgaagaatataaaattaagttgacaatcactgtctctgtgcataacactgacttcacttctcttgagaaatgtgcatctgctaatccatatttattactttttaggggtgggtgaacccataaataagatactgttctttgaatgcctttagctggtgttatttaccagtaatgcttggagaaagaatccaaaattacccccactaaaatgctcacgacccaattgtttctgtgtttgtcaaagtgtttctggtatattctagaatataccaaagataattacttgaatcatttagaaaattttacattatatcctcttataaggcacttggaaattcaccctttttttttttcggcttggctttctaaatgtactttaacatcaatttataatattaagagttcctaaggagagagatttcttagaagaataatcgtggcttgtcttagagccacagcctttcacaatctgaagtgaatggtgcagagagctttcttgtcaagtcgtatgtttcttcctgcagctcggcttgcccttcccctgcttgtgccgtgtaccctgtaacactatgtttggatcccagcatcagatggtgagttctacttttggtttgtaaaatcatgtgggattgtgtttggaaactgcctttcaagtgaagttctttttgctggcctccagataattagtaacttactgatgtattgcttggacccttgcattgtgtaatatatgcttctgttaatatgtgaatgtccatgaaggttggttggtatataggtcaggagcacctggcttttaaggagtcttgtaattactgtatcgcctgctttaagtagaaacatggcagctcaattaagcaccagaaatttcttctgaagctcctacttttaatgagttagcactgttgcctggatttatgaatgggcagattttgaaaatgaggttcttcattgtcatcgtggaattgagttctgcttaatttcagacatgcaggtgataaatctctccttaatgattccagaaggaaaaggaagggatggattttagagttttttatttcttttgtcaaggtagttttattttctagttcaggtacatcagtgagtaatagtagagatacattcatggctgttttaggagagttaagagaacatttcatttaaatgtaaatgtttaaaatcaaagaaatgttcctgcatatgtacagtttttacctttaatcttgtttaactgatttttctagtcttcaaggaaaactatttgattttcacatctatgatgagagaaaacagaaaaattgtcaagagtaagaattgatttgacattacttttgagagttatctgcttcttttgcaagtcataatttttcattttatagcttttatactaggcacctcattttttaatgatttgttttggttccaggatgttgccttcctggagaaactgattaaagatgatatagagcgaggaagactgcccctgttgcttgtcgcaaatgcaggtaggtagcatgatgctgaatctaccattttgaatatataggagcgaggctacatcctcagcctataaaagataaagtcttaagaaatgtgtgtgtaccacatgtttaattaagatagtccatgtccacattgtagcaaaaactgtaatagtaaggttggctcgttagatttttctttaatcgttggtttgttttggaagttattttatgtgtgtgtatactttttcatttagattgtaaatgcttctctatcttctccttcatgtacttcttttccctgttctaaactgaattttattttatttttttgagacagagtctcactctgttgcccaggctggagtgcagtagcacaatctcacctcactgcaatctctgcctcccgggttcaagtgtttctcctgcctcaacctcctgaattgctgggattacagctgcgtgccaccacatctggctaatttcttgtatttttagtagagacagggtttcactatgttggccaggctggtctcgaactcctgacctcaggtggtccgcctgcctcagcctcccaaatcgctgggattacaggcatgagccactgtgcctggcctgaatttttaaatgacacatttaagccaggtgtggtggcacatgcctatagtcgccctactcaggagacaagcaagatgctggcttaagcccagaagttcaataccagcctgggtaacatagcaagaccccatctcaataaataaaaataattgtactgacattgtaagattgttgtaaaaattaaacaagaaaattcataaaatgtcacacttaaatatctaccttataggcggcagagcaactaccacttgctgctccacttatctcattcagcatcatacttgaaatctaagacagtgcaataaggtaaaaaaaaaactgacagattagaaaggaagaaataaaactttgtttgtaggcatgattgtatagatagaaaactaaagaaaagctactggaactaatgatcaaatctaaaccattttctggatttttatataccagcaaagaagaattggaaattgaattttaaatgtcatttataataggatcaaaaaagatgaaaaatttatggataaatttaacaaaatatatgcaagatctgtacattgaaaactaagaatgatactgagagaaattcaagaagacccaagaacgatatgccatacacatgggttggaagactaagtattaagtcagttcttcccaaactaatctgtagattcaactcgatacctcttaaaatctcaacaggctacaatttcttatagaacttgatgagctaattctaaagtttatatagaaatacaagggacctaggaacagcccaaagaattttgaaaaagaacaaaattggaagacttaccttgtcatacttcaagacttctgtaaagcagcaagtaagattgtgtgagattaaccaaataaaaaagagaattcagaaatagactcatgtgaagtatatggacatttcaggtttttacagatgcctgagtaattcgagggagaaaggacaatctttttacatcagtggtcttagagcttggatatccatatggaaaaaaaactgaatcttaacccttatcttattctctgtatatataaatattaactataaatggttcatcaacctaagcatagatctaagacaataaaatgtctcgaagaaaatacagtagatctttgtgaccttaggttacgtttcttaggatacaaaatatgtgaaccataaattgtactttatcaaaaattaaaagcattagctgtttgaaagcccctattaagaaggtgaaaggcaagttgcagactgggagaaatatttgcaaaacatttttttcttatttcttttttttttgtctttttctatttttattttttatgtttttgagatggagttttgctgtgctgcccaggctggagtgcagtggtgcgaccttggctcactgcaacctatgcctcccaggttcaagcgatccgcctgcctcagcctcctgagtagctgggattacaggcgcatgccaccatgccaggctaatttttatatttttagtagagacgagatttcgccatgttggccaggctggtctcaaactcctgacctcaggtggtccacctgccttggcctcccaaagtgatgggattacaggcgtgagccaccacacccagccagccactgtcccaggcctgtcttcttttaaaatttctttttcattcttttccccagaagctacaaaacatttgacaaagaacttgtatctaaaatatataaagaactgttacaactcaataaggacacgagcaatacaatttttttttttttttttgagatggagtcttattctgttgcccagactagagtgcagtggtgcgatcttggctcactgcaacctctgcctcccgggttccagtgattcttctgccttagcctcccgagtatctgggattacaggcatgcgccaccacacctagctagtttttttgtatttttagtagagatggagtttcaccgtgttggccaggctggtcttgaactcctgaccttaggtgatctgcctgccttggcctcccaaagtgccgggattacaggtgtgagccactgtgcccggcccacaatacagttttttaaatgaacaacagatgtgagcagatacttcatcaaagaaaatgaaaatgtatagcacttgaaaagatgtttaacatcattagtcattagtgaaatgcaaattaagatcaccgtgagacattactacctgtctgttagactagagaaattacaggtggctcacacttgtaatcccaacacttgagaaggctgagacggcgagatcaattgccctcaggtgttcgagaccagcctgggcaacatggcgaaagccctaggaaatctctacaaaaaatactaaacattagccaggtgtggtgatgtgtacctgtagtcccagctactccagaggctttggtgggaggttggcttgaacccaggagagagaggttgcagtgagccaagattgtgctaccataccccagcctgggtgacagagcgaggtcctttcttaaaaaaaaaaaaaaaaaaaaaaaaaaattctttaaaatattatgtcaggccaggcactttgggaggccgaggcgggcagattctgaggtcaggagatcaagacatcctggctaacatggtgaaatcccatttccactaaaaatacaaaaaaaatagctgggtgtggtggtgggcacctgtagtcccagctacttgggaggctgaggcaggagaatggcgtgaactcgggaggcagaggttgcagtgaggtgagatcgcaccactgcactccagccttggtgacagtgagactctgtctctataaaaaataaataagtaaataaataaaatttgccaggcgtggtggtgggcacctgtagtcccagctactcgggaggctgaggcaggagaatggcgtgaacctgggaggcggagcttgcaatgagccgagattgtgccactgcacttcagcctgggcgacagagtgagaccctatctcaaaaaaaaaaaaaaaaaaaaaaaaaggcaaaaaactacagtgacagaagcagatcaggattttccagggccagtgaggagtcagggaaagggtaattatattggggttgatgggatttgggggttgatggaagtattctgaatcttgattgtgttgatggttacatgctctatatatttgtcaaaactcattggaccgtatacttacatgagtgagttttgttgcatgtaaatcatactacaataggccgagcatggcagctcatgcctgtagtcccagcactttgggaggctgaggcaggcagatcacaaggtcaggagttcaagaccagcctgaccaacgtggtaaaaccccatctctactaaaaatgcaaaaattagccaggtgtggtggtgtgcacctgtagtcctagctacttgggaggctgaggcaggagaattgcttgaacctgggaggtggaggttgcagtgagccaagatcgcactactgcactgtagcctgggtgacagaaagggactctgtctcaaaaaaaaaaaaaaaaaaaaaaaatcatactacaataaaactgcttatttaggctgggtgtggtggctcatgcctgtaattccagcactttgagaggccaaggcgggaagatcacctgaggtcaggagttcaagaccagcctggccaaaatggcgaaaccctgtctgtactaaaaatataaaaattagctggttgtggtggcaggcacctgtaatcccagctacttaggaggccgaggcgggagaatagcttgaatccaggaggctgagattgcagtgagcctgggcaacagggtgagactctgtctcaaaaaaaaaaaagacaaaatagaaaaaccacataaatattcactttattgccaacaggaaaaccatcacttcctgccttattgtttaaaaacacaaattcacccatattcaatcacatgataaactggaggggctgcagtttgcatgtgactgagtgacttgccagtgtgattatgttgcagatgtcagaagacacatgtcaagggttagtcaccagacgttgccaagaaatatgaaaagagaatctgaatgcggtccgggcactaacacagcagtacgcttttattttgctggaagagcctgtggcacagcccatgcattgacatttgatcttgtttcagctaaactaaatgtgtctgttaagattttttttttttttaatttgaggtagatttaggtatgaggggaaaagttttcagcccttttcctggcatagaccttacaaaagaactactttctttagctgtgtttgttgaggccgttggtgagggtttgaaatctttttagttggcttgctgctaactggaaattgaggacggttgggggatgcctgactccacgttttaactaagctctctctgaaaagggatctccccagcaaaatctgtagtgcaatcaattaccaagggagcggctgaaagtgcttaatatgcttaagctggcttcagaatgcatgttctgtattacaaagaacctgggtggaaacaaaacaaattcatctatatgttttgtttgttttttgagctggagtctcgctttgttgcccaggctggagtgcagtggcacgatctcagctcactgcaagctctgcctcccgggttcacgccattctcccgcctcagccccccgagtacctgggactataggcacccaccactacaccctgctaattttgtttttgtatttttagtagagacaggatttcaccgtgttagccaggatggtctcgatctcctgaccttgtgatccacccgcctgggcctcccagagtgctgggattacaggtgtgagccactgtgcccagcccacctatatgatttttataaagggcatatctaaatcaaaataatccaggaagtgacgataaaataaaaaggtggaaaagtttatcttggacaaatgctgacaaaatgaaagtaccatagccatattagtgtgggataaaatagacttcatattgatgaaagatgtaatctcctaaaagaaataacagttatacctgctgggcacggtggctcatgcttataatcccagcactttggaaggccgaggcaggtggatcacgaggtcaggagttcgagaccagcctggccaacgtagtgaaaccccgtctctactaaaaatacaaaaaaattagccgggcgtggtggccggtgcctgtaatcccacctacttgggaggctgaggcgaggagaattgcttgaacctgggaggtggaggttgcagagttgagatcatgccactgcactctagcctgggcgacagtgtgagactccatctcaaaaaaaaaaaaaaaaaaacagttatgaatgcttgtgaacataactttaaaatatataaaggaaagctaaaggaaaagtctgatgtaacacaagtatatattgacaaaccacaatcttggtgggagatttgaatatatttctcatgagtcagcagatcaagtagatagaaaataagtatataaaagatttcaatgacataattagatacatgtaatagagattacatactcttcaaagcttgtaataagtcaactcacaaacactgattttaagtccttccacaaagaaaatctcaataaaatagggatataataagtcacttccctcctagggcgataatgtgtataaaagtgtttaaggtataaagccttagaaaacatttgttccttttaatgccctgatttgttttatcctaggaacggcagcagtaggacacacagacaagattgggagattgaaagaactctgtgagcagtatggcatatggcttcatgtggaggggtaagccggcggtgaggctggtggctccattcgggcctgcacagagtcctcatgaggactggacatccaggctctcactttggtgacatttatcacgaagggctcttcgggtcacagatcacaaaataacccaaattggcttaagcccaaagagatcttactggctcacataactacaaagagcagtgttatgactgcctcaggcacaacatcaaccaggatccagtgtgttactcccacctctgctcccccagtcacaggcactgggcttggtttcctctacctgtggacagatcttcctgttacagtgcaaagtagctgcagaaactccatccttctttccagcttcgtggtcagctggaagtcctaacagaagtctcatattgaaccagccactgtggccagggagaagtaatcctctgatagttcaggttctttgccctcctctggagcagatagtggtgtctcctccccacaaagctcatgttctgctggaagaaatggaggtggcgccccggaaggctattgtagggccattaagagaagcagggggaacggacgtgggcagccagagtagcccatatccaccacatcatacagggaggtttctttttgatccccaagtaaagaatgataaaactggaaaataagatccatgaaagagaataatactcccattatattaaatgagcggggatagttcctgagacacacttttattaaagtgcattttcaggattttccttcatatgtataaagcacaccttctgttgctgttatgaaagctaataacattaaaaatatacttaagtgtcaacttgcaacagcacagcctttatttttttaagtacatggtgagtaagcaacattaaataattagttcttagactggtgttttttcttccagtgtgaatctggcaacattggctctgggttatgtctcctcatcagtgctggtatgttgttgatttactgaatattggtgtttttaagaatgaatttaaaatcactcaatccctcctggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgaccctgccttggtaagtttcccctcactgcggagggagtgggtgtggctaatacacattattggctttgggggcaaaatccagaaaaatacaggaaaaagtgaaaaatacccataatttcacttctatttcatttttttaaagagaaacttgtaaggtgagactttttttaatgacattttatgattgtataatattctgtcacaatttaattattctccatttatgaacttataggatgttttcagtgttttgttactgaaataatgaagcagtgaacgtctttctgtgtttctaattatttccttagaataggttcccagatgtggaatgactgagtgggggagttttaagcctcctgatccacattgtccaataggttgtaactttttttttttttttttttttgatatggagtctcgctctgtcacccaggctggagtgcaatggtgagatgatcttggctcactgcaacctccacctcctgggttcaagtgattctcttgcctcagcctcccaagtagctgggattacaggcatgcgccaccacgcccggcttattttgtatttttagtagaggcagtgtttcaccacgttggtcatattgaactcctgatctcaggtgatctgcctgcctcggcctcccaaagtgctgggattacaggcatgagccatcgcacctggccacatttttttttttttttttaatcgtagttgtgggccaggcgtggtggctcatgcctgtaatcccagcactttggaaggttgaggcaggcagatcgcttgagcctaggagtttgagaccagcctgggcaacatggtgaaacctcgtctctataaaaaaaaacaacaacaaagaattggctaggcatggtggtgtgagcctgtagtctcagctactcatgaggctaatgtgggagggctgattgagccctggagatcaaggctgcattgagctatgatcacaccactgcactgcagcctgggtgacagaatgaaaacgaaacctgtcacacacaaaaaataataataatgtggttcttgataatataggtcagcgtgcaaaataaggtttaagtgatttctgctaaaacaatgctgtcttgctcagttaataatggccaggtgtttgaggatgctcagagctaccttcgaagtggggagtctcctaggttctgggatgtgacccatctgggttttccactggcttttcctggctttgccactcctgagctgtgaacccttggacaaaccgaggtctctgagtgaagttacctagaatacttagctcacagagttgttggaagatcacatggataatgcaagcctagtgactagtatggcatctagcccacactaagtgggtagcaaatggtagctggttagttctattatgagattgcaatggctttgattaataaacctcttttggcttttttagactttagttgctggtcttatatcaaataagcccacagacaaactccgtgccctgcctctgtggttatctttacaatacttgggacttgatgggtttgtggagaggatcaagcatgcctgtcaactggtgagtagaagcctgacatttaaatgaaagactccttggccacagcagagacagaaaaacatctcatttctgtaccttccatcaagagtgttgttgtctggattgactgtctcatgagccagagactaatcgccctgcatgtaaatatttcttgttcaaagttctgggagaaagtgctgggttgtctgtcccagcatttgtgtgcagatgaaatcagatgaaaaggaacaccactgtcagcatgggatcagaaaagaagtcacagatgacttccaaggagtggagaagtgtgcaaaagatggaggggtggggagcgagtgttccccttgattgactgactacggtgagggaacaggaaggtcacagggtggttatggagggcatggatattttaaaaaccagctggcttgggtttccaaattgcagggctcttggggacaattctaattctctctccattttaggtgtgttctaattgtgaaaaatatataattatgctatatttcagtgttttagagcattcagccttctataacaaaataccttagagtgggtaatttataaacaacagacatttattgcttacagttctggacgtgagaagtctcagatcaaggtgccaggagattccatgtctggtgagggcccgtcctcatagatagtaccttgcatgtggcctcacatggcagaaggggtgagcacagtcccttgagcctctttcagaaggtcactaatcctgtttgtgagggttccatcctcatgccctaatcacctcccaaaggcctcaactcatttgggattaggtttccacataggagttttgcggggacataaatattcagatcatagcatttagaaagcaaaaaaacaggctgggcacggtggctcacacttgtaattccagcactttgggaggctgaagcgggcggatgacgaggtcgtgagatcaagaccatcctggctaacacggtgaaaccccgtctctactaaaaatacaaaaaattagctgggcgtggtggcgggcgcctgtagtcccagctgctcaggaggctgaggccggagaatggtgcgaacccgggaggcagagcttgcagtgagccgagatcgcgccactgcactccagcctgggtgacagagcgaggctccgtctcaaaaaaaaaaaaaaaaaaaagccaaaaaacagggtcatgtttactcagggttagagctgagccctacctaagctcagaagcacgtcacctccattttcttacctgtgaaatataaattatatgacaaggattgccaggatggctcgaggaacgaatacaggtagagctcttgcagtagtgtctgttcatatagtaagttatgcacatgggttgaaatctttgttttaaatatattcttggggagttagcacttcctcaagtatcatttctatatttaagaaacataggtagccgggtgcaatggctcacgcctgtgatcccagcactttgggaagccgaggtgggcagatcatgaggtcaggagatcaagaccatcctggctaacacggtgaaaccctgtctctaataaaaatacaaaaattagccgggcatggtggcgggtgcctatagtcccagctacttgggaggctgaggcaggagaatggcgtgaacccagaaggcggagcttgcagtgagccgagattgcgccactgcactccagccagagcgaaactcagtcttttaaaaaaagaaagaaaaataggccgggcgtggtgtctcatgcctgtaatcccagcactttgggaggctgaggcgcgcggatcacctgaggtcaggagtttgagacctgcctggccaacatggtgagactccgtctctactaaatatacaaaaattagccaggtatggtggcaggcgcctgtagtcccagctactcaggaggctgaggcagggagaattgcttgaacttgggaggcggaggttgcagtaagccaagatcgtgccactgcactccagcctgggtgacaccatctaaaacacacacacacacacacaagaaaagtatttgcatagtgctctagcagtagtcccttcgttcatcatatgttaggatagttcaacagttttaagtatgctctgggctgggtgcagtggctcatgcctataatcccagcactttgggaggccaaggcaggtggatcacttaaaccccagagttcaacaccagcctgggcaatgtggtgaaaccctgtctctacaaaaaatacaaaaattagccaggtgtagtggcacacacctgtgatcccagctactcaggaggctgaggtgggaagatcacttgagcccaggaggtcaaggttgccgtgagcccaaatagcactactgcactactccactccagcctgggcgacagagtaggaccctgtctcaaaaaaaaaaaaaaaagtttgatgctcattatgtttacaaaagcactgcattttttgaaaagtgtctcactgtgctattagctcatttcttgagatgtggttcttaggaaagagaagccttagtaacttagtttagagatggcttgggcactcgggagattttttcaatttcctgtggctatggagtgcaggagaatgatgccattaactaccagacccttgaggtcagcacagctctggcatcttcctgcaggcagaaccgtatactcctgaggatttgaatgctgtcctactgctgactcaaaggctaatcaatgcatgtgttaaactgcatggacatttagcagacatggtgatctgtatatagccatgccttatagtccacagtggagcatacatttcctgagagcgtaaatcagcattcgcctcctcctcctcctcttccttctcttctccctctctcctttctcgtcttcagtagttattgagcattcacctcagtgtcaggcaccatgagtactttcatgcatcatctcatttgatccctgcaacttcactagaatgtcagttccactgatgacagtgtattcagaattaattttctttaaggaaaaaaaaaaggaatttcttgaggggctttctactgtccagtactcagtgaatatctgttgaattaatatactccaatcccatgagttagatatgattagtgatgagggacctgggattgagacattagtctaatgacactacattctagaccctgttgctaagcacttcttgtattgcatatcaactcatttactcctcacagcaatgtgagatacatactgtcctccctgttttataattgagggaactgaagcatagacaggttacatagctggtgactggcagatgaagtgacttatccgtggtcctgcaggtgatgagtggcagtactgtgctcttatcaccagctcttgagcgtgctgcatcctctcatttgtcgttggtctcccctagtgttcggtactgtgccttgcacgtgtttatactcagtagcttttgaatgaaagacagacttacattgcaaatacaacagatttccgtgtcttattagaaactgcttttcttgaattactacatgtaacttttaaatgaaagattggtgaatatttccagatgttgaaatacaaaaacaggtggctgaacttagaaaccaccaagtggcaggtgactttgcctgacatccgtgttcacagacctccacagcccctggtgaaaaccacttcttcatatcccatgtccgtctaattacatgtgttattttttgtcatttgcagagtcaatggttgcaggaaagtttgaagaaagtgaattacatcaaaatcttggtatggtatataatttcatctgttttcaaaatacaactttttttgaacttcagcaacttagaatgattttagaactttagaatgattttctccacatttcagtggaattgtggcagctccagtaaaaaacaaaacaaaaaacaaaaacaaaaaaaaactgcctgtatttatacagtgagcctgaagcgaagaaatttgaaccatacaatgtttaattcctatggtgcttttcatgtacttcatttattgggtttaagttcagaattgcacaaagataaacaccattgacttcagctgcccaaggccttgggcacactcctcttcccaaaatgaaaactcactttgtgcctcagaatgctttgggcttctctttctgcaaccttctgccatcagttttcatttgcgtgaagtgggagaaagagaaaagcaaatggctctgctcttgtcttctcctgatatcttcctgaagtgaatccaacagattgttccctaggcataactagacaaggaaataaggacttaggagagaatgaggatcagttcaggtttgaaagtttttgtgttttgcttcattgtattttagaacctcaggaaatatacgtcaaattctgatttaaataggttcactgagtgtttctttgacaattctgcaaggtatgcttaagtttaaaactaacatttgagtgtatttggggttcaagtcagtaggtttatttttcttttagaacatggtttggtttaaatacaaaaagtagccgcgcgtggtggcacatgcctgtagtcccagctactggggcggctgaggtgaaagaattgcttgaacccgggaggcggaggttgcagtgagccgagattgcgccactgcactccagcctgggtgacagagaccctgtctcaaggaagaaaaaaaaatacatggtttggttgaagggggtgtggctactctgccttctaagtgggagtctggagccagttgacccgagttctagctcagtgggggttctatccttggatgaggaagtggaccactggagaagcggaagggatgaatctaagttcagaggcctgggctctgctctgagcagtgccacagggtggccctgtgacattgagtcattttctttccaagcctgactgtcaaatgaaagtatgctggttggtctcctctgattgcaaacagagaagcaaattatggcctagattgagcaagctgttaagaatccaggcggtgctgggcccgtctgctttcctgcccctgccatgttgagcgcacttggcttttcctcagtcattgctgctcccttattctcaaattgggggacccagtggtgctagttaatcaccagttgttttggagcatctctgtaggccacactggcccaggcagaaagcctgctctgtcccttcttccaatggctgttttttcagtagaggatacaataattggctaacaccatgaggcattatggcctgtgagtcctcatcatcaccatcaccatcaccatcaccaccatcccagctgctgcttgtgaaattcatgtgtggtactaagtaccttacatgaattatttcatttaaccctcccaacagtctcctttgtacgtgctgttctctctgcctggaaacactgtttcccacccccaacccccaattcttctgtttattttttttgagacagagtctcactgtgtagcccagactggagtgcagtggtgcgatctcggttcactctaatctccgcctcctgggtccctgttcaagcagttctcctgcctcagcctcctgagtagctgggattacaggcacatgccaccatgtccagctaatttctgtatttttagtagagatggggtttcgccatgttggccaggctggtcttgaactcttgacctcgtggtccacccgcctcagcctcccaaagtgctgggattacaggcgtgagccaaagcgcccagcctccccagtcccaattcttctcatgactggtttcttatctttcagatcttaattcaaatctcacttcttcagaaaggcctttcctggccaccctaagatcatctcccaccgtcagacatcactccatccccctgggtcgtcttcatcactcttactactatccgaaatcaaatctgtttgttttttcctatagaagctttgtaaaggccttatacagactcaccactgggcattaacacccaagaccctagccctgaaagcccagtgccaggccccagacatgctcccatcccctgccattcagcttacagtcgtctttctgtttcctcttctttgtggattcacctttttttgggtgtgagcccagccatggtttaacctttttttggttcttggttatatttaatccagtatttcagatattcagaattgacaacttcagtgttcactcagtctatcacgttactagaaccagaagtgtctctaaccctgtatactatttcttacacactttgacatttgagaccactgagttcaaagaaagaaaagatgatgataatattcatagcagtcttggcactcacctcattctgccatctcctagctgaggatgggagagtgggcggattattttgttgcctttttgttcctccttgcttattgggcgtgctcccctatttaaatattaagcatcgcccccctgccgcccgccgccatacctttaaaagtatcacgttttatttgtctctgtgaaagttaaagatgatagatgtgaaggcacttagcacaggactggccccgtgaataattggcagatttgaattcacatcctgcttggtatgaatactgtccacacagtcctttgaaaagttagtagaaaagatcttgggccactgcttcttgtctttccaagttagcatttcctgttgcggccctaccagtgagtcatcacactcagagccttggaacataagttttattactagagctatagtactgggattgttagatgcttagagatcttccccaccagggccgcccacacgcccctacagtaccacagagcctgccaaggacatggatgcttacggtaccctgaccccatggcttgaccaagtcagggtatactatttgatgcaaaacaggaatttgctgctggattatcgtaatacataacgcagtggatattttcaactgttaggaaacccactaatgaagttagtcgtcttcggcctgtctttaataataattaaatatattagaaaatacacagatccagttctcagctgtgcttgtctacatcaccagcaggacttgcatcttgttccgaaggttttgcaaaggggaagaaagtagttgttcccccctcttttttcctatgagtatgaaaaattctagttggccaggcacggtgtatcacgtctgtaatcccaacacttggaaagccaaagtaggaggattaattgaggccaagagttcaaggccagcctggacaacataccaagaccccatctctaaaaaaaaacagtttaagtttcaataaatcctgcataatttctgggattcttgaaagcatgggctctctccgcactgagtctagtttcactgcttcttactggttttaatctttaatgttagacctatgtttatcccttattaaaatttccccctgctttaatttcaatgtaccagtgtcaaacatcttataattcacagtgtactctcaaggctggctcatagttattttttaaaattttactaaacatttgatttttctctagcaactgaaattaatctctgaactttttagtgtgtttatttacaaatagagcatctctaagcgagtttttgaactcagcatttcattttgaaggcgtctggagtttaatgttacttggtgatatgagacttccattcttccaggtggaagatgagctcagctccccagtggtggtgttcagatttttccaagaattaccaggctcaggtgggtgaattttaaaagagggttattttcatatctgtgttaaaggctttgaatttgataccatttcaatttaaatatttcaaaatatttttattgctgacaatcttcagtcagcatttcagaaaaatgtaataattttcatgaaaacttcagtccgaaatgccttagcaatttgctgatagtttgcggtgattaaaccaggggttcccaaatgccagtccctggaccagtgctggaatggctaagaaagagttgcttgaacataaagatttgtgggtcttacttcccacatattttgagtcaataggttgtgcccaggaatctgtatctttaaagaatgacccaagtgccaccagtctagtccagggcactactttttttacctggatggccattgtcccctctcaactgacctctgactttcatacattctacacagcccattccagaccattctccacctggcagagtgagggttataagtggaagtcacatggtgttgaaactggaaaggttcccttgtccccctcgcagggcatgtgatgggggtgtggctcgcttcttcagtgccccgctgctgctcaaacctctaggagagcatacagacgggcagactgtggggctccgaccccatggcagcatctaggggtgaatgttttacagctcctaaggctccagcgggcatgtgttacagtgtgctcttttaatttagccgtctgtaggcagcttgttttagctcacttagacccccttccttatcacaaggacagagggattaatgtatcccaggttcttgtcttggtgtaccggaagaatgggatcacatgtgggcttggagaatgagtgcaaggttttattgaatgaaagtagttctcccctgatgggggagccagaagggagatagatttcccttggagttgggccgctcagcggccctggccaaactccgcctcgtcccggtggttgatggcctgctggcttgccggtgcctgtcgggatgctcttctgccggcctgctctccatgaccagccgcttgtgtctttttccaccaatgtgttcctcttgccatccagccacttctgtctgcccactagggtctcaggtttttataggcccaggatgctggtgtggtgggccagcgtggtcttgggaaatgcaacatttgggggaaggcaggagtgcttgtcctcacctaggtccgtgggggtagagtcctagccagggacccgcctttctctccccagcacttcccttccctgcttctgtgtcatttaaagggaccacgctcttcccttcccagcactcctgtatcagtgtcacttccctgcccagagcccctgggtatcttaccatttcggtcgaacaaaggccaggctctcccatgccccatgaggcctgcgcactctgccccgaattcacctctgccttcccctcttccactctccctcttgttcgttgtgcctcagtcagaccagtcttctccgcgctgcagaacactctgccctttcctaccgcaagggcttaacactcggcgttccctctgtcttacacacatttctctcttctggtgccagctcctcctcaccatttcggtctccactaagtatccacatcctcagccttccctgcctatcctgcctgaggggactccatcattttctatcagagcccccagcttcacttgtgacactaacaaccacatggagtgattttctttctttatggtctgtttcctcaactaaaatgtaagctccaagatgacagaaaccttacctgccttctgtcccaagtgtcaggctctgtgcctggcatgggtgggcacccactgtgaggcctagttggatgatcgtggcactcacagacctcgcacggtgcttggtaaactagttagtaacttacaacaattgctgtttcctcttgaaatcccttgaaagcaaaccttttcaaaaatgaaattaataattctgtcttatgtgaatgtattcaagtgttacatagatcacgaggagaaagaaatgtagcccttctgtcagataatacatgagaattcagtaatacgagtcagtgccctggggctaatattgggatgggaatgatgtggggtttggagggtgttttttttttggtcagccgtgtttctgggagtgactccctttctgtgttttggtgtcagatccagtgtttaaagccgtcccagtgcccaacatgacaccttcagcagtcggccgggagaggcactcgtgtgatgcgctgaatctctgggtgagaatggcagtcgcccgcctttcctttcaggtccccgtccatcaccatccgacctgctggtgagggtgacgcctgcttgtgtatgggaactgaggcccacaggaggagccgccctgccagtgctgggcctgctctggagttctgttccccgttgcgttaccacctcacgagctgggtcacctctggcaagtccttccagcattgctccctcactttccttgctgctgtataaggctgtgagacaacaggcaaaaggtgggctgcagggcagctgcagtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggacggcggcagcagcggttctagccaatgctggacacgcccagcctagcagggttggcggataagtcctagtacatccgtgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcctgccactaggagaaaagacgctgggggcagaccacatgtcagcagtgggtgtcgcttagtaatgtattgtgggtcattgttattttcttctttttgtttacttgtatttcctaaatttttctacaatgaacttgtattaataagaaaaaaccataaaatttactgtttttaaaaagctgctctaagtaatcagacagtcaaaagagcatgaaccagctctccaggaggctctttggtctggggccgaggggatgaggatgggtcctgaagacgtctgagtcccttgttacaggagggtgttcattgtgtcctcctcacagctgggagaacagctgaagcagctggtgcctgcgagcggcctcacagtcatggatctggaagctgagggcacgtgtttgcggttcagccctttgatgaccgcagcaggtaaccaggctcggtggacatcccttgcttttgttctggggctgctgggtagattagcttgcccttatgatactccattctcctagagttattagcagctctttttggaggggcattttcttttcttttgggctaaatttaggtagattagcattcccatgtaacttaccagaatcagaatgagaattcagaagtcacctgaattggccgggcatggtggctcacacctgtaatcccagcactttgggaggccaaggcaggcagatcatctgaggtcaggagttcgagaccagcctggccaacatagtgaaaccccgcccctactaaaaatacaaaaaattagccgggcatggtggtacacacctgcagtcccagctacttgggaggctgaggcaggagaatcacttgaacctgggaggccgaggttgcagtgagctgagattacaccactgcactccagccttggggacagaggagactccatctcaaaaaaaaaaaaaaaaaaaaaaaagtcatcacctgaattccttttttgttgttgttgagacagggtcttgctctgtcacccaggctggagtgcagtggtgcgatcatggctcactgcagccttgacctcctgggctcaagtgatcttcccacctcagcccccgaggagttgggaccacaggcatgagccaccacactggattaatttttgcattttttgtagaaatggggttttgccacgttggccaggctggaattcctatattttgatgtcttgtgactctcggttttccactacaagggttctcactccccactgcacattagagtcatccgggagctttacacacaaccagtggccgcccagaggcgggcggatcaagaggtcaggagatccagaccatcctggctaacacggtgaaatcccgtctctactgaaaatacaaaaaattagccgggcgtggtggcgggcacctgtagtcccagctactcaggaggctgaggcaggagagtggcctgaacccaggaggtggagcttgaagtgagccaagatcgccccactgcactccaccctggctgacagagggagactctttctcaaaaaaagaaaagaaaagaaaagaaatgctaagcaaagtgttccggtgtgttttgcctgttttggtagtggaagggaagaaaatcagtctttttctttcttctcccccttaaaactatttaagaagggaactgggcacggtggctcatgcctgtaatcccaacactttgggaggtcaaggcgggaggatcacttaggtccaggaattcaagaccagcctgggccacatagtaagacctcatctctaccaaaaaataaaacattagggctgggtgcggtggcttacacctgtaatcccagcactgtggcaggctgagggagctggatcacctgaggtcaggagtttaagaccagtctggccaacatggcaaaaccctgtctctactaaatatacaaaaattagccgggcatggtggtacgcacctgtaatcccagctactccggaggctgaggcaggagaattgcttgaaccgggtaggtagaggttgcagtgagccaaaatggtgccactgcactccagcttgggggacagagcgagactctgtctcaaaataaataaatattatttttaaaaaaagatcccctgggcatgcaataagtaataccatactacttaggcaaataaagcacaattctatcatttgggaatcttaagatcggttctaccactttgtggatcttcagactcaatctctattttagagatactaacattgattgatcctactatgtgccaggcactgtctttcacaacttcacatatatgatctcattcaatcctcatttaattttggcagagaaaagttgagctccttacccaggatcgtatagctaggaaataaagaccaaagcacatgcctcactcttcttgttattagaaaagatttccttctgtaaacctcagggactttacaagggaaatattggattactgtaatatgactcatcagcccaatttatttatttatttatttttattacactttaagttctagggtacatgtgcacaacgtgcaggtttgttacatatgtatacatgtgccacgttggtgtgctgcacccattaactcgtcatttacatcaggtatatctcctaatgctatccctccccgcttcccccaccccatgacaggccccagtgtgtgatgttccccgccctgtgtccaagtgttctcattgttcaattcccacctatgagtgagaacatgcggtgtttgattttctgtcctggcgatagtttgctcagaatgatggtttccagcttcatctatgttcctacaaaggacatgaactcatccgtttttatggctgcatagtattccatggtgtataattgccacgttttcttaacccagtctatcattgatggacatttgggttggttccaagtctttgctattgtgaatagtgccgcaataaacatatgtgtgcatgtgtctttatagcggcatgatttctaatcctttgggcatatacccagcaataggatggctgggtcaaatggtatttctagttctagatccttgaggaatcgccatactgacttccacaatggttgaactagtttacagtcccaccaacagtgtaaaagtgttcctatttctccacatcctctccagcacctgttgtttcctgactttttaatgattgccattctaactggcatgagatggtatctcattgtggttttgatttgcatttctctgatggccagtgatgatgagcatttttttcatgtgtctgttggctgcataaatgtcttcttttgagaagtgtctgttcatatcctttgcccactttttgatggggtggtttgatttttttcttgtaaatttgtttaagttatttgtagattctggatattagccctttgtcagatgggtagattataaaagttttctcccattctgtatgttgcctgttcactctgatggtagtttcttttgctatgcagaagctctttagtttaatcagatcccatttgtcagtttgggcttttgttgccattgcttttggtgttttagacatgaagtccttgcccatgcctatgtcctgagtggtattgcctaggttttcttgtagggtttttatggttttaggtctaacgtttaagtctttaatccatcttgaattgatttttgtataaggtgtaaggaagggatccagtttcagctttctacatatggctagccagttttcccagcaccatttattaaataggaaatcctttccccatttcttgtttttgtcaggttcgtcaaagatcagatagttgtagatgtgtggtattatttctgagggctctgttctgttccattggtctatatgtctgttttggtaccagtaccatgctgttttggttactgtagccttgtagtatagtttgaagtcaggtagcatgatgcctccagctttgttctttgggcttaggattgtcttggcaatgcgggctcttttttggttgcatatgaacattaaagtagtcttttgcaactcttatcagcccagtttaatattacctattcattataatgtaatgctgctcgcacaactgagaaaacactgttgctttaccccctccagctctgtagcagccacgcacaaatcatagaactataaacatatgctaattacacaatgtatgtgggcaatcaatattaagaaaaatttttactgcccaatatttctgtggttgaaaatgtagagtctaattctgatccgcagtaacatctaggttaatgttgattcagaaggaaaacgtttgttgttgccatgagaagaggcactgaaacgctgaatcaccaccacaaatgttatcactattaatataaggagatacatagcaagatcgagttagaccatctcggaccaccaggtttacaattccacctgcagatacatgcaagaagtattgtcacaatacttatgtcacgttattccattgaggtcatcaccaactaagcttatcattaatgtgtggtcaatttggtcaatgtcaccagcgtagcatactgacaaaaacaagggttgcaaactcagatgcctataaggcagaatgtaagacggtaggaagcaaagtctatagggaactatataatagaggctgcagattaatggcagattctaaagcacagcagtcccccacatttttggcaccagggaccggctttgcggaagacagtttttccacaggcggcaagggatggggcgcaggatggtaatggtcttgggatgaaactgttccaccacaaatcatcaggaattagattctcataaggaatatgcaacctggatccctcgtgtgtgcagttcacaacagggttcatgctcctgtaagaatctaatgatgctgctgatctgacaggaggcagagctcaggcagcaatgcaagcaatggggagcagccagaaatacagacgaagcttcaattgttacccaccattcacctcctgctctgtggcccagttcctaacaggccacagaccagtacaggtccatggcccagggattagggacccctgctgtggcacattgcttaatagaggactgtagcagccctgacctttcctttttttttttttttttttttgagatgccagaaacccagaatttttttttttttttttaagacaaggtctggctctgttgcccaggttggagtgtaggagtgcgatctcagctcactgtaacctcaacctcccaggctcaagcaatcctctcacttcagcctcccaagttgctgagattacaggcacactccactacacccagctaatttttttgtattatttgtagacatgcggtttcgccatgttgcccagactagtctggaattcctgagctcaagctgtctgcccatctcagcctcccaaagtgctgggattgcaggagtgcaccaccacacctggcctgaaacccagattttatttatttatttattcattttttgagatggagtcttgctctattgcctaagcttgagtgcagtggcgcgatcttggctcactgcaacctccacctccctggttcaagcaattctcctgcctcagcctcccgagtagctgggattagaggcacatgccaccatgcctggttaatttttgtatttttagtagagacagagtttcatcatgttggccaggctggtctcgaactcctgacctcaggtgatccacccaccttagcctcccaaagtgctgggattacagaagtgcaacaccacacccagcctgaaacccagatttttaatatgaaatcaaagtcttcaaaccttgtaggtgtcataaaaagcacgctgaggaccactagtttgcaactgccaatctaaaatatcatagacattgtatcactttaaccacgaaaaaaaagtatgtgaggcagaaaatggaagcaaccatgcctaatttattgttgaatacttcttccatataccaagaacttcctttgcactagcatctgaaactatattcagaatgacattggttttcataaaagtgttgatcctcacacctctttatagtcttgcacctagcacagcagagtgaaacactttaaatagcacttgttccttgagtatatatggaagaaagtgaagtattggtaagtgttcagctgatatgagcagcatctcaggagtctgcaattcttgaattaccagggagtatttttaccattttcccccagtgaaaggcctattttgagagacttaccctccaaaatgaatgtattaagtcatattacttttttttgttttgagacagggccttgctctgttgcccaggctggagtgcagtggcatgatagttacaggaaaggggtcccaatccagaccccaagagagggttcttggatcttgtgcaagaaagaattcagggtgatcccgcagtgtgaagtgaaagcaagtttattaaaaaagtaaaggaggaggggcacggtggcttacacctgtaatcccagcactttgggaggctgagacaggtggatcaggaggtcaggagatcaagaccatcctggttaacacggtgaaaccccgtgtctactaaaaatacaaaaagattagccaggtgtggtggcgggcacctgtagtcccagctactctggaggctgaggcaggagaatggtgtgaacccgggaggtgaagcttgcagtaagccgagatcacgccactgcattccagcctgggtgacagagggagactccatctcaaaaaaaaaaaaagaaaaagtaaaggaataaaagaatggttactccacagacagagcagccaggagggctgctggttgcccatttttatggttatttcttgatgatatgctaaacaaggggtggatttttcatgcctcctctttttagaccatatagggtaacttgttgatgttgccatggcatttgtaaactgtcatggtgctggtaggagtgtagcagtgaggatgacgggaggtcactcttgtcactattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccagctcctatttaagatggagttgctctggttcacatgcctctgacatgatcactgctcactgcggcctccacctcctgggttcaagagatcctcctgcctcaccctcccaaggtgctgggactacaggtgtgtgccaccacgctcagctaatttttgtattttttgtagagatggtgtttttccatgttgcccaggctgatctcaaactcctgggctcaagcaatgcttctgtctcagcctcccaaagtactgggattacaggcatgtcccaccatgcccagactaatatttacttttaatcagagtaagatatggttactacttgagttactatggctccagctgaaagcctatgcagtcatatcatgggtaaacatttgctttatgctaaaaatatggtggacctggcattacagctattacaaatctcctaaggtgtctcgggtagtatattagttacttttcatactgctatgaagaaatacttgagactgggtaatttataaagaaaaagaggtttaatgtactcacagttccacaaggctggggaggcctcagaatcatggtggaaggcaaagaaggagcaaaggtacgtcttacatggcagcaggcaagagagcacgtgcagggaaactgccctttattaaaccaccagatttagtgaaatgtattcactatcatgagaacagtatgggaaaaacctgcccccatgattcgattacctcctaccgggtccctcccacgacacatggggatgatgggagctacaattcaagatgaaatttgggtgggggcgcagccaaaccatatcaggtagcaactacctagggttggttttgcaggtggtaaagccatttaccaagatagttgtaggtaaagaagggcagatttattagagaaattatgaaaatatgttgcaatgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattctcctcaacttggggctctccccaacctggggacccttccttattgttgcttacttagcaggactccacataagggtgtggaaacttcattcactcatatcttcaacacaaattgtaggtagcctgttttttaaaaaatttattcaacaaatatttagtccaagccactattacttattaccttctcaacttctgtatggacctttaactatctctgacactattcactattcttccacattctctattatttatacctatggtaaaatttgccagtttgaccatgcaactaatactgacggggaatatatagagtctagaagaaaatagaccggtccttaaaggctgccctgccaacaaaaccgtaatgcagcaacaaacatcacaactatgccaaataatcaatcctacaatgtccaaaattttactttaaaactggaatttccagacttcctttccgcattaaccagtttaactagacagtaatgaaatatccctcctactttatgctgtgatagtttatgtatttatttatttatttatttatttgagacagagtttcgctcttgttgcccaggctggagtgcaatggcgcgatctcagctcaccacaacctccacctcccaggttcaagcgattctcctgcctcagcctcccgagtagctgggattacaggcacgtaccaccacgcccagctaattttgtatttttagtagagatgggggtttctccatgttggtcaggctggtctagaactcctgacctcaggtgataccccctgactcagcctccgaatgtgctgggattacaggcatgagccaccgtgcctggccagaaaattttaaacacacacaaactctcgagtggcctaattccctctcaccaaaccagtcacaatacagacaaaagagaataacttatattagtttttgtacaaacaaaaaagactgataaattgtgaatgatgcatgatttttaattacaagtaaactgggcaaatgcttctgcattatttaaagctaaaaggtgatcagtggaaactttcctctgttaggactctaatactttttaatcggctcactacaacgtatgcctcccaggttcaagcgattctcctgtctcagccacctgagtagccgagaccacaggcaacgcactaccgtgtccggctaattttgtatttttaatagagacacggtttcaccgtgttggccatgctggtcttaaactcctgacctcaaccaatcctcctgccttggcctcccaaagttctgggattacaagcgtgagccaccacgcccagccttattataattgttactatttaaatctctttttctctctccttcaagagaaacctcatctcattcagtggcatccatttatttactcatcttctgcctcttgggctcgagagatcctcctgcatgagtctcccaagtagctgggactacaggctcacaccaccatgcttggctaattttcgtaggttttggagagacaggctcttgccatgttgcctaggctggtctcaaactcctgggctcagatgatccacctgccttcgcctcccaaagcactgggattatagacatgagccaccacgcccagccccaagtacttttacacaaaatgcaaacactatttttctatcataaaagtgataccacagcttctgtaaagttttgccaggtagtattcataattaccttgggtaaactttttgatgttaaaatgtatcttcttattacgagtttttccattgtattaactgcttttacaacaacacaaataacaagttattttacaaaccatttagaaatttctgtactatggtcccaataatgtaaaatatattaatgcctattacattcagataaattatacacttggaaaccacatacttatgacttacagaaacttacataaacaaattgtagaaattatatgctcaatttttaggtatatagtcttaagctcaaatatacattctcaagataaattaacagttcagggcttcacaacttgaaatctgtggaagatgacattggagacaacagaactctggtggaattcttagatggaatttgctgaaactttttttttttttatctttttgagacggagtgtcgctctgttgcccaggctggagtgcagtggcacaatctcagctcactgcaagctccacttcctgggttcacgccattcttctgcctcagcctcccgagtagctggaactacaggcgcccaccaccacgcctggctaattttttgtatttttagtagagatggggttttaccatgttagccaggatggtctcgatctcctgaccttgtgatccgcccgccttggcctcccaaagtgaaacttttctttaaaatagagatgggatcttgctgtactgcccaggctggtctcaaactccttgccttaagcaatcctcccacctcagcctcccaaagtgctgggattacaagcgtgaaccattacacccaagtgaaacttcttgagatagttacataatttttaaatctgctggtgtagaagttaataaagtgtagaactgaataaatattaaatattagatcaagtttctcatgttcaccttaaagtataaagatttatcttaaagcactgattttcacaaaataacatcagtgtgaaattggaaaagaagccaaatattttatttcatgtatctgggaaatgaggtgctttagtcaactgaatctgcccaaaactaaaaagcattaattaaaaagtacttaactcagaaatcataaaaataggagacatcaataaaatacattctacacagaatacgccaatcatacactactcttttttgataataaaaaacgtacttactgagccagttgtggtggctcacgcctataatcccagcaccttggaaggccaatgagagtggatcagttgaggccaggatatgacaccagcctggccaacatgatgaaacgccgtctctactaaaaatacaaaaatgagccgggcacggtgggactcacctgtaatcccaggtactccgaaggatgaggcaggataattgtttgaactcaggaggtggaggttgcagtgagccgaaatcatgccactgcactccagtctgggtgacagagtgagtctctgtctcaaaaaaaaaaaaaaaaaaaaaaaagtcagttgcagtggctcacacctatgatcccagcactttgagaggccgaggcaggcggattacaaggtcagtagatcgagaccatcctggccaacatggtgaaacctcctatctactgaaaatgcaaaaattaagccgggcgcggtggctcacatctgtaatcccagcactttgggaggctgaggcgggcagatcacgaggtcaggagattgagaccatcctggctaacacagtgaaaccccgtctctactaaaaatacaaaaacttagctgggcgtggtggcaggcgcctatagtcccagctacttgggaggctgaggcaggagaatggcgtgaacccaggaggcagagcttgcagagagccaagatcccaccactgcactccagcttaggcgacagagccagactgtgtctcaaaaacaggaaagaaaacaaaagaaaatttggactattgccaattacaaatagttttagagaagaaatcaaaacagtaactgtggatgatggaaacaatagttatgataaaagtctgatgaaacttcccagttcacaaggaaatttaattacttatctgcagcattttaagacagtaatcagaatcataactgacagcatcacatcaggaccatcagacttttataaatttcatataatcttcagaaataataacttttttttttagatagattctacctctgtcacccaggtgggagtgcagtggcatgatctcgactcactgcatcctccacctcctgtgttcaagcaattctcctgtctcagcctcccgagtagctgagactacaggcgtgtgccaccaggcatggcgaatttttgtatttttagtggagacagggtttcaccctattagtcaggctggtctcgaactcccaacctcaggtgatccacctgcctttgtctcccaaagtgctgggattacaggcatgagtgacggtgcccagccattcataacatgtttatacaaatataactttaacaaatatttagcataactatcaaaattacaaatcataacatattaaatttgtataaatgtatgtgatttttggaacgtgtatatcaacaacatacccataaatataactgagatgagatctaatgtcacctcacttgacagtgccctcccatgcagtatcaccacatttgacaatgcccgcccataaaatctaccaaataaatcgaatcacttaataccgctacaagatgagagatacattctttagactccccaagggacgcagctgaaaaatcccaaagttaattttaagccaaaaagacctgatttaggattttgacactggagaaacccatcaaagatgtcaagtttgaaaacacttgatcaaaacagaatcacaggtcactattaaaagggtattcatttaaccagagacttccaaagcaatacagaaacttacatggatataaaaaccttaacccttttaaaggtcagatttgctaagtgatcaaaaggggtacttgaattgagtcgacacaggaagagtgtgtacagggttatgagtgtaggcaaatggttactttggtcatatctccatttgccacctgattacacatgagaatggcatctttactcatcagaaagccagtattatgggaggtgtaggaggcattcttggacttgagacgagaacattgttgtgtagaaatttcattgactgtgttaaaattattctccatgggctggagaacacataacttggtgtttagaatgagacgggcatggattggatgcaaggtctccacacttactagctgtgtgacattggacagagtgcttcatcattctgagactcagtttttaaaggaaaaacaactaactaccttgcaagcttgctagcaggtttaagtgtaataatgtgtgggaatgactgcaccgtgactaacacgtagtgacagcttaattaatgttaacccttatcattatcatataagaaagtgagttacataagagaggaatcctgtcagttcgttctctgctgtgtccccaagaccatgaatcatggctggcacgtagtaggcatttaataatatttgttcaacaagtatttggcagtcttggagggcagaaaaggaggtggggaagatttttaaataacattttttaaaaagtcacattgtcctacaataccgatttttcttgcatatttaggaaattgagggttttttcctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagccttggacttttagcatagtgtgtcaggtcttcatagtttgggcccggggcacagagaagtcacagctctccagcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgtgaggaggaaaatacaaaagtccttaggtgaacactgagaaggcagatgcagcagaaacctccaggccggaactacccagtcttggacctatggtggagatagagcatagctggcgatcatgtgtacttacactctaaggtcacctggttgcactgtggcctcatctgtggctctgaaaatgaagatttggaaggagatcatcacagctaatgttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccacggacaaggccttgtgtgattaaatagggttataattaataatataaaagtgagaaatcactaatgctttttagacttaacattttctttttttgtaggtttcaggcacagaactgtatatccaataatagtgaaatggatgccactaattatgacagaaatgatgatacatttaaatgacttggatgttttgtaggtatgatctcgtgaaaccttgagagaaactgaatgaggaatgaaactattgttcctgtttcacacagaagaaaactgaggtgaaaaggggtaaagtaattttgcatggcatgaagtagaaattcaaagtacaggaatttgaacttggttctgtccttttctgaagcccttgaccactatagactcaaacatcaccttgtttttccactcattcaacactttttttttttaattgtctaataggttggcactcatgatgagcccctgttctcattctgcaaatggtgaagctctctatcgtcctgaccccacagttcctgtcccatgaccagggcccgctcaccaaggagctgcagcagcacgtaaagtcagtgacatgcccatgcgagtacctgaggaaggtgagtgagtgcagacagatggggcctggtgcccttgagcagttcccaggtctcagctgccacacatctcacagcgggtgatgctgggggaagcttacgcagtcacagtactggattcttcctctttttctttccatacaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggttatttattatcttgccaagtttaggctgggcatggtgactcatgcctgtaatcccagcattttgggaggctgaggctggtggatcacctgaggccaggacttcgagaccagcctgaccaatatggcaaaacctcgtccctactaaaaatacaaaaattagccgggcatggtggtgtgagcctgtagtcccagctactcaggaggctgagacaggagaattgcttagattcaggaggtggaggttttagtgggccgagatcacgccattgcactccacactgtgcgacagagcgagactctgtcaaaaaaaaaaaaaaaaaaattatcctgcaaaatttgaaaaggaaattcaaatcaacagcttctaaactactttttaacatgacttataataagaaatacattctatagtacgtatatatgttctataattttgaataaaagaattaaccacatcacatttattttacaacatgtaatacatattttttattctccttcatttgttttgaatgctctgtgcagtctacaaaaagtccaatagtaataattaaattagtcattaagttgaacattatcttgtcttttaaaatgataatctcaaaaatgatcttttatttttgagatgtatatagatacacacacacacacacacacacacacacacacacacacacattttgagacagagtttcactctgtcgcccaggctggagtgcaatggcacaatcttggctcactgcaacctccgtctcccgggttcaagcgattcctctgcctcagcctctgagtagctgggactacaggtgtgcgccatcatgcccagctaacttttgtattcttagtagagatggggtttcaccatattggccaggctcgtgtcaactcctgacctcgtgatctgcccactgcggcctcccaaagtgctgggactataggtgtgagccactgcacccggtccaagataaaattattttaacaatatactatgaagggaaaaacactggctatgaaagaatatgcatagttttaccctgtttaaaaataaagattgaaagaatacatatgcaaataagtttacttttatttttggtaatactttactgcattgtctgaatattgacaatcagtatgcattatgaagctacatggctaacattgtgtactcactgtgtgtgccaggccctgggttcaatgctctatatgcacttatatttcatttaattctctctgcaacctgagatggtatagccacctcattttacagagttgaaactgaggctcagagactgaaagttaagcctgaggttgcagtcaataagaggcagagctggaactgaaacctacgtgtgtctgaccaccagttcatgttctgacggcaggctagtctgcatcacagagtgtggggtagatggtgcatgcctgctaggatgggctaggtatcactgtaggtaagaaacagcctcaaacgatggaaatgtacaccactgaaggctcttttcctgcccatgctgcacatcctccatggctctcctgtgccctgtgccccacatgccctcatcctgccacgagaataaaggagcagcctccatatgggagctgtcagctgctctaaaagatgaaggagagggtggccagtctcaatggctcccaactcttttgcctcgaggtgacacgcttcacttccactcacatctcctgggtcaaagcaaatcccatgggtacatccactttcaagtggcccaggagagaacctgaaatactcggtggactccattaaggccgtcagatggtgtcagcctgcatgggagactgtggaggggcagaggaggagagtggggaactgatgggaaatgacaggaggactaagtcaccgcagatttgctttatcctcagccaggtggagtttgtcccagagctgcacaaaatcatcaccagcatgatgaaacagagtagacttcagaaaaagcagtttggtcagatgtaatcagcagtgaactcagaatcaactgagtgacattgagtcagtaaatctctgactgcctcagttaccctatatgatagttttgaggatgggaacattgagagagttgatttggaaggatatcaagagtacaaattccaacagtttagttcctttaagtgaagtccaggcactgtctttcctgcaagtctcctgttcctttcagattgcacaggtgagagtgctcagattagggctggaggttgtaaactattgctcccacactgacagtgcccctgtgtcgtgcatgtattctgtgcattttcctgtgctaaacactctcccaaaacatcgtggggcctgattcttcctctttgttccaatggccctgggtgactcaagtgcccattcaatgaccaggacacagaggtcttagagagatgctccatgaggccccaggtgcgagcctgtaccctgccggagcatgaggcaagggacagggcatcgtctgtggggatagtgggggtagtgggggtagtggtcagccagacttggtgactctacttgctcaccagacgatcctacacctgccacctccgatggatccactgcctctgtgcctgcctgtactgccgatgctccagtggataactcagcatcccagccaaggcccaatgccactgaagatggacctgccccctggggacccaggagtcctaccactcagctgtccccaggagtgcccagaccctcattcttatccaggacctaggagccttacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccgttggctctcccattgtatggaaggaaaccagcccagggtcacacagctggtcagcagcaacgcagctggtctcaaatctaaggtgcctggccatgcctccatgagggggaccgcctgcaagggaggttgatcctggctttggggagcctttcctgggctgcacgaataacctccattgtttgaggccccaaactctgctcacatcttcctttctctgtctctgcttgggctatgatcgcggtgactctagcaacccttcatggacattatggcactctctgccattcacttttggtctaatctgacttcaacccccacttagttggtctctccttttacaaccaatacaaccgaaatctagggcttctttttttttttttttttgagacagagtctcattccattctgtcacccaggctggagtgcaatggtacgatctcggctcactgcaacctccgcctcccgggttcaagggattgtcctgcctcagcctcctgagtagctgggattacaggcgtgtgccaccatgcctggctaatttttgtatttttagtagagacggggtttcaccatgttggtcaggctggtctcgaacccctaacctcgtgatccgcctgcctcagcctcccaaagtgctgggattacaggcgtgagccaccatgcccagccaaatctagggctggaacatggctgcagcatacaaatagaattgaattccatagttttgttcaccccgttttttgtttgtttgtttgtagttgttgctgtttttgagacagagtctcactctgtctcctaggctggagtgcagtggtgcaatctcagctcactgcaaactctgcctcccaggttcaaactattctcctgcctcagcctcccaagtaggtgggactacaggcgcccaccaccacacccacctaatttttgtattttattagagacagggtttcaccatattggccaggctggtctggaactcccgaccttgtgatccacccacctcggcctcccacagtggtgggattacaggcgtgagccaccacacccagcccgttttgtttttgttttgcttgtttcttagggttgtttttctatttatggtaaaggcattggctttccatttgtagcatcaatagaatatttctcatttacaataaccttatgtgatagtaaatgtaaagggatttaaagcagtggttttcagccgccagaggcctgagtgagtttgggcacactctgtgtgatcgggcagaaggcctgtgggaagtttagctgaggacagggccaggaaaggtgatggacagtgggggtccgtcctggtcaccaggcccctgggtcctacccacctgcttggagctccccacccatcacacatgatgctgccaagccctctgggtattgtgggcgaataccttaggagagaagctgatgaactttgtttcttgaaatgcacagattccttggacgtccctgagaggtcagtcatgaaagtcaacttggttttctccccctcatttgggttcagaatttaaagtccacacacacgggcagtaagatgatatagataaggacatcatcactcggtttcggatgttaagatgtctaggtgggttaggggtgatttgagatcacacaaccttgtgccacaaagaggaattcccaggccagagggagacattttattgccatgttatgatcttatcattgagtttaaaggcaatcttgtttcattttggattctttcttatgtttatatcttataagggcactttgaatttccaagcaaataataattttgaattagcttttaatcattgacttctagcacagttatatgatcagaaacatgctgtgtgatttgattgctctcaaatatattgagatttgctggaacaaaataagtcaggttaatttttgcaaatgtaccatgtatgcttaaaatgaatgtatctacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaggtgaccttgaggaaccctgggagctcaggaaggaaggagcgcccagaagcagggacagggagctggttggggaggaccagaaatcaggtttgtgaaggttccagagaggacctgtccttgggaggagcgtgggggactgagatgggggaggggtcattggaatgatgcgggcgctacttggcattgtccattgtgaggcaccaccggggtcatcagggattggtggagagggagtataaagccccagggttgctaagggagggcccagaccgaagaaggtttggtggaaaggagaacctttgtctccttctaattgctcctaagcctcacgctcccttgccctgcgtgtcctgttgcttccctgatcttctacgtgacctgtagctaaaccttccaccagcgcttgagaacttaatttgaactggatcctttcccagaccgctttcttctcctcctcctcctcctcctcctccaggtgcccaacagcccccttctcctcctttcccttcccttacttccccccttcccctccccttcccctccccctccccaactcagatctggccccggtcccatccccttccctcccccctgccctaagccacctccacctctgtcctggctgcctcagggcgccctgaaaggaccaggacatgcgggtgcggtggctgcgcttttggctcctcttctggctcctgctgggatttatcagccatcagcccacccctgtgagtagacgctggacccgcggggtttcttcctttttactgggctgtgtcaggcggcatgaaattacacagctcaggcctgtaatcccagcactttagggggccgaggtgggcagatcacttgagtccaggagttgaagactagccagggcatcatggcgaaaccccatctctacaaaaaattccaaaaaagattagtcgggcctggtggtgcgtacctgttatcacagttactggagaggctgaggtgggaggatcgcttgggcccaggagctggacgttgcagtgagccgagatggccccgctgcactcttgtctctaacaaacaaaatggaccaaaacaaagtgaaatgtcatttgatttgtgtcatctggtttgatgactttttttgttttttttttttagacagagtctcactctgtcgcccaggctggagtgcagtggcaagatctcggctcactgcaacctccgcttccagggttcaagcaattgtcctgcctcagcctcctgagtagctcagattacaacgcctggctaatttttgtatttttagtagagacggggtttcaccatgttcgccaggatagtctccatctcttgacctcgtgatccgcctgcctcggcctcccagtgctgggattacaggcgtgaaccatcgcgcctggccaaaatatataaccttaagtgtaagtttactaactttggaaagtacatacaccagcataaaccgaccccctttcaagatctacattattttatttatttatttatttatttgagacagtttctcccttgttgtccaggctggagtgcaatggggcaatatcagctcaccgcaaccgctgcttcccaggttcgagcgattctcctgcctcagcctcccgagtggctgggattacagacatgtgccaccactcccagctaattttgtatttttagtagagatagggtttctccatgttggtcaggctggtattgaactcccgacctcagatgatccgcccgcctcggcctcccaaagtgttgggattacaggcgtgaaccaccgtgcccagccaagatctacactattatgtcaccccagaaagtgaactctcactcttcccagccagtctctttcttatcataggttagcttgcttattctggaatttcgcgtatacagatgcatgccatgccataggtactcttttgtgtctgctttattctgctcaacaccatgtttctgaaatcattaccattgttgtatggttctctaactccatcatttccatttcagactcacgagttcaaccagttgaagggctatctctgtttaattcaccatcttgaaagaaacatttaaaattgagatgttttcaagaatatatagttaaatcctgaggaatcgatgtagaaatgttatcacaagctgtctgaacttactcagaggaagtcttcgtcttcactcacataagagtctaatggaattaatatcaacaatcttagagaaatcccacactattcatgccattttcatgatctccaccttggtaatttttttttttttgagacagagtctcgctctgtcacccaggctgaagtgcagtggtgcgatctaagctcactgcaacctctgcctcccgggttcaagtgattcttctgcctcagcctcccaagtagctggaactataggtgcgtgccaccatgccctgctaattttttgtaattttagtagagatgggtttcaccgtgttagctaggatggtctcagtctcctgatctcgtggtccacccacctcggcttcccaaagtgctgggattgcaggcgtgagccaccacgcctggcccagcttgttaatttttaagcactaaaatttgatacttatttgtgaatgaagtaatctcttcattgtatttttttttttttttacttatgctgagctttaaatgacaaagattcatataatccaaaagagaagtattatttagagggattcttttaccatgtgatatataataaatgcatccaatgttatacatcaatttaaaaaacaagtaaataacttaaaagataactactggccaggcgcagtggctcacacctgtattcccagcactttgggaggccgaggcaggtggatcatgaggtcaggagttggagaccagcctggccaagatggtgaaaccctgtttctactaaaaatacaaaaattagccgagcgcggtggcaggcgactgtaatcccagttactcagtagctgaggcaggagaatcgcttgaacccgggaggcggaggttgcagtgagctgaaatcatgccactgcaatctagcctgggtgacagagcaagattttgtctcaaaacaaaaagaaaagaaaagataattacattatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggtgggcagattacctgaggtcaggagtttgagaccaccctggccaacatggcaaaaccccatctccacaaaaaatacaaaaatttgctgagtgcattgtcaggcacctgtactcccagctactcaggaggctgaggcaggagagtcacttgaacctgagaggcagaggttgcagtgagccgagagcgcaccactgcactccagcctgggtgacagagtgagaccccatctcaaaaacaacaaacaaaaacaaaaaaatggctgggcacggtggctcacacctgtaatcccagcactttgggaggctgaggcaggcagatcgcctgtcaggagttcaaggccagactggccaacatggtgaaacctcatctctactaaaaatacaaaaattagtcgagcctggtggcagagacctgtaatctcagctactcgggaggctgagggaggagaatggcttgagcccaggagctggaggttgcagtgagccgagattgcaccactgcactccagcctgggcgactgagtggagcggaactctgtctccaaaaaaaaaaaaaaaaaaagtttttttttttagatcatcagctattgttagtgttagtgtatgttatgtgtggctcaagacaactttgcttcttttactataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattatttcaactattattattccaggttatcaatactctggctgaccatcgtcatcgtgagactgactttggtggaagtccttggataattatcattattgtgtttctgggacgttacaaatttaccattctcttctgcacaatttacctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatatctgccatttacattatgaaaattaaataggtcggtgtttgtttaatagaatgtcaacagagcttttggtcaaaaataagtttttttaacctttgtactatttatcacaaatggagtatgaggtttcgtcacttaaataggaaattctttctaaactcttctgctttatagttctatcgtatgggtggaaggaaagcttccaatctcctttcggaagattcactgcagaaatgagctgacaacagacagcttaacaggaaaagaaaaacatagaacaggcataaacatgggaaccagctgaaaaatgagactgctagaagggccggatggttgatgcttaaagagcaccctcttctgaggggagagggagatagatggagatgtaggccatttagaggggtagcaaatgatttttaggggaaatgaaagagcccaaggaacaaacaattggcctgagacaaagttcctctgaggtcatagggacgaggtgacaaactgccggaaggtgaagggcagaactgcactgcatctcacgatgcagagaaagccccagagaatctcttagaactgccctccaagagaatcaatgaaaagtgtgtctgggcagggtaattttgaatgacatcattcaaagtgcatgttcccacttgcaactggagagagatcagtatgtcaaaagtctgtacttggtaagaatttggctgctaagttgtgccataatttgtcttttgagtcttttttcctttgggtaagttgagctctacattttgtcttgtcattcatgacagtaaaaatgtggttgtctgggggctgaacctccttttgaacaatgatccaagataaaagtactaataccacaatgcttttttatattcaagggaagaggaagtatgtttcagttttaccacctagataattatacgtcatttggcactgcctttcaagatatgtagaaaacagaaaatatatgagttatgaagatatctaggcaaatttaacattctctatgccacttagtcctgaacagagaattttcggtataaattggaggaagcttttttttttttttttttttcttacccccgagacaagtctccctctgttgcccaggctggagtataatggtgtgatctcggctcactgcaacctccacctcctggcttcaagcgattcccctgcctcagcctctcaagtagctgggattacaggtgcccaccaccatgcccagcaaatttttgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacaattccatttaggaaagttcagctgagctgttggacttggacaacttcgcacctctcttctttgtccttgtcatctagtcatctataccattacctcctaagcagggacatcatgggtgccatgaagcattcatgcgtgatggcatttctttgcttctcatttcttcatgtgtttgacatttctcctatctccaaactgggccagctacctttcctatgaaatctagcagtagctgtgggatagatgtggttgccctttcatctttttagattacccattgcttctctcgaaatcctagtacatgatttttttttttatcctatgtgcagaaatcaggaaaaaaaaattctacaaagattttgaaagatattatttcaggccaggtgtggtggctcatgtctgtaatcccagcactttgggaggctgagacaggtggatcacttgaggtcaggagttcaagaccaggtgggccaacatggtgaaaccccatctctaataaaaagacaaaaattagccaggcatggtagcaggcacctgtaatcccagctacttgggaggccgaggcacaagaatcgcttgaatctgggaggtggaggttgccatgagccaaggtagcgccactgcacttcagcatggttgagagtgacactctgtctcaagaaaaaaaaaagtcatttcaatgactacctcaggagattcataggtatctgacccacatctgagatgggatttgcattgcattttagctgtgatgagaacaaatatttaatatcttagaagattaaaagcatactgtgataatatggaaatcttggtgggaattcagtcattagtgagaatgttttgcgttaagtacaaaccagcctcaatgaagctgatgtgagggaagggaaagtgaactctgagtagagcagggacagaaggaagatgctccagtgtagatcaggaagaagcagggggtgaaatgttacaaattctagaactcagagagctgaaggtaattccttccttttcaagttgtgaaacatgttaacctgtggtaaaatacttatgagatgataattaccatctaaccatgttgaagtgtacagttgagttgtgtgaaatatattcgtgtcatttttttctttttttgagacggagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaaaatggtctccatctcttgaccttgtgattctcccgcctcggcctcccaaagtgctgggattacaggcgtgagctaccgcacctggccttttttttttttttttttttttttgagacagagtttcaatcttgttgcccaggttggagtgcaatggcacaatctcagctcaccacaaccttttcctgctgggttcaagtgattctcctgcctcagcctcccaactagctgggattacaggcatgcaccaccatgcctggctaattttgtatttttagcagagacagcgtttctccatgttggtgaggctggtctcaaactcctgacctcaggtgatcctcctgcctcggcctcccaaagtgctgggattacaggagtgagccaccgtgccagcctcatgtcattcttttgtgtgtgtgtgtgtgtgtgtgtgtgtgtgtgtgtgtgagacagagtctcattctgtcgctcaggctggagtgcagtggtgtgatctcggctcactgcaacctccgcctcccagcttcaaacggttctctgcctcagcctcccgagtagctcggattacaggcgcccgctgccatgcccagctaatttttgtatttttagtagagacggggtttcaccatcttggccaggctggtcttgaactcctgaccctgtgatccacctgcctcggcctcccaaattaatgggattatacgcatgagccaccgtgcccagccgtcattcttatattattatttcctaggtgcctttcctgaagactatcttctggtctcgaaatggacatgatagatccagggatgtacagcagagagctaggaggtccaaccgccgtagacaggaaggtatggctctgttggagtccccatagtgtggaaatgagtttgccctggaaagggaaagaatagcttcttgccctcaggtttctcaccttctcctctcctcactctcacccagggctgaggtccatttgtatgcacacaaagaaaagagtttcttcctttccaggaattaaaattggcctggaagacatctgtactttatggaaacaggcggaaacaaaagttcaagctaaaatccgtaagatgaaggtcacaaagaaagtcaaccatcattacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagtttgtcctttctgcttcattagtttaagctgtataattcctttcccttcctacattcttgtttgtaatttttttgggggaagaggagttgctagtactggcattggttttcctttctctctctcttttttttttttttttttttcctgagatggagctttgctcttgttgcccaggctgtagtgcaatggcacaatctcagctcactgccttttgggttcaagcaattctcctgcttcagcctcccaagtagctgggattacaggtgcccaccaccatgcccagctaatttttgtatttttactagagatggggtttcaccatgttgtccaggctggtctcgaacttctgacctcaggtaatccacccgcctcagcctcccaaagtgctgggattagaggcgtgagccaccacacccagcctttttttttttttttaattttgagatagagtctcgctcagtctcccaggctggagtgctatggtggaatcttggctcgctgcaacctctacctcccagtttgaagcaattctgcctcagcttcctgagtagcttggattacaggtgtgtgccaccatattcggccagttttttttttttttttttgagacagagtctctgtcacccaggctagagtgcagtggcatgatcttggctcactgcaacctccgcctcccaggttcaagcgattcttatccctcagcctcttgagtagctgggactacaggcatatgccaccatgcccggataatttttgtatttttagtagaggcggggtttcaccatattggccaagctggtctagaactcctgacatcatgatcagcacacctcggcctcccaatgtgctgggattacaggtgtgagccactgtgcccagcccaatttttgtatttttagtagagacaggggttcaccatgttggccaggctagtcttgaactcctgacctcaggtgatctgcctacctcatcctcccagtgtgagccaccgcacccagcctggattgttgaattcaatgcttgggtcacctccagattcattttcacagtctttcatgttttggtcatattacattgttttttgctgccatatgactgatctctttttgttaaatgtgagatacttgttaaaaaatatttagcaatgaattgaggcctagtagcgtgttatcttgctgcagaagagatgggagtctacttctgggggatggtcaggggtcctccatacaggctgcaattaaggtcatcagtgcaggctcagtccctacaaaggccagggtatttcctgtccacctctattctgatgtgtgactcttctgggtctcaaccagagccagtggacttcagtacgggtcgctttcattggcagaccctcagtccacttgttttccatctaatcccacgcatgtgtgcagaagctgctctgctgctttgcatctcagtagttccttctggaattcagcaatgaaatcagggaaatgggttccaaatgcaaggctgacttttgtcctgggttgccttcttctccatcttcacctcatgtctgtttactgccatgttagcaatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagtttccaagtgcacagcaggagtagtgatgtcctcactggcttctcatttgcattaaactgtgagcttctttagcgtggggacaggaccctgctcccattgcattctcagcacctcaccacacactccttgttggaggccactccagacagcatgtgctgaaggatgctctgtggtcagaaacaagttcattaactttccctttgaagtgttttcgtccctgtttcctagcgttctgggaattttacacatccttcctataaaaccaagtatcaggtgagatccttaggataaggaccatgaatcaagtggtgtgagggcaacacagcaaacttaccctttttaggccatttcctttttctgccctcaatctctgtgaactgaaccttgttaaagtcagtcaacaccagggtggatggtttgcagttgtcacctattttcaggacataacaccctgacttaggagccattccgatcatttctaattcaatagatgtgcccggcattcagattgcctttcctctcaaccaggatctttcaagtcgatgacaagagttccagtcctgaatcacggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgagttggtgaggtctggtttttcacaccgaactaaaatgaactttcactgtgtcaagcacaagactgaccccagagacacacatagttgcacctcgtagaagcttttaatagtctttatatttactaaagaataggactaactatggaactatgaagatgagctggaaatgacaggtgacttgccagcaggccagagtgtgattttttttttctccctcaatgggaggtgtccattctcccttcggttgtgagaatcagttggttcatttatgggaaggttgcagggggcatctttgaatcacagccttcagatgccagaagggcagagagaatcccacatgggctggtggatcatgtgtgtgcatttctctcccttctaacctgaggaaactaagcatgaaagaatgtgagcatgcagaaaaggagaggcaggtatcagaggcagaggaaaatgggaaattggatatgaaagaaatacacacctacaagtgagttcagaaactgaaccccaccctcctgggaaacgcccattggagtgttgtttttaacctctgtacaatgtttagacccagtaaatgcagaaatagaaacaaatggtcagaagacatatcgtgagagagagagagagagttcacaaaacagaaaacaaagtaccttaatatttaccagtgaccaaaagatgtgaagcagcaaaaggtctcctgaccccattgccagctagactgtgtagaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaggatattaatacaaagagaatacagctttatgataaaagatgctcagtgaaggatgaattagggatatactgagaatggggaaggaaactatcatctcagaagtcagcaggcagtaagcaagaggaggaatcaatatagcaacagtttggatcagactgtacagtttttttttgtttttctgagatggagtctcgctgtgtcacccaggctggagtgcaatgacgtgatcctggctcactgcaacctccgcctcccaggttcaagtgattcccctgcctcagcctcccgagtagctgggattacaggtgcctgccaccacgcccggctaattttttgtatttttagtagagacggggtttcaccgtattagccaggatggtctcaatctcctgacctcgtgatccatctgcctcgccctcccagagtgctgggactacaggcgtcagccaccgcgaccagctcagactgtactcttatagccctctgaaatacgttttctaggtagagatagattgtgtaagggtacagttatgaggataacagaaacgtggcagattatttaaaatcatcctgaaagtggtgctttatctgatgaaagtgattgtaatccataggaaaatgtttcaacgtgcgcaagagttgcggtggcgggcagaggactaccacaaatgcaaagtaaggagcttcctccccgcagttgcaggatagttcagtgctgatgcagatgatgccaccgcccttagactctctcaacattcaatttctcatgtgttggctttttcagatcaccccctctgcaagaaagcctctttgcaactgggtaagtttgtttgttttccttgcttttggacagtctgccaggtcaggacatggatacatttttctccctacagctctgtgctcaagccctgcagagggagatggcagagaggaaggctgcctacaagcatcacagtcccatccctgttggtaaccgtgttgtgcaaaaacaccttcatccccacccagtggggcccctgatctaatattcaaagtgtcagaggttccatatttgtaatagcaaatgggccctgactgtaaattagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctgcagagctctttgttctcatgggtggcacctccagagtgaagaagatcctttatcaagaagggaaacaggggaaatgagagggtcctgcaggcagagctggaatcaacttccactctgcctcttgcaagctgtgtgaccccgggcacaatttctccttcctctggaaacctctgttttcttagatttggagcagggtggtcacactgaccttgcagagttccgagaatcagagacagaacataaaaggcctggaaaacattctccaaaaagaagctgcaacatgtgtggacaatgggcttttcatgcctctcttactgtctgttgacctggtgcaagaaacatgctctggtgatggctgtgagggaggaatgaggatagacatagacactcctgtgtctcaaacatgcctctttattactctgttatgactctgtcttccctggggcaggaccccagcctgcctacatttgcagacagacacagtggcatgtggagacaacagtgtgtcccaatgacttttctttactccccagctgtcggcagtactcagtggaagggtgatattatgacactgatactgctattttgaaacctggaggatggaaaggtgcaaaaatctatcaccagcaacagaaggtgcagaccgtgttggtggcggtaattttgtccatcaaatgaatatgtgtgaaaacattcccttcttcggccctacaggtcagaatggcggcagcggagcatcgtcattcttcaggattgccctactggccctacctcacagctgaaactttaaaaaacaggatgggccgccagccacctcctccaactcaacaacattctataactgataactccctgagcctcaagacacctcccgaatgtcttcttattccccttccaccctctcctcttccaccctccgtggatgataatctcaagactcctcccttagctactcaggaggccgaggcagaaaaatcactgaaacccaagaggcagaggttgagtaagctgagaacaggtcattgcactcaagcctgggcaataagaagaaatctgtgagtggaacaaaagaaaaaaatcaaaaaacaaaacaaaacccacactccaaaaacaaactaacaaagaataaataaataatataaaaataaaa

SEQ ID NO: 763 - DNA, 47728 bp, Homo sapiens
tgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggtgagtggctcctcgctcccagccctgcggctgctgtcgcttcgcccccgcgggcgtgtgggctgcgccccagccagcccggcggcgccctgaagagggtggccggggcgcagaacactcgggccctgagcgcccgaagtgcagacgtgggagggccccacggggaatcgggcgccccccttcttcctcccttcctttccctggtcgtcttcttccccctgggtgagagcggggctcatctcctccacccggttctccatctccaaatgcacacacacaggaagactccaaaccgcgcacctcgcgcaaaaattaactagcaagaaagggcgcgatcagaggcaaggggctgcagctgctagggatccccttctttcgcacccctctcccttctcagtgcttagacgcatttggggttgagggagggagagtgggagggcccgggcctcttgcgatggaagtgcgcattttggcgaagtcggtgagaaggggtttctgccgtttgcctcccacatgaacataggagcgaagaggacgtaaaggacacaattaagtttcattttcaactcagcattcaatcagaagaatcttccggccgtgtaatttttgctgtcgtttttaatcctaaaaataagcttgctggaaactcttcctttctcgtgaccctcacgccccatcagccacttgcatacattctaaattgtacgttgaagtttttcccactttatttgggggaaccgttttaaaagtaatctggttttcgcctgaaataggaagacagtaacctccagtcaaaacatgtgcagcagaatgggatttggtgtttttcgacgccaaagaacctccacccccccacccccaccccgagcttttggaatccatttcgcttttgtaaaacgtgtgcttcgtctgtaaaaactgagcaaggaatagaaacattcgtagctctacagtgagtgcctgtcacacttcacatccatagagccttttgtgaacttttataagattcagaattcagcttgagcaccagtgacagcaattgttacatttattctagaatgctaaattaattcgattttaaactgattattagcctcggtgtgccgttcctaaaggcttgtgactttaggtatttccaagatgcccttaagtctctgcttaccactttcctccctccccgagcatcctggatgttgggactgtgaatccaggtctccgttatctaaatggttgatgttagtgtttcctgtcatcacgtttagtatgcttgttgcctttactatcattatagctaaaataatactgctttcagagatgtgttgtataatcgcataataatttcagaacgccttcatattgaaccagatatgaagtgatacagtatcatttattcaaactgcctaaaaagtaaaaagtataaaccatatactatttttaaaacaggtaggttagatttaaatcacgtagtttagaactgttggaatggtactttgagtgataggatttatgttaggccttctttagtaatagttaatatcatgtaattagcactcgtttacacacaattttaatgtgttcgaatccctagagtcatcgaattcagaatttatagtattttattttacttagttaatattaacctaaaaaaaaagcaaaatacaggcattatgcagttgagttgtgttaagtgtggactgtaaaacaggatagtatttgttataaaatatgtttttgtatgtgtttaatatatagcttcaaaaggacatgtatgaagaaagatgtctcagcacataggtagttataaaccaagggtttgagagactgactttagaatctagaatgagtaagaaagtgatggatctgtacattcatttgtattgaagtttgattttgctttcagtttcgttaattaagccccgggaatcagggacctttcctggcaccctctacagtgttagtggcctttgtggtaaaagaagttatctcagatactcatttcatgcaattacaggcaaactggaaggcaccttaatggtatgcaagatgtgaaatgaattactatgttgcattccactctgcccccactcatgtacaattatactttgtttaaaagtgcatagtttcagtggtatttattagctagcaaataaaactttaaataaataatgatggtgttgtgaactgtcttttcagtggttgaatgattcctctttgttcaaaatgagttgtttttttttttaaatcagggtacatatgattaaataaaatttttttccatcgtctaagtctagtagtaatttggcttgtttaaataaaaatgttttctcttaaagaatatattatttttaattacaagttgccattttaaggaagtaaatgcctatttaaaagtacgtatttatggggccgccccagcagtctagaggcagtgttttttaaagcattacactaaatgcctaccattaggacacttgctcatgctgtcatctgtgttttggcagatgttttatctttgtcactgagttgttcatggagatttgaaaggccaagttctaaagatgagagatagatgactttccccccaaattgatacatattctaaatccaaaataatcacgcatattcgcaaaactagatttgcatttcatagtatgaattcagctatagctagtatataggcattgcttttaatatagtaatgttctttttgtggcataattttcaatcactttccctgtcttaggtttctgcctacctttttatacaagataaacatttctattttcatatcttatctctcagtctgattttaataatatcgtcttgggttatcataaagttactttcactttgtatactagtgtagatatttcttctgtgataaaaagaacaagaataatagtgtaggatcagttttgttaaactcattgtagtactaaagtagaaaatacagagcacccaggaaatttgattctgatatacctagactaagacaatagaatctgggtttttcctctttacgattatacagtgttgaaacagaaatcaagctacacccacctctgaatatttcattccaaatccatggagcagttgcataagactcagaatctggtcaatctcatggtttgagattcagattaggagaattaatgtgcatatttgaatatatatcacacttgtaggttaaaaggtaaagcaaggggtttggctagttcaaggcctgtcaaaaccacttttttccatttcaagcaagtatgagcctatactacacaccaagcagtttgcaaagccctctttggcatatagacaaatttcagacagtatgtcagtatgtctcttaatgacttaagatgtagtatatagacagtagggatatcttgtttttattccctcatggtacttaggtgcttgttaaggccataattctggatgttattgactttaaactgccctgccctttttaattctaagttggcctcttccattcttataaggccacttttaaattcattagggggattgcgttgggtcagaactaagtacaacttgtggacaccccactctaccccagacctttattttagtgtccattgaggagagatctgacttcatcctttttgtacgtaacccagtgtagctagagactccagttcttcaagccagacactagttctaaggggcaaaagtaggtaggattgctttctggcatgtgtctttactgatgatctttgcttctttacctaagaggctgctgagacttcttactccattcctgaacatccattcccagcagataattaacttcctactctactgcaaaaaatagtggtgtgtggtttggactccctctgcttccctcccaccattactaaactgatctataacatcttagataaccttcgtctcattctcttccgtcatccagcttcagaagaaaacctactcacttttccaacgaaaggacaacctgtctaccaccttttcacttctaccatcttggagacctgctcagtcagcataattcttcagtcttgcatcttagatctttccctctccattgactccttccccgtagcttgcacacatgatcaaattttaccccatattaaaaaataaaacaaaaaacctcaagaaccaaaatgtccttgcccttgttcctgcctgcacattgtcagttgttgccttctctgctttcttacactgccaaatttattgtaaaagaatcactgccacttaatatattttaagtgcttgataaagccatcttgtttctctctcatttctcaaacatagtgtgcatcagatctcactagtccattgacagatggaaagatattctccccaaatatttaagcctcttttctctataattagcctaccatctaactagctacacatactattttggttcacaattttaattttcccctctttatctcccctgcttcccacaactaacttctgttgattactgtaagttttaggtcttctctccagttgttctttacctggactattgcagtagtctgttaacggatctccctttctcttttcccttgctgccctcagtccttcctttacactgctgtcaatgttttttttttaatgaaattaaatctgagtggtttacagttgtttatgttatcaagtctaaactcagcatgacattcaaggaagccctttagaatttttcttattcatcttttccaacctcatttcctagagctcacctaaataattctctgctttcagttcttcactttctttatctggctgtacacgttactctgcctagaaagccccttctttcccataacattcttactcatcctttaagacccagtttaaacatcaccctctaggaagatcattcatagacacattcttgtgatttttaaggaacttttctatccaaccatacaagtgacttgagattttccatgaaaatatgcagcttcatgatttcataatcaagtctatacaagtgagaagcagtggcaggttctcttgaaatacagaagaaaaatctatcttctcccacatgatttttagatttttcttctatggaatttatactttaaactttttacattcacaaggaaggtattgaatcctactttctggaccctgtgttagattcttaggataccaaatgaagacagtgtcttactttctgagcctggagagatcagttaagtaaaatagtaattacacagtagtaggtacagtgacaacatttgaacacaaggcaatgggagcaataaggaggggaagaatacaattgagtaatggtagggaaggggaacaagattgaacaactcaactgtgctttagtaggaagagcaaaagttagcaaactgtagctgccatttattgagtacttgctgtatatgtgaaaggtgatacaaaaacatgttatcttattaaatcttaacaatatctctatgaggtatataccatcactatgcacattttatagatgaggaaactgaggagcagaggtaagtaacttgcctaaggttatacagctaagaagtacatgaggtgaatcttaaactagggtcgaccccttaatgtgtgcacttaactattatacaccctatgtactcagtggggtaatagtgtataacagttaagaggctatttaggtttgaggaacagtatgtgctaaggcatggggatgagagtgcatttgcatagtcatggaattgcaataacgtcattatgattggagcttagtgtggaaatgagggagtacaggaggtggggctggaaaggatcttgaaggacctcgtttgtattccatgctaatgtacttagaatttagcctgaaaagggttgagggtgttgttaaagtatcttaggcaaaggagtgcacatttgcatttagaacagttattttgggaactgtagaaaatacatcagggccaggatggagaaaccttgaggatggaggcagggagctggttagaagggtatggcagtagttcgaggggggaggatgagtgtctaattcattcattcaacagacattggatttaggaactattaattaggttgaacctactaagaattctccatggctaaggagagggagtaatctaatgtgattcttaggtccaggtctggttcactggtagatgatagaaaatactttagcaaagtgatttaggctgagggtaagaagtgggggtacgtaagtttttggacatactgactttgaagtaactgtattacatccaagtggaagtgcacagcagacagttggctgtccaacatctgcagtttagaagaaaggcagtgcatgattcagttttttatttaaaagtttgcaggtgaagaaaaccatgggagtcagggaaaatactagggggcagagggtactgaatctgaagcccttagggacactaacatttagtgtgagtcaaggaatagatttcaacaaagaaagcaaactaggatggggtggacaaagcaggaggaaattcgtaatcaggagataccatggaggccaagagagaagagcaagaaagagactgcccactggctcaagaactgtggaaaagtcaagacagaaagtgaaccatgcatatttgatttttcacaagggattggtggtgactttggcaagagctgtagtaatgaagaagtaggggtgaatgggtggaggccacgtaacagatttaaggagtgaattggaagtgaggaaatgcttatagattgttaatttgggatgctagggagagagaaagtatgagggattttttttaagttggcaaatattcaagcaatttttaaagacacacacaaaaacaacaccttgtaaatggaatgggggatgtgggaggctgataatcaactaaggaaagtcgttgaggagactgatgggtatggaggcagaaatggaaactagctttcaggtgatgggattcatttcagaaaaggaagcaaaaaaaaaaaaaaggtgtggatagttggggttacaggtaggtttatagggaaggagtattggaagcttcaggattctcctctgaaggtttcagtttgtattaagaaatagggagagaggactgttggagagtatgggataaagggcagaagggagtaatttaagagttgttaaaaagaagcgaacatttacatgaaatatgtaaaatggtaaagattgaaggcccggaggagcagggactatgacattcttctgtttttgcctattagcaacatgaattttcttagaaatctgtaagaccaattactcttctgcccatccataaggacgttgtccatgcagaaaagataacacttgtaaccttgtattatatacttatcatcgcccatttgagaattgtaagctcctaaaagataataactatattttttcatcactatatccccacatcctatcacaatatttcatcacaggtaattcttgacaaatgttgattgcatttttaaaatttctaacctgaacttgtgtgctgtgaccaccatggattgagtcttctctgccactacaaagctcttttctagactatgatatgagatggtttgggctgatagtctatattcaccaatacttgtacagttccaatgaaggtttcaagtctaatacttttggcatttgatataaaatcattttcccattttatttgctaatttatctataactctggcattactcttggttacatttgtctgctgctatctgatttagactgctataagcatatcttgtttattcagagttttcttattcatgttaattatctgtgtttctttatttgctctctacattttaaatagtttcttcactttgctgttttatgagaagggagtaggcaaaaggaaaaaaccccaaatcagacagttttactacttaatagttttttaatgcatctttatagagattgaagttgtagttaacagctagagtgatatttttggcctgcccttatttattaattactagtgcaaaggttattcaaattgtggtttatccaggtcaattttactgttatttttactaatagcatttattctacttaaattgcttcagctataaaatgtttttattgtaacaaataatgcagtataattattgctttctgtattcctttgaaaattcattctctaaacatatgttatgaaatggtggattgttcaccaactacttcttacttacttaattaaagcctttgcaaaaagtttcataggatgactgagttcttcattcgtacctcttttttttaagaataatctcttgaaagtcaaaccatgattcatacaaatataaaatgaacatgtgtcaaagattttatttcactaattaattaacaagcaaactagcaagaaggcaaaacccttttaaaagaaaattggaaaaacagacacatttataggcaatcaagaatgcctaaatgaatttgctaataaatgcaaaattggtcaatatcctcagggcagtaaaatgtagtcttttggaatcctctcttccaccaggtggaaatcaattgcagaacaagatttatttttatctgtatggacagcaatccatttgaattactctcagttttctacaacttatgaaactgtaaaacagcccagtcaaagtcagtgaaaggcacaggcttctatagagtcagataattccaaagcgtctgttagacattgcccagcacttgactgaaaggatacccagtagtctttgtatccctttcaaaatcttcaccatattttctgatactttccttcctttataatttgaacatcttcacccctttattcttctctggtatactatgtcctctctccctcagtgtttctctctcaggggaaataattcacaattccaaagttttaaagaatgcaacggaagtccaggttttgccttgggcttcctagtatttgggtggctagaaatgtagaaaactgggaagaggtgagctgtggatgcccacaatataggttcagactgcaatttcccagaaatataacaatttggactagtcaaagagggcccatatcattacattaaaatgccagattatctagtttttatagtatcaccctacatttttacagcatagtattgtttagagagcacttgccgctatgttttccatgttaatgctcaacacagttctgtgaagtagcccggtgtttgtttttgatcctcctacttaagagatcctcctattttagagagtaaaccaaggcatagaaaagtgagttgcttaaggcagcatattaaaaaggggcagaaatagtatttttactcaggtgttttgaacattgtccagtacctatattccagtatgcatccttgcattcaattcatggggtatttattgagtaaacatagtgttcttacaatagaaacattctatgcctctgatttttattccagtttatgtagaagtaaatcttaagtgtgaactattaacaaagttgatattttatttatatttgttagtaatttgtgttttgtttttgtttatgttttgaggggaaggccaagtagctacttaggtaaaagagttgctgagtggctgaagaatatggaagacaactacaattcctacacattcttgtacattttagttgaacaatgagtgattacatttatttacccagtgcctcttctataaggcaacaactggtagtttatcctattgagaagcgtagataggatgcttattagcagtaactgctcttggtttcaacttgcatcttacttagctttttcaccgttttgtggtttcttggaggaagaatacccataatatacatttggagactgttgttctgtagtgtcaatgaaatgtgggggtgggaaaatgtcattcaagactcccatacaaaatgtctattgctgcctatattttgctatgggaaagtagccacagataatgttttttttttcctcattagtattttaagattttccatcctagtggaaagatatgatttgattcatcctatttactttgtatattaaagtacagtagaacctgccactttttttggaaatgcagcataaggataaagataaatttcatatcagttcagcaagttctatttagcagtgtgttgaagttgagactgaataaaatatttggtttggttttctgttcaaaattttaccttgataaggacaatatttttctacatatatcagtaggcagtaatgattacttcaaagcttccaaagccagatactacacctgcatgttccaacatagttgctgaatttattcccaagatgcatgtaatgtatactttgtattattgagaatgaataaagaaaagtcataatgatgccttccagctgtgcaagttaatattaaaatataatttgtttgcatatttcacctaataggtcttcttcattgctatactgtttacttaagtgaacaatggaaatgttgctgtttatcttaaggatttgtaacatgcctaagatcttacagtacagacttctataattaatgaaacatttttctttttcctttccaggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttggtaagacttctatgaaagcttctttttttatttgtcctggtgcaacctgatcctctttcgagaggaggccaaatggggataggtactcctttgaatcaaaaagcaggctgttattaataaatgttgatgtaatgtttagcaagtttaagattgtgatttctatcctatttgttaatctactcttcatggtaaaacacatttactatttaatttgtattacttgttaatttgtatattgtgtggttctcaaacttttggtctaaggaccattttatttggctgattggtcctggggtaatgtactcttcatttctgtttgctgccatccaagtgctttctttcctgtgactaattttcaagtctctttccaattattcagccttctgttttttgtgttttttttttttttttttttttttttttaaccttacactttgaccaagggatgacaagtcccagccatgctccctctggagagaatagaggagagtcaggagattaaatcacgttatcatggatgatttcttcagattttctgtgcttagccttactttggtcttctttttgttggccaaaatatgagagaactagagattcaaattcatttattcaaattcagacttgatgatagcaccatgattctgccctttttatcacaaacttgggttgctgaggtgtagaaggtagtaaaattagctgaagtaaatagtctcctctccttgctgtttcctgctgtgctagctgagttcttcaaccccatatgagtatgttctttctgttttgaaatctctatttagaattacctgtcatattaccgatcatggcttaaccacattttgagaaccttaactctagataggttcagttctgttcagttggatcaactatttgcctagcttttataaaataatctactaccagattaggaatggggtgtttggtttgatgaaatgtttgcacattacttaggattgagaatcaggaggtctgagttacagcccctgttcagcaacttactattcacctgtgtgatcttgagaaggtgcttaaccgagtccaagttacctcatgtccgaaatggagatgacaatagatacttgcttttatgtattctacagtctaatgagcataaaccaaagtgtgttgtaaatgttagttgttttcctgggatgtttattttatgaagtaaggtatcaagttgttgaagttagcctagagcattgtgagagggatttgtgtgcagtgaggaatgggcaagggatggctccgagtaggcaaggagaatttgaaaggtctttctgctcagaaatctctcttacattgtagcttttactattgatattaatttgggcaaaggagctttttttgttgttgttaagtatacctttaatgaagggtgtaatcagtcagtcatatccactgcaactaactggtattagatcatctaatacctagttgaaatttttctgaggtaatgtacaattttgtggaaatgaaagaataagatatgggggaacagtaacttttggggggtaatgcaggtcactgagaggtaaactggaaaactcaaaatatgagatttgaaaggccagaagatgaaatgaagatggaagagaaaggaatgccaggatctgagataaaaacagtttattattttgcgtgtgattgaaagactgttttatctttgtttgcaaaataccctataaaaataaaaactagacttattttgggagccattaaaaggagaaagtattgttttattatagagaatgtagaaaattctaccagaggtttgagacatttggctttgcatccattttaattttttgaaataattattgatttacaggacgattcaaagatagagagcttccatgtgcccttcacccagtccccccaatggtttcctcttatgtgacacaatatgaaaatcaggaagttcacaatggtgcagtgtgtgttaatggttcgctctcattttatcacgtgtttatttgcgtaactacctacacaatcaggacatagacctatccatcataacaaacatctccctcatgcttattcttactagtcataccgccacctcccactgtccctaacctggcaagcaccaatttgtcctccatatctataattttgtcatttcaacaatgctatataaatggaatgatacaagatgtgaccttttgagaagggctttttcactaagcacaatgcccttgagatctatccaagtttttgcatctatcaatagttcttttttccttacttttttttttgctgagtagtagtccatagtatgaatatatcacagtttgtttaaccacttacctatagtaggacattttggttgtttccaagtttgggctgttacaaatgaaactgctctgaacaattgtgtacaggttcttgtgtagacacagttttcatttctctgggataaatgctcagaagtatggttactgggctgtatggtaagtatatgcttagtttttaaagaaactgccagacttttccagagtggctatttcattttacatttccatcaacaatgtaagagtgatctggtttctccacatcctcaccagtatctggtgccactatgttgtaaccatttttaactgaaaaaaacaacaaacaaacaaaaaccagttaaaaagttatctgcacaaaaaggttaaatggggcaggactcttactatggagtataagttcttttctaataagaatacttacttgtcacggactttgaggatttaagcattagaaaccatttttactatgtcgtgatttttgcaaatacaggcataaatgagaaacagaatttgctcaatagagaagtgaattctacttaatagaatgcagataatagtgaccattctttgtgcctttttaaattttttggaggactaggactgaatacatggaaacactataagatatagttttatatacctctgtgcctatgtatgatatagtccattagaaggagcactggacttgaaattagaaagctgttttctagacttcactgtttaatagcttaagaaaagttggataaaaaactcaacctatctgtccctcaaattcttcttagtacagtaaagatggcatcaccatcatggaaatgtttgagatataaataatacctctcttacttaacaaaattttactaagtgcctaccatgtgccagtcaccgtactaggcatcacagattctgtgatgaataagacattattgctgatttcaaggaagtggttgcagtacaaatatgaagagtgaagtgacctaacatttatttgcacatgtgccacatactttatgtaagtcgtgtcctgttatcctctcaagaactctaggagatagatggagttcttaccatttaacaaatagggaagcaaaagagattcaaggtattgttcaaggtcagagtaatagccaagaattaaacctagatctctttggcatcaaaacccagtatttttaccaccgtaatatgtggttcatgtgaaaacaccttgtaaataactaaatactgaatgcaaatactagtaatcataaaatttatcattaatatttctgttctattagcaatacaaaaacttgaaaacttaaagtttatttttctctaagctattagagttttgtttagaaaggtcagttcaagttccgcagtgttgccaattccattattatcaacaggacatatggtctgtttataatgaagacatgaaggcattgcaagatctttgtattagttttctagtgctgcataacaactacaaatatagcagcttaaaacactacccattttttagctcaaagttttgtaggtggcaagcctggtcatggcatgactgggttctctgatcaaagtcttaaaagactaaaatcaaggtgttgcccagggcatactttatttggagtttggggtcttgttctaggctcacataattgtgacagaattcaattccttgtgattgtaagactggggtccctgtttctttgctaagtatctgccaaggaattgtagcagctcctagagattgccctcatttcttgccccatggccccttgcatatttaaagccagcaaaggagaatcttcctcttgttgaatccctctcacatattgagtttattttgccaggaagaacccagacccttttaagagaccacttggttaggtcagctctctctccctcaaaaataatctctctttcttaaagtcagctgatttgggatcttaattacatcagcaaactcccttttgctgggtgatataatcatgaaaatgaaatccaatacattcacagtcctagtctcccacacacaaggggagggaattataaaagatgcatggctagggcaggggttttgggaccaccttagaattctgggtttgattaaataaataatgggactgtagcctagcaagtcgacacatcagaaaagccatcacaatcctgaaacatcaagtaaaaatttggtttgcattttaggattgtaaatgttactgtggtgtatgcgtgtgtgtgtgtgtgtaacctggtgttccctatgtttgtgggagtttgaaggagacactttgttgataggaatggtgtcttcacttttttaggttgtctcatttttgtacagtgataagacaaatgaggtcctgggttttaataacacttcagcttgaaagcaaaaattaaacacttattcattgactacacccttgtaatatcacttctttgcctttccactagcaagaagttcattttcgtggaagccattctgcctgtccaggaattggaggagagtgatagacacagttgtcagccatagcttgggtagaataaggatgtgaatgtccttggcttatctttattaatcttgtgatggaaaaatatctgacattgttcttagtccattttaagcttaatttatgttcttagtggcatagaaattcagagctgaaagaagtatcatgtctcactctccccttgaggaacaagagttaacgtcatctgacagtactaccataacaaatcaatagcttaataggcatataagtggctttatataaaatgttggtttttttcccccagcatctcagttggttcttaaatatctaattccatgatcctcaaacttttcccactgtaacaaattagagagaggaggaacatgttcatcagtgactgtagttcaaatacagcagaaatgtgcagcagtgatttcaaactgagagaatcctggatgcccttctccattgtgtgccccccccccccacccgccccacatatcagggaacaatttaaaatcctggcacaataatgagaagggagagtgacaaactgataagttccagttaagaatcacttagacaggccaggtgtggcagcccacgcctgtaataccagcactttgggaggctgaggcaggtggatcacctgaggtcaggaatttgagaccagcctggccaacatgataaaaccctgtctctaccaaaattacaaaatttagctgggcatggtggcgcctgcctataatcccagctacttgggaggctgagacaggagaattgcttgaacccgggaggtggaggttgcagtgagctgagaccacaccactgcactccagcctgggcaacagagtgagactccatctcaaaaataaaaaaaaaagaatcacttagacagtattttttgttctgtaatcttcctctctgtcattgaaatgtctcatatttcttgtttcacatagaatctgggagtcatcaagtagtcatctagtctatctcatcatctaatttacgaattatttctatcacaccccaagtagctggcgattcagattttttactgaaagcttgacatgatgagacattattacttcccagaggatcttggtctgttatcaggcaatttcagttcttccttaaatcaagctaaaacttgctactattctcactcactgggagggctgtagtatttctctcaagtttatacctctctgtgatgaaaatctctgttcttttagccattgctcatggtttcgggatccccattctagtcatcttcctttggagcaattccctgttagatcttcaaatgtgatgagtaaaactgagctcaggactgcgtttgttggtcacacccttctcccttccaaatgactgctgctgtaactttctgacaggtcctgcttccctgtaatccattctccatgtggctgccaaagaagatttgaaataagtcaggttatttttcttccctatttaaagccttccagccgcttgtcattgctcttagaataaaatccaaactctcccaacaagcttttaagactctacatggtcttgccccagcaaactcttcccatttgatctcatcactgaattccagtcacaatggccatcctttggtttctcaaagttgccgttcctttggcatctcttcctccctgtcttcacaatgtaggctccttcccatcctaggcttagtttcgttcctctccctagaggcctttccttactgcctcagcttctcccactctgcacactcagggtcctctgcattgttcactgctggccttcaagagcctagaggagttcctccccatggtgggctttcaataagtgtttgtggaataagtgaaaaatgagtggtcacaccaggatcgaatgcacctcttacttttgttaatatattcaaattaatattaatatattaatattctattaatatatcctaaaattttgttgtgtataggggcagggaccaatgaaagaacatttcattgtcagctcatcttgactatgagatcagatattggctatattttgaaggtagagtcagcaggatttgctgtttaactagagtgggatgtgggagaaatcagggagtcaggtataactccaaggttttcagcctcaagcaactgaagaaatggggtcaccacgactgaaatgaggaaaatgagagggggagtttagtgggggatggggtgatgaaaatatcaggattcattgtggaacatgaacagttaagattaactgaagagcctgaattcactgttcctcagtttctacaactataaggaggggttaataatttctcacatcataattgtgaggatttgaggagttgaggtacacaattaaaaacaaaagcacaggggaagtaaggaaaaatacatcaattaagcatggctattagaccatacagccttaccaaatccattggggattagatacaaaaatccaagcatgatctccaaaattttttcctggtagggttttaggctatactgaagtgacttttctttggcataagaagatattcagttatacagttggaaataaaggtattgatttggagtatccaaaaacatctctcagtagagatccacaaccaaagaagcataaaaaaaagtcttccattcactcgcaaaactgtcttatgaccattgcaaccctcaacagcaaacatatggagtctctactacatatagaggaaaatgctagattctgaaaagctaatatctataaaacagagtttatgatgttgttatattctggggattgatgtaagcattttaccaggacttattatagcattataagcttaacacaagaaatatgtggctatcattatggagtgaaaggctggaaaattcctcacctgtgacctgagagatagtgcgtggtagaatttgaaagaagtgttgatttcagaggaatgctagtgcttgcttagggcagtattcagaagaactcttccaatcacacagccccttgtacaggcaaactccggaatactttcagtacatttacttggctttattgttagagcagaaacttcacagctaaaattatggtcttaggggtttataagatgcaattaaacttaatttttaaaagttctcacaaatcttatttgaagtcttaatatcttaatttcctttatataggatatgtggatatatttttatgataaaagtaacatgtgaccaacttaataacagcttcgttaatatcctaaagccactcatcttactttacatataaacagtccttctgaagcctaattatgcatggataattgcagagtgagtttgggaaaagaccaaccgggcacatctctctccattttaaccacaatgagaagagagtacctagtggtgcatcttcctcgcttaggttccctgagtctgtctttacaggaagacttcattgttacttgaaggtacattcttggaactttacacacccagccactcaacacatgaatacatacttattttagttaactgagtacttagtgagtgctaagctttgttttaagccctttgcatgtagtttattaactttgttaatagttacaacagtccttcaagatacatgtactgtgttatactagtgtaacagttgaggacaccaaagaacaaagaggtgttgacacgtggtcacggttccatagagtgttaagttagagttgggttcaaaccctggcagtgtggccacagagccttgttctcagccactgcactgcactacctcctcccgtgaaacataagaaaaatgtgagaaatgcttaagtaagtgtagtttttattcataaataaaatttacataagtacattatgtgtaatttgttttatgtatatgtgtgtatgtataaataaatacatgtaaaaataaggccacagttttaatttttttccatctctataataaagcatgtattatagaccattagcagaatttaaagtgttatagtaaatattaattgtgacttttgttttcttcttccccagtttcatggttttctccaaatgaaaatattcttattgttattttcccaatttttgctatactcctgttctggggacagtttggtattaaaagtaagtattatttctacttttcatttatgtttcagtgatgatatagttatttctacgagacattgtcagcgaaatatttaaagttgtactaggaaaagtgctattatgataaatatgagtatgtaatttgaatactactagtctccttgaagtatatgttgtcgcccacattttgctgcagttcacttttaattcctaagaaggttgttttcacttggtgtttttttaatctcttaagaatgaatagtaggaatattagtaccaacaccttaaactcatgtcacattttaatattcacagaacatctacacacacattatgttattaggtaaacaggtggtgacagcctgcattagttttaaggtaggacgttatactttggagcatttagattcccctctttttattttcccagtttgattttctctgtgtacacgtgttcacccttggaaaagtccagtcggaactatgttttgtcatcctctgcgtgcagttctgcagcctctaaagaagcagccaccagagagttaggttctttgatcttgctttcctataatagtaacgtaaccagacttctgaaggcagatcttgatgctgcattagatttagcttcaacaacacagaattgtcattactaggcaaataggtaatatgcattacggttaatgtttaatcaaccatattttcatattttggtaaagaaaatttacaaaattaatgaagttctgaggtgacagtctaaacttttaagctttttaaatacaagatttattccttctttccttgtagcatcctgaagaccagtaaacatttatataagcaaggaataaatactgcttatttaatttattctgcaacctttaaacacacaaaagctagtaaactattgcagtggattgccctgttgtatattttatgaattttacttttactcagcagtttaagctgtctatatctatggtggtgtataaacatggaagggagatgactgattgattatatgttttaagcgcttttctcagtgtatggcattctggaaatgcttagtgatttcagaaatgttctcaacttttgtctgaaaggaaaaaagggggaagaaaggggtggcagtggcaactgtcaagacattttataacttttactttcaagatagtgtctagacttcttttggaaattttcttataatctcttagttttttatgtcaagaaaaggactggtgtagcattaagacctattctggcatcaatgatattagggaaagcttttaaccatattggcagagccagactttaagggctaagtcatatgacttgggcagggaacagcctttttcaaagatcatgaaattatttcacatagtgcgattttttgagtttggcttgatggatgtttgctgatccagacgttatcattggtgacattatttttagtgaaatgaaccaggagtgagtttgttcactgttggctgtatttttacaaaatgagctttacaatattttttctgacttaaaaaagtcatacatatcactttagaacacctcgtacaaagtagggagttatttaaaaaaaaaaaaaaaaaactcatctgtagtccccaaacctagaaataaactattggtatattctggtgaatttcctgtttccctttctgtctttttctattcatttttgttatcttttttttaaaaaaaggtaaccataaatggactcgtacagcttatatgcttgtacgttctgatgttcccccatgtcttcagaaatcttgttatagctgcctgtgttctacttttgtggatgcactataatttacttaactctcatcttgatggattttaaggatgtttccaatttttttgatactatgaaaataactctgctaaagatatgaagcctggaattggcagagatattttaagactctagatacatactggcaaaatgttttccagaaacgtttgtatcaactactattgcagatgagaatacctgtctttcacctcagttataattctgatattataacgctaaaatctctgcaaatttgatgggtgaaaaagcatcttattgtaattgtaatttttgtgttagtaaggtggaatgttcttttttatattttttgtactggtcatattttaaggaacgtgcttataaacctaaagaaatattttggtgggaattttttgttttggctcatcttgaaacaggtagatgtgtgtgtatgtgcatggaagaggtatgtctatacatgattcacccagcctgcgctcacatttaaaggtgttgatgataatagtagctaaccatttgtggagctcttgctctgcttgacaggttctgtgcaaagtactctatatctgaaatgacatttatttctcccagaaactctatgggcatagacactgttgttattcccgttttgtagataagaaacaggcacagatagattaggcaatttgcccgcaatcacccagccgtttcctgatagtactgggatttgaactagtactgtttaccactgcactgtactgcctccccgttttgcatttattttgaggattttatttccatgaagggtgaacctatatctaagcacataatactgagtagctaaaacttattaggagagcagaatgttgacctgatttgtttacttattctgcaaatacctagtgacagggtgcctactgattgctggacaccaagctacatgcctgaaatgtgggtgtgatgtgcatattgccctggttttgtagcacccacatttaagccagggagacacgaatgtatgtgcatcccatgccttgtcacatctttgagatagtcatggatccaaatctaacttttctgttagtgcctctgttgatggcctgagcattccaccaaatagaaatagaaagcacctctattctccacctgcttagatgtatattttttagaatccagtatggtaaatcttctaaagcattcataataactcagacccatgacttttattttatagatttctagttctgcttaacttttcctgattaccatttatggtctgtacttggctacaggggatttctctcagtggtttttccagctctgcatgtgagtctttgtggtccaagacaaacctggacctttaccaggctaaactttcagtaaagacagcaggttatgccctcatttgctcactctgaggagaaagagtttctttataccagagctgtatcttgaaagatgtctcaggatgccattggtcctactgaggaagaagcctgagaagactcttaaactcccagagcccagccagcacttggtgagccctggaccacgtttcaaagataaaggcctcttacagggaaatgttcctaaataccttcacctttagcttagctttaacttaggaacttttaagcagaatctctatgcttagcaaacagctcagagattgctagaatcaaacaccaaggcttaactgatagtattgaatttcagacgctttgtttgtgttctgaaaactacaccaactcacagtttgccactctactgacaattaagttcctggctgattttcaggattcttctttctcactctgatatcattttaagtgctgtccacctagtcctccagttcctgcaggattaaggtccaactgtatgtaaagaactggctaacattttgaaattctttgagataggcctatctgttctttctttgcctttgtaactttgttttatacaggcaatactggcttcgcacaaaaccgcaagaccataaacatgaccatgtaagctgaaattctgcaaaacaatcttcatgatgaatgggaaaaactattattatattgttccatgacctttaaaattttttttgttgttaaaaccttaaaaactctgttattatcaataacaacggcattgggaaatgaaaaatagtaaagctagtatttagtatgtggtaaattaaatcattagaaacatcgagaatgaaagtgtgttatcaagagtagtttgaacaacacttgtgtgttcttcttgcataactttggatacagagcaagcatcttctctatggcttggtgaattgtcatacccctttctaagtttggatcggtttctaccgttttatcctttgcactctcaatgtcatgaaagaattcctttaatgtttttttgaatgtttaaagtttattttattgccagtcacttcctctgggacatctttattctttttgttacatcctcctcactttcctcatttatatcagtaagtccaccttcgctgagttcttctggcttcatctctagagtttcttgcattgcagtaatgtcgacattcgcacaatcagctatttcttctcttactccatttatggtctattcaaatttcactcctagcatttgtcagtttttatttctttactctttcatctttcttgcctagtttcctcttttgatttatccattataaaatgtcacatgggtttatcactgggaaacaaggaggtaacaaaactccatactttgctgtctgtgcatgacctaaatatcagatgtacagtgactagtcaccaacagtcttcaaaagaagtgacatggttgatcactgatcatgatgggacatctgctatttacatagttatttttgaactgaagaaatagcagtgaagttgtactttatgcagttactcagttaatatattgtggtaattgaaatttggactgtttatgagggatttatttgattaaaccatggtaactggaattcatatcagaatagtgcaaagtgaggactgctgtacttgattccaaatttaaaactgtattctaggcatctttaatttttttttttcaactttcccctccctgctcaaaattactccacagagattttggttacggctcagatgtctttgagtagatgttcctgtagaaatcattgttagaaaattcaaggaaaaaagttctcattacactaccttgagatcctaccaagtccttgagttttgacttgaggacagcttaataatgaaagtaattcagccatgaaagcatatttaaaataagtaatggaacaggaaatttcttcatagattagaaaaattattctgaaaaagtgaagacatagcctatcttggactaggaaatttccatccaagaaagtaaaatatacaataaatattatcacaaagaatcattctgtgacctggttgatggcccctggtaataagactttgttattaagtttactgtgaattctttttttttttttttttttttttttttttttttgagacggagtctcgctctgttgcccaggctggagtgcagtggcgtgatctcggctcactgcaacctccgcctcccaggttcaagcgattcttctgtctcagcctcccgagtagctacaggctactggcgtgcaccaccatgcctgggtaatttttgtatttttagtagtgatggggtttcaccatattggccaggctggtctcgaactcctgacctcgtgatccgtctgtctcggcctcccaaagtgctgagattacaggcattagccaccatgcatggccccttacagtgaattctgttcaataatcttgaactcccagtgctttcccttggtcctgtccatataatgatcacattctgttattaaataatgtgcttatgtgctgattttattgtaggaggaattgaacaaatctatagctcagcattttactcttttgtagaaatcccttgaccctttccaaatccagacatcacaaccttctccatatactcaaaaattgtgaaatccacaaggcagggaaagttgataatgaaaaaaaggaagtttggtctgttggacatcctcttctttcatcttttatgttcaaagtacttgatgcacaaagcctggactcttttatctctgtcctatagactgatgtctagtcagtattcattgtgacaaaattgtttcattagagcaagttggatagtgtatggagattattataaaatgatttaacttgtcttctgtcaagtaattttataattggtattaatgttcatttttttccagtaccagtttcagaagctttcatttgtgtatgcatgtgtgtgttaaataagtgtattagatacttgaaaaatagtaatttaaatttaaacaatttaaaaaatgaaattgtaattttatgtgtaaaggtgtctgatgtgctttattctgcactgaaaacaatattcatttacagctcaacagacaccaaatatattctaaaattactttcctagagttatcagaaaacagcactgtaataatgaaatcaaacccatctttctttatgatttattcttagtctgatacgcatcagcctggtaagccttcctgtctctctgcttacttaccaatcactccaaatgtcatgtctttgggcaggcattaaattcttgggttttgggttttgttggatggactgcagtctgtgtgagcctatatgggtgtgtcaaatccagtctttggggtgtcatggaaacttagcatgatagacttgattttatccccaagttgacttggtaatttcattagatttcatcagtcacaacctgcattttatcttgtatgtgctgtctattggtcacaaaatcagaaaaccttcttgtccattcataacattagctgttttttcaggtggctagagggacatgtcattgcttcatctgcatgaatttgaaagattaaatgcataaaggaattttcttagagtagagtaggccttcaccatctctttaactgggaaagaagttttgggagtaacatactcatcactcacacccccctcccctcaaacacacacactcacccattagaatgtaagggccttgaggcaggccttgtgtttgcttttcgtgttcactgtcagcatttagaatagtgatagtcatatagatggatagtgctcaatcaattattgtcaaataaagtaatctacttgttccttgatttagactagcaaaaggggctggtacattgtaggtacacagtaaatatttgtagaacagatgaatgaaccaacccaacagatttcttagaagtagcctgcttttggttactaattattttatagaacatataaaagaaaattttagaatacctaatttgttcacaaaaatgttatattgtctcccctgatacttggtattcctgtgtcaggctgagcactaaggttatacattttttgttaagcatgtaattactgttatttctcatgtactttattttgtgtattgatttcagtagttgtagctgagggtaatccttaagagcatgcagattttaaaaattacatagattgccttgccaagccgtctgaaagtcatactagaaaatttgataagagcctgctgttaacaacacattgagttatttttatcttaatgctaagtggagaattacttgaatttattttttttgctgcatttaatgttttgatacattcaataaataaggataaatccacttactgaaggacaagaaaagatcaataagagatccttgaggttattgggttctatggcatctattatatcaaattccttgccctttcactatactgagaaatttgacgactgggctagcaacaagatacctaccccacattagctgtggtacctgctgaaatgtgaccatgtgagcaaagaaaatgagccaaaagaaactctttctgaagattcactgaagaaaacctggagatactctttcattagtagaccccacagagacaggtggagtgtccgttatccagaatgcctgggaccagaagtgttttggatttcagattttttcacacttgggatcctcaacatgtgtatttgttggaaatggctacttaatttaaggaaaagtttaaggtggcctggaaaataagtagtagttgaactaatcaacaggaaccaaaactactttcaatatatagtgtacttatactcaaagagagacggaccattttatggtggaaccctgtctatggtagtattttgtgatgttttatttttgttgctattgtttgcactgttttctcctataacagctcttctaagccttaagaggataaattttatatgagattcaaactcttatttttgttaagaaggatgtaagtcaccaggcatggtggctcacacctgtaatcccagcactttgggaggccgtggcaggtggatcatgaggtaaggagctcgagatcagcctggccaacaatgtgaaaccccgtctctactaaaaaaaaaaaaaaaagaattcaaaaattagccaggcctggtggcgcatgcctgtagtcccagctactcgggaggctgaggcaggagaatcattgaacctgggaggcagagtttgcagtgagccgagattgtgccactgcactccagcctgggtaacggagtgagagactctgtctccaaaaaaaaaaaaaaagaaaagaaaaagaaaaatatagaagaagaacataagtcaacctttttccatgaaattatactgtactctaaggcaaattcttgttgcttgatcttagtagcttttttatgcattgacttaaacctggaagagtttcttatgaatgtttgattgactgtgaggtgcatttgaaacagcttctactttataaccctttgcagaactttcaagctctatttagataacaatatatatgggattaaaatggaaaatgtgacatatgtctagagaaagttcctttttctgtgtatgtgccttttgtgacttatacactcagtttcattctagccagcatttgagcctagaaaatagggaagttatgaaaactctgtgccttataagaaggcaaggctatgactgagtattagacacataagtccagggctgggcggaagtaatgaatcaaataaaaacttggggaacttgccataggatgttttctgattaatatgggtttctcttctctgattaatgtggatttcagttactcaactgtgtaactgaaatccacattaataaattggttatttattgcttaggacttatctccccataaagagactaaaattgaggttataaattatgggtagatagaaattccagaaatatttaggtacctgtcatataccttaaacatagatttttatcacaatcatttaggggcttatttattgcttttactttatttaatgtttgtcactgtagaagaaaaaaaactaaatgctaaatataacatttaaaatattttccccttcatgacagccaccaattgattactgtcatggagactatctctatgtggatgacacacagcagcatttcaatcacacgctgtttctttccgctactcagtttgcttttaggttgccttaaacaacttccttggtgaaaaaatcaacttcaatattaaccaaaatttaaaagattcatatatagtaaaagaactaatattcgcagattgacccattccattctttcagagaaggtatgagatacttgacagtggagctagcagcagaaacaataacatgtatgatgaatcccattgagtctttgcagtttatttttattaaaatattttaattgaacaatttaagctttttttcttcatcaggatttcacaagggtgtaatctgcccagttttattctgtcatttttttcaaaacaaaataactagatttccagattgtttactaattttttataaggtaggacaaaattctctttttctcaatattgttaattaacccattatttcccattagtattatgtacatcagtgttgtgttgtcacttggagtggttttgctcatcgggggcattgacaatgtctgaaaacagtttgattaacataactggcatctagttactagcatctagtatgtagaggccagggatgctcctcaacattctatattatgcagagcagtgtcccccctccccccaaaaacttatctagctcaatttattagtaatacatcaaccgagaaagactgatgtatagaacctcatttgttagtgtaggaaaataaggtgtcacctataaattcaccatccatatttatactgccgtgacgttatccatttgcttatgaaagagatgtgaggtgacttgatgatattaaggagttgttcctcataagttattacattatagtacttctgtcagtttgtctctgtaccttacaagttattaaaatggcttcacttgtgattgagttcatataattctttgtttttcttttttaagcacttaaatatagatccggtggtatggatgagaaaacaattgctttacttgttgctggactagtgatcactgtcattgtcattgttggagccattcttttcgtcccaggtaagatgtgcagttcctaggcaggaacgcaggaggtagatgagtgcattccaaggtgaggagggctgcattagtttcctagggctgttggaacagatgaccacaaactgggtggcttaaacaatagcaattccctttccatgctggaggccataagtctgaaatcaggacgtcatcagggccacactccctctcaaggctgtatggaagaatccatttcttggctcttctagcttctggaatttgctgaagaatgacagtgtttatcattccttagtttgcggcagcataactccaccctctgcctctctggtcacattgcctcctccttcctctatgtctttgcctctgtgtttttgttaaatctccctcagcctctctcttatgagcacatttgtcattggaattagagcccactcatataatccagggtaagctcctcctttcagatccttaacttcatcatatcttttgccatataatgcagtattcactcttttgctgtattaggtaatattcacaggttttagggattaggaggtagaaataattttagggccatcattcaactcactacagaggcaaacttcattggccaagacatgaaagtagaatgaatgtgggaaccaagtctggaaattggcagttgcatttggaggatgggaatgtgagtgggaaatgaggatatgtagcacatgtaaagaaaagcaaaggaaggctgggactcaacctaataactatagcacaccatcgtttgtggagaagaatgcagtgcaggtgtaatatttaggaacatgggcttggcagctctattggtatctgaagttagtgaagacagcaggaagaaggaggtgaattcagaagacaacttgaaggaacaattgatttgactttggggcatactgaatacagcagatgaagggaacagtaaaagatgaatacacagtttctcactggaattctgtaaactagttaagaaggaggcagagccaattcaaggtttcagcatgttgaaacttaaatgttgagatttagatgtcttaagtttggtcttaatcaaaaaatagtcactaattttgtgtgaggttttcagggaaacgtatatttttaaaattttcacagttgtcaagcacagaatttagattagtacatttaaaaagtatgtaggaaaatattttaaatgtttttatttattgacaggtgaatattcattaaagaatgctactggccttggtttaattgtgacttctacagggatattaatattacttcactactatgtgtttagtacaggtgagttttcattgttacagtatgattttgtctacctttttcatttacaaaacagcagttttggtgaaaatgctcatataaattttttacaactcaataagagtaggtttattaaaagatttttcatgctattcttagtgacattttcccattcatattaattttaaggttattctaggttagctgttttgtaaaaagtgactttcatatgtatttgatgccaatcagcataattttaaattatgccatataacttcttaatgattattttcatattctaatttcagttttttgaagttataagtggatgttaaacgcagtctttctcttcttttgctaagcttctgcttctgcattaagaagactggttctataaaatggaattatgaatcacaaatagtagaaacatatttgttttaattattagcaaaccttaatactgtagttttaagagatggtatggaaatccaaactataatcagtatcattttcactgcattttgaaagtagatcactaccatatttagttattactattaaagagtcacatttaacacttggtcttagagcctatctctggctcgttgtacattggaaaggtattagtttgttataaaatgacatctagagatagagagcatgatgtttacagtcaggtatttgcataatggttccctcagcaagagcaattccatgtgcatgtggagaagacattcataatagccattcatattgtaaaatgcacaagtgtggtaaaagcagcattgttctaagatttagggtaaaaacttccagtccagcttagctgactgtgaaaattaaaggctgccgaatgtgtgaatttggagctgactacttgtgtggaagggttagatcactgagttaacatctaccgtcaaacaatgaactccagagtcagtctttggtcttaggagatccctgattataccaaatgcaagtggaagttattgctttttaaatactcttgacatgcttctgttacatccttttccttcctccagcgattggattaacctccttcgtcattgccatattggttattcaggtgatagcctatatcctcgctgtggttggactgagtctctgtattgcgggtaagagtcatctttctgtagacctaatttgggttacttttggacagagctcttcttcctttttctttttctttctctctttttaaaaatatatagacttgatttttttttttagtgcagtttttggttcatggcaaaattgagtggaaagtacattcacatggatatttttatgtggacataagttttcaattccatttgggcaaataccaaggagtgcaattacgggactgtaaagagtatgttgaaataaactgccaaactctctgtatcaaaatagctgtaccattttgtattatcaccaccaataaataagagtttttgttcattcatatacttgacagcatttagcattctgagcttttctttttaaacttccaatttaccccagtggtaatagtgctttcctcctcgctacaaagatattagctgtatatatggcttggtggctgattgttctagcacccaaactgatatgcctgtatttgtggaagagcttttaaaataactgggctcaaattggttggagccttagacttgaaacaccagttcccatttcttgatatgataaggtatgtgttatgcaaaggagggctttgttcttctaataattttgagtcattttactggttaagttaataaacatatatggataatttttgttttttgatcgttagaataactctcttaaaacttgggattattactgttttttagtaagttatttcatatgcttttctaatacagaattttatttgtttttacagcgtgtataccaatgcatggccctcttctgatttcaggtttgagtatcttagctctagcacaattacttggactagtttatatgaaatttgtgggtaagtcaatcttattttcattaacctatgccaataatttcagatatatcacttagaaaatgctttttagtttgttcttccagtttaggaccaaaaatgagaaaatacaattggagtgattcgaggataattaaagagggtagaagacatataggatttttagttggttcttccagtttaagaccagaagtcagaaaatacaattggaatgatttgagggtaattaaagagggtagaagacatataggattaatgaaaatttggtttccaaagtagtttaaaggaaaatggctttatctattagaatgtgtacctttttatactaagtaaaaggggagagatctttgaggatccattttaagtaatagaataggatttttaattgttccagtgtttctgtgatagagctgtcctgcacagacctgtttgtttgtcacttgctctttttcttgcagacatagacaccccagacaggaattaaaattcacaatctatcaattttgttcatttaaagagcagtgacctctaatgcatgactttaaaacagttctagttaaaaccaatataatgaaaacattgagtttcaaaatttaggcttttactccttttaaaatcaattattagtaagtatggaatttacttcattgtttctaacttgtatatttaatctgccaattttcaagtaacatttctgcataaattcttattttttattgagatatatgtacacagagagatattttcaattgtgcctgaaactaatgttatcttacctaagctcaagatgttcccaataatgtaatttatattagtttccgttttttaaaaaaattatatttttatgaaataaaacatactcttaaccacctatcaaaataatcaaaagttataaattaatggagtaaaaaaatagtgtttctgctttgctttaggtaaactttgctgtatgtgtttctaaaacttaatacgaaacttgaattgttatagtcaaataatttctcatatgactcacataatagtttcaaaaaacttttacctttatttctgaactttggttcttgatgattgttaattgaattcaattctgtcatatattctgtgtctttctttaattaatgcttattagataaataattaaaatacttaactaaaatctgcgtatccttagcatatgagttcataagtcttagttgttgctcaatgaaattttctaattttataccacataatgccataaaatacaatggagacatctaaagcagaatggaattcatgtggtagctacagtgaacatcttgaatgttggtgcatattctatttttgttacatcttccaatcaccatgtgtctggttctggaagatgacactcctggttttgttgctccccacaaatgcctgagaatagtgtgtgatttgcagtatccatacaactctggtgaagtagtatgagatacctttggctgacgggcagcacgctcttattttttcctcactatctgggttgtcctcccttttactcccatgccaccccatgccttccatatctagcatagaatgatcttcagtacagttgccagcaggtctggtgacaatgtctcaagtggaactaagcattgtctatctgccacctccttaacttcactctcctgccttctccatcacttacgttcctccaagcctgtgaaaccactgtactgtacctgtcactgttctgacattaaaattaaaatgacttaaatcttgacaagtaccccaaattattttttctttgtcataggttagcatataagtatactatatgctaaaatttatgctatatgtttaaaatttagtgcaattttattgatagtgtcctaattttattgatagtatcctaaattaactttttaaatcaacttgtctgatgccagggttcagagggacacctacagtcagttgaaaggcaagaagagacaaggtacaggaaagttgctctttagataacatggtagactaggaggaacattaatatggtttgcttatataatctgactgtgtaaatctgaatctatgtaacattaaggttgcaaatttgagcgtttatattaggaagttaaaattttaagtgtctccaaaataatttttactcattgcacgtgttctgttttagaaaagcctaatgattgtgttttgatttaaatgcaataaaatcctcaaatagttaaaaatccaagctttctcttcaagaagaagttaatgtcgctatgagatttttaacttttataatttttattatttccaactttaaatttgtagccttaatttgctattttaaagagtaggcctttcactttctacaactttctgtgaaagtgactttcactttctattttttaactttttaaactgtgttgtattttttttcttttattggaagcattttaattttataagatgagaaaaaggactgggcacaataacttaatgtgaaagcatagaaaagattacaagaacctaaccaaactcactaaagttgggcttgttgtttgtagagaacgtttatataattataaggatcaatactttctcatttttaaagccattaccagttagttcaatataagggcatatagtgttttgatacaaatcaatctggtagcagtaagtaccatatttaccacaacatcccagatattttagaatgatgcagatgcagaatatatacgtagaatttatatctatgtatagatacaaattcagatattttcttgttcaatttaaggagaggtaaatttggtatcaatagaaaaaatgtttctgaaaaatttaaaccctggaaatgtatttatggcatggagtcagatgtttcagggagagaagaacaaatcaagaagcattgcaagtatgctcatatggaatgcttaaggcttgtggttaaaaaatatatatatatggctgtcaatgtcttaggctcatggtagcagcagaaatcgtaataattcttttgtcacatgggttatatccatattggagagaattaactcaggtgaaattaacttgtacactgtttggttttataatatttagagggatcacaactgactgatgtccctttgaagtaccattcttcataaatctttttttttcagaatgggccagccaactgtgacatcccttggatcggagatttagaactagaaagtattctttctacattattagggaagaaaaggagttacttggcggttagcaatattctattttgttttgttttgtttttagagacagggtctcattatgttgaccaggctggcctcgagctcctgggctcaagcaatgctcccacctcagcctcccaagtagctgggactacaggcatgtgccactacacctggcagtgtttattctgataaatacatttatgagctcaaaaatgtaactctaaaaccttatctctgaacttccatattaccatcagaaatttagatagttgtttagttctctttttctttgtagaacatagatataaggcatggtttcattgaagtcagttgtatatacatgtaactatcctgatgttcccaaataaagctctgtatttctgcttagtttattggggaggctgctaaatgtagtgcatcccaacccattttaccctgttctactttaaaaagaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgtttttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaatttttgtatttttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctagggtaagttaaagtttattaaatgaattgtgaatgatcatttgagggattagactgaggaacttggtaattgagatattttgctatctgttttgtctcacgtcaaattaagagaatgttgaagtcattgcatgacctttgcatgaatgggtccagttctattttaaaacctgtgtttggtcattttagtgtcaatgggatggaataaatgatttcttaagattgtactgacttctcacacccaaaactggaaagtaggaataatggctatattatctctgcaatcagaaggaagctgattccaatatatcacctcacctgttggattcattggatgtgcatacacagaatgacaatttcaggcttaaaaatgaggagaaatctatactaagttgacatcactgataattataatctataaaataaatgtaaatattgctgaaaacatctgttcggagttatgattcgatcctctcccatacaaatgttttataaacattttttcccttaaaactgtgcttaaggtttcattgtaccttagataccttattaagccatctgaggaaattgcaagaaaggagtaattttaggagggcataaatgaagagaaaagcatatttataaacatagacttatcacagtgacaggcccaagaggtatgttgtggacataagctctggaaaggattatattgtacttagcttcctataacggagtgatgatagatgtatctggaatgccaaagagagtcttctgtctgtggccggaggtagaggtcacatatgcttctaagtctgacaagcctcattgtgcctaaagggcaggtggggcgggtatgtgtgtctaccacaggggtatattctagaaagattggtgccatagctatgttggtcacaagaggccagcaacttaactggacctgtgaatcctaacacattttctttcccagttactgagttcaatttgcgatacttaaagatgattctgttttgcttccacctcttcactgtgttatttattctgttgttgctatttatgcttgcactttcatatttttagaagttagaatttcttgagctgagagtggtgaagtgggaaattctgtttagaaaaataatattaagagaataatacagttattattaaactattaacccgacttggcaagctttgctttaacatttacaggcttatttcgttgttttgttttttcttttttttttgactgtaggatttactgcttactacgtaatttaaatattagcatatataagttttactataaaatgacatgacataaattatatttttatgtaaatatattttaaatatttttcagaaagctgtagaggaaccccttaatggtatgtggttatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggctgggtgcggtggctcacgcttgcgatcccggcaccttgggaggccaaggcgggcagatcacgaggtcaagagattgagaccatcctggccaacatgttgaaaccctgtctctactgaaaatacaaaaattacctgggcatggtggtgtgtatctgcagtcccagctactcgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgttttaaagtctgtgaccttacctgccctcttctgtagcaaagtgcagcatttaactcaggaagctatattccccccaagtgtcattaatatttgcataagattaaaaacactccagtcggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcacctgtggtcccagctacttgggaggctgaggcaggagaatggcgtgaacccgggaggcagagcttgcagtgagccaagatcgtgccactacactccagcctgggtgacagagcaagactccgtctcaagaaaaaaaaaaaaaaaaaaaaaaaaaaaacactccagtcatgcattggtgaacaaagtttaaaacaacgtgtattcagcatggagtcacagaatgatcctacttttgtatgtttgtgtcacagcctttaaaagcatgtcttgttatataagccattaccctcctaaaaaagactatagttcacaggaataagttaaaagacataacaaaacataaaatgactagtaccaggaattgtgaccatggtttgttctggtaactgtggcatggcatggtttgttccaggaattgtggcatggtttgttcatgtttacattctgatgtcctattttttttttttaatttctatgtcctttccttttccttggtggtgtcattgttctgtagctgtatgaagaaactaaacttttctccattttcaggaaagcaatctaagaatcttgagtgcctcttcctttgttaatttctcttaagatgtgacttttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctat

SEQ ID NO: 764 - DNA, 4814 bp, Homo sapiens
caaagctctaagtatgctgggacagatactacaaatgaactttatgatgagcgaattaacctgatttatagtcctgtactttctctacgtgccatatccattattaaagaaatgagtctaagtaggaagtagagttaacctatagtttcatttcttgaatttcttattctctttcttcagtctttttcagttaacctacacacacacacacacacacacacacacacacacacatatgtttataagtgggatgggagaacgggtacggtgataattaaaagaggtaaggtttctcttgagatgaaaatgttctaaaattgtgatggcggatgcacacctctgaatatattaaaagccattgaaatgaaaaaagggtggggggaatccaaaagtgtagcagacccaaccttgagatttgcttgtttgggaatgaattttccaataacttgaaagttgtaaaaactcacacttctcagggttaggtgtcagaaagaaaaggaagtaatttattctttaataaagcaattgttaaatactctttagaactaccactgattgcaattttgcagtgtctactcatagtgtctatataggtaccatgaaaaagatgtacttgtgaaactgttctcatgttacttcagaaaaattttgcttctaagtgtgtattctatgtctggttaaatgttcattgaattttatttaatcattaatctcaacagcattaaacagtcaataacataaatgacagtcttctctttgtactcctccctgtacaacatcacagagctccatctgtatacacgaaagtcacatgaaaatagaactcagtgttttgtattacatagtctattcagtacatttagaagtattttgcctccaatattcaaccacagtaaaagactcagtgagaacgcgtggtggcgctgcaggttaagatgacggaaaatacaactgcctacgcagctccaggatccagcaaaccgtttcccaaagcctggaagcaaaagaatagctgagccagagcgaacgtgagtgtgaaacctctttaagacaccgttgggctgcttggttctgacattctggactgcaaaacagttctactaggatcctggggatacatgaagcttctgtgaaccaacttttcaagaaaaagcaatggagattggatggatgcacaatcggagacaaaggcaagtccttgttttctttgttttgctgagcttgtctggggcgggcgccgagttggggtcctattccgtagtggaagaaacggagagaggctcttttgtggcaaatctaggaaaagacctggggttggggttgacagagatgtccacccgcaaggccaggatcatttcccaggggaacaaacagcatttgcagctcaaggctcaaactggggatttgctcataaatgagaagctagatcgagaggagctatgcggtcccactgagccttgcatactacatttccaagtgttaatggaaaaccctttagaaatatttcaggctgaactgagggtgatagatataaatgaccattctcccatgttcactgaaaaggaaatgattctaaaaataccggaaaacagtcctctaggaactgagttccctctgaatcatgctttggacttggacgtaggaagcaataatgttcaaaactataaaatcagcccaagctctcatttccgggttctaatccatgaattcagagatggcaggaaataccctgagctagtgttggataaagagctggatcgggaggaggagcctcaactaagattaaccctgacagcgctggatggtggctctccaccgcgatctggaactgctcaggtccgtattgaagtggtggacatcaatgataacgctcctgagtttgagcagcccatctacaaagtgcagattccagagaacagtcctcttggctccctggttgccaccgtctccgccagggatttagacggcggagccaatggaaaaatatcatacacactctttcagccttcggaggatattagtaaaactttggaggtaaatcctatgacaggggaagttcgactgagaaagcaagtagatttcgaaatggttacgtcttatgaagtgcgcatcaaagccacagatgggggaggtctttcaggaaagtgcactcttctcctgcaggtggtggacgtgaatgacaatcccccacaggtgaccatgtctgcactcaccagccccatcccagagaactcgcctgagatagtagttgctgttttcagcgtttcagatcctgactccggaaacaatgggaagacgatttcctccatccaggaagaccttccctttcttctaaaaccttcagtcaagaacttttacaccttggtaacggagagagcactcgacagagaagcaagagctgaatataatatcaccctcaccgtcacagatatggggactccaaggctgaaaacggagcacaacataacagtgcagatatcagatgtcaatgataacgcccccactttcacccaaacctcctacaccctgttcgtccgcgagaacaacagccccgccctgcacatcggcagcgtcagcgccacagacagagactcaggcaccaacgcccaggtcacctactcgctgctgccgccccaggacccgcacctgcccctcgcctccctggtctccatcaacgcagacaacggccacctgttcgccctcaggtcgctggactacgaggccctgcgggagttcgagttccgcgtgagcgccacagaccgcggctccccggctttgagcagcgaggcgctggtgcgcgtgctggtgctggacgccaacgacaactcgcccttcgtgctgtacccgctgcagaacggctccgcgccctgcactgagctggtgccccgggcggccgagccgggctacctggtgaccaaggtggtggcggtggacggcgactcgggccagaatgcctggctgtcgtaccagctgctcaaggccacggagcccgggctgttcggtgtgtgggcgcacaatggcgaggtgcgcaccgccaggctgctgagcgagcgcgacgcagccaagcagaggctggtggtgctggtcaaggacaatggcgagcctccgcgctcggccaccgccacgctgcacgtgctcctggtggacggcttctcccagcccttcctgccgctcccagaggcggcccccggccagacccaggccaactcgctcactgtctacctggtggtggcgttggcctcggtgtcgtcgctcttcctcttttcggtgctcctgttcgtggcggtgcggctgtgcaggaggagcagggcggcctcggtgggccgctgctcgatgcctgagggcccctttccagggcgtctggtggacgtaagcggcaccgggaccctgtcccagagctaccaatacgaggtgtgtctgacaggaggctcagaaacaagtgagttcaagttcctgaagccgattatccccaacttctctccttagggcactaggaaagaaatagattaaaattccacccttcacaatagctttggatttaattattgataggaacccatttgataaattccttaacttcttatgattgtcttgttgattaaattgttcatgctcaccaccaccaataaggtatttttctctgattgttagttcaaattatattgttaattccagtttcccttttcctcatatttaccccgaagaggtgttgcatatagaatcccaattaacaaaatatactttatcttcaaagttgatgtcatttaaaatttttccgtctttatattttatttacttcctattcattttttgctccatttttcatgttacttctcagtttcctagaacttcaagtattaaaataacctgttgcatgtattaggcatatttcctatgttacatttcttttgtctattttcctttcaaaattggtatttttgttgggctcaattttcattataatacttttcttaaagtttctttctttcttttcttttctttctttttttttttttcctttttgagacagggtcttactcttgtcacccaggctggagtgcagtggcacaatcttggctcactgcaacctctgcctcctgggctcaacggatccttccacctcagcctcccaagtagcttggactataggtgcatgccaccatgcctggctaatcttttgcagcgatgagattttgccaagttgcccaggctgatcttgaactcctgggctcaagccatcctccctcctcagcctcccaaaattctgggattacaggcataagccaatgtgcccatccaaagttttatttatttatttttttgagatggagtctcgtaaagttacctttaaaaaaaaagttctattttccctgtattggtatctccttaaataaaataaaatattcctattgtaagtgatatgagaaatctttaaccagccttatctaaaaataaaaagagaagccattgtaagacattcagtatgtgtaaatgtgtttgtgtttgtagacaaaaggcaaaggtattatgtaaaaatatttaataatttattctttctattactgaattaaaaaatcagaggtccctgttatatttttaatggctaacaactcaatctcattaagttggaaaaaaaacttatcaaagagacatttacatggtttggcttttatattcatcatagtatacattggcggtatctagccctttctctgtaaaatatccctatgtttaatctgtatttcttgcttattatatgtaaagttgagcttctttctagatattaggcctttgaataaaattctatgtgagtc

SEQ ID NO: 765 - DNA, 9285 bp, Homo sapiens
gcagctctgggcttaaaaatcctgcctggtggtctcgtcccgcccctcctcttcctccctccggttccttttcctccttccggttcttggtctaggctgcctgtctcgagctccccggccttgtcctggttggctggcgcgggacaggatccggtaaactgaacagcgtctccttgtggcaagtgcgtgcgtacgtgcgtggcgacgtcactgcgtggcttcgtgaatacgtggcttcctagcgatttggcggtgtataggcgtggctgaatacgggcctcctgcgtacgtgcgtggtgtacgtacgtgcgtgattacgcgcacacgtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtacttgcgggctggggtttctttcccctgggtttcgggcagagaacccgtgcggggcgcgcccgaagcgccctttggtgtcccttgctctccccatggtctcggcccccctccttctaagcgcgtgtacccgcgacctgcgtctgcaagtgctgctccacacacagcggccccatctcggcccggtcttccctgcctcccgcttggcccctgtgctgtaagctcgcctggaccccaggccgggcggtgcatagctctgtggcctgtggccccgtgctcagcatgacctaaccagaattaagcagtggacaatgggatttaggccccccaaaccctcgtccgatgacaatgggaggggaagtgtgatttttctcccctcggatggagcgtgctcagctgtaggaatgtgactcaacttgctgaaatgattttctgctctgcggactggtgcaccctgtgacccagacagatgtggagggtcccaccgctctgattagcagaaccaaaccgtgagtgaggtgcacatgtgttactcttaggaccggccctcccagctcttggtttccaatgcctgctgagtagaagaccttcctagggccattaaccagctttgctgacttgcatttaatgacctttcctctttatcttccttgttgtgcaggtaaagaaaccaagtggaagagtgtttcctcctctggccgtaaagcaggtactctctgcagcaccaggtaggaggggactcaacccccttcttgccttttcagttacatcagttcctactagggattccacacacacacagttgttgtgattttgtggtgatgacgagaaaagggttggctaagaaactgggcggcagaaaagaggcaaacattcactgtagccatttatcccgatggaagtggccaggccctgtgggggacattcagcctccgtcagaagtaatccagaaccaaggaacctggttatctttggtcactcatcagaagaataatcatgctcaggggccacaagtgtgtgaggaaatggcaccatggatgggttggtggagggtacacgggtgagtctttgtggaaagtcatttgctggcagatatcagcatcttagatgggcgtgccaggcggccgaggcatttccttcagcatgtcttcacacagcgagtgttagaagtaatgtcatttctagtggcaaaagtgggaagcaacttgtaactctccatcagtggaggaatggtcaggcaaattatgagacgaccaacaatgggatatcacccaggcagtgaaaaacaaggtagatgaagattgtcaggtggaaagaatgggcttgatgtgctgtcaaatggcaaactcgtgccctagcctgtgcagatgtgttgggaacagcagtttgccaagatggctgaaacaaaggaccataaaggggctggcttaaagaacagacaatcattgtctcgcagttctggaggatggaagtctgaaatcaaagtggtggccaggttcgtttgttctgtgggctgtgaaagacaatctggtctgtccctttctcttagctgcaggcggctggccggcaatctttggcactcattagcttgtagaagcatctcccttatctctgcgtttatcttctcatggtgttctccctgtgtgcgtgactgtctctcaaatcccccttttcataaggacgccagccacattggatgcgggtccgccctgatggcttcagtctcacttgattgcctctgtaatgactctgtttttatatataaggccacattttgaggtgctggggtttaggacttcaacatacgcattttaagaggacacaatgcaacccatcacaactgacaaaggctctgaggtagaaacaagcttggcatgttccctcaggggatggaaggcctgtgtggcttcagggtggtgaataaaggggagaggagaggacgtggctggggtgggaaaccagatcaggagggaccttgagtgccctgagaggaagtgtggattctgtgctagttggggcagggagcccttgaaaggtttcagtagaggagtgacataatctcattgtccctgtaccaagatcattccgatggcagtgtggtcacaagagtgcagaggacaagtgctgggggggggtgggggtgctatcaggagacttcttcagaaggcagggggttttaggggattggattgggattgtggccatagagattatggaaagggatcagattcagtgtcggttttggacacagtgccacgggatgtgggccgcagatgtgggaaagaaaggcagtgcagagagcagctaggtctggggcaggaacactgtagctggtgatgccactcacagaggtggaagggaggtggacttggtggtgatggttggggtcctgagtatgtatgggcctgtccacctaaggctgagtctgaaggggggtggcctgcaccacgggattcagagcaggacggtgagcaacatgggggtcccagaagaagggaaggagtgtgcccagccatgctggggctgctgagcatggactaagatgaagacaggactggcatgaggccggccatgggtgcttgtggggataggtcagtcagtggagtgggtggtggggggggtggggaataaagggagaaaggtgggggtgggggcagaaggttcagagaggaagtagagactgcgcatgtagacagctcttctgaggtctcggctgttcagggttgtagagaagggaggcagagtgggaggcgcgcgtgtgctcagagtagggatgctgagcgagcatagatggtggctggtggcacccagggcccggagtgagccagaggagcagggtccagagcacagcaggcaaccggctcagctgaggcagctcaccccagaggcgggagaaaagcaggagatctggagctcagaaggctgcagtgcagactgggaaaggagtgaataccaggcagctttggccctatcagggctttgtctcatgagggtgggtatattttcttaaaatcatagagcgtactagaggttgcgtttatgtgttgaaaggaaggacagagagaggagtaggggcagctcaagggtggagttcagggccagggggcggggccacgggcctgaggggtgagggcggccactatttctgactgttctgttaggtgccacgtactgggctgggtgctcttggtgccttatctcccttcctcacagccatgtggaaactgaggcatctcaagagtctatgactgggctgaggttctggtttcaagcccagggttccttccaaggcacagggctgtcctccgtgcaagaggaggggaccctctcccaagccacacacgcaggaggctgggcaagagttgtgggaagtcagagcccgtgtgactgtgggctggtgcctcattctcctcagccatagagtgggcctcacagtaccactgaccctgctgggttacttgaagattcaatttgatgatctgaagatcatgccatcccagaggctggcacgtggaaggcatgtgtggggggttgccagttgttctgattatcattcttcttttctcagctcagattgggacaggggcgtctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagcgtgggactgtccctctgtgctggaagagggctaacaccagccccgactctccgctctggctaggccgagggggccctctgtcctctgtgttgccctagggctcggtgacctctgtcatagcactgaccacatgctatcctgcctgtgccttcctctagctgtccccgccctactccggaccgccccaaagactccatgggatggacctgagtcagccgaatcctagccccttcccttgggcctgctgtggtgctcgacatcagtgacagacggaagcagcagaccatcaaggtcagtgcgatttaggccacctgagagacacggggggaaggtcaggccactgcccatgagcttgaagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggtaagtgacaatgtaccaaatgcgcagacaacgcctagggctgctgcccaagatcttgcttgggaatttgggggcttctcttgtcatctgaactgattggcgtgtataacacagtttcctttggcaacacaccttcaaaggggcggcaaggaccttgggctgggggttggtatggctggcttccgcaagctctggtaaatcatttctccactctgggccgcagttctgtttctgatctcagtgagaagcctggtcagggccatgtgcacatggtgtttgtggtgtttggctgtgtgtatttgcacatacatgtgtgagtgcacatgtgtggcagagaccatgaaaagcagcccagcccgccgaatgggtcaggtggcctctagagttgggctgcccgcctggcttcatgaacctgccccagccccaccactcacagcaccctgggaaagtcccctaacctctaggtgactgaggcccgacatcagcatctgtcccctggtgacctgctcaggcatcacctgtagcttcccaggcagtggctggtgcccttccaatctgcaaccgctgctctcagaagtctggcttggacctgcctcttacttgtgtggcttcatgaggacaaggccctctcctctgcctttctggagccctccccctgcctctcccagcgtttcctgaatcgggtttggttcgttatcaaagctacggaagaaggacttgactcccttcttgtcattttgctgatgctgtcttactctctattgattgtgactttgagtaactgtgttgtcacatgggcaggccttgggctatggaagtgaaaggcattcatgtgtatctctctttgtgtacaggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacattacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatagaaggttaaaaaaaaacacagacaacagttctcatttaaattgtttattatttatttccatggaattttgtttttctttattaagaccaaaaatgtgtttctcattagaaaatggcaacttttatgggccattagtggcctgtgagttcacgaatttgcagtgtgtctgaactgttcacagagtctacacttgtaatctgaggagccttcctactcctcctcatcgtcagagggctcatttggagacatgactgagagggaggccaacagagcgtagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgagggcatcctttctctggatattctccaggagcctgggcttgtctctctgaaaattggagttgcagtagatctgaaacaaaatgaaacatgttagttgttctgggataaattattcctttcccacctctcaaaattatgattttgttttgcaatggagaaaagaatgctttaagtggcagcaagtgtggttatgctctacagcatgacctgactaaagataaacaattcatagatcaaggcagtaatatataaatagcatggattttgatattaaactgcaaccccgtagaggtaatatgcaggtctgcaaaatatgatgcttacattatctctaagggggttgcagtttaatatcaaaatccatactttttaagttctatacttttcatctttcaataaacaatatttcacattttcaaatgctatctttgacacttaagctcttacagtatattattcaaattggtgtcctatgaagatatgtttgagaaagagagaaaagggattacagaaatgctttctactttaccatcattttcttgtttcctggagagttgcttgggcgtgttttgcagaatccatagaggttcagctggcgaatgaaactcgtcaagttgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaattcta

SEQ ID NO: 766 - DNA, 25863 bp, Homo sapiens
gcggcccaggcccgcaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgaggtgggtgccggcccctgctggggctgagaccagggctcggaggacctgtcgcggtccttgaacccgagctcctctctcccagatgcgcactggacgctgtcactccccctcccccaacggtcaacaccctagcgatggagaccctccagccaggtggcttgggaacgcttcacgaggtgacctccagccacagtgtgctcctccctgcacaggtggtcagtctggcctcccgtcctgatggccactttgaagagggtaccaggaaggtcctggcggtccctgggcgatgctctatggccctgtgtgtccaggacttactctagttggggttgggggtggtaagtagcagagccaggacttgggccaggggctatcccgtttttcctctagtctcttgatttctttttagaagagaagaaatacttctctttcctgaacttttaaaagttaaataaagcatgtgtatacaactgcctcttccctttttcctctagttactccttcccctaccgtccacaacccaaaaacgacaatctggtcatgccctgtaagtaattgtttgccttttcccatggtcagttgtcagtcttttttttttttgagacagagtctccctctgtcaccaggctggagcgcagtcgtgtgttcttggctcactgcaaccttcgcagtcgtgcgttcttggctcactgcaatcttcgccttccgggctcaagtgattctcctgcctcagtctccgagtagctgtgagccacgacgcccagctaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcatagggtgtaggggagcctttctcatttctcatccccttggattttccctctgggtggttttgtctgtcccctccgaacctgttggagcagttgttggagctggatgtaggaacatgatgttaatgatgtatgtgttttgtgtcttttttagacactggcactctagctccctgaagtttcagcagcattgagtaagtagccagtgaatagccctcattgatagataggctcactaaatgtgcagatgaccaattcgcaggttagagaaggcttcccagaagaggaggcctctccgtgagcctagggtgttcagctcagcataatagtgagctgaaggccccagtgcagcagcaagaaaccacccagcaggacggcggagttcacagagaggggagagttcatagagagggagagtgccacaggccctggcacagcttcaagccctgctggatgttggtgctgagcctcccctcctggagcctcagaggggcttacaggggctctggagatcccaactgtgttgcttcttggcgtcatcacccttcaatggagtctgagagctaccctgggagatccaagtgtgtgtgcatgtgtgtgttttttctttttggaaatttgatgtccccagcatttggacctgctttctccacatatatgtagtgggagtgtgaccggagccccactgggatttcttagctagtgacatagcttcagtgtccagaggcatcatggcttgacaaaagaggcactccttggaggtagccaactgtgctttctggcccatgaatccacaggaaattggaaccttcagttgccacaaatcctgggtcctagcctcacaggtgggtgtgttaccttcccggaagccagtgagtactatgaaagcagaggctgtccctgaggttgcaggcagaggccacagaggggaacatgacacaggaatccctacaaattctacttggggctgcctaaagaagagggaagtagtgaagcaagaagaagcacatggcatctcttggagttttacattgacccctgagggttccccggcttactctagtcacttgttcctgctttgctgcctccatcccacattgggctgagtgatggtggcattgatgagctcccaaaggccagctgtgccagggggtctgaccttatcttgctgccaatgtcagccttttgttttttaatatttagactatttatttagctgtcttagcagtttcaaaggagttatgtgccctttcacctacttatatgttgtcagtctttgcagggaggccagattaatgcttagatctttgttttgggctactggaatgcttgacttgaagttcagagctgcttgttcccaggtgaacagctactgctggaagttgctgcatcaacattctaatggctttttctatggcctgttgtctttcaacccaaacctggcctgctgaccactgcatctagtcccatgcctgctaaatgtctctaagcctgccctctgccccaaatcatacataaaggtgtttgtaagtacactggtattgaattactagtcatattttttccactgaagactggaacctcaggtgtcctgtttggatttttttaatttgttcaagttaaagtacatacatgtagtaccaaactttgtggtggatttagatctttgcgtcttcctcaatttctgacacaattctggatgcagagggaggttctcaggaaaatttttattgaatgagttaatgaataatttaagaaatcatctctaaagtttgagaactaaagaaaaatagttcagttcttagaagggaaacttgagggtggctgaaaaggattgactggaattttttaaaggaaatgtgactccccctgcccactgactggggctttgatgccacatggatgtggaatgaggtgttgggattggcagagggaatctgctagcaattaataaataaatattggcagggcgtggtggctcacgcctgtaatcccagcactttgggaagccaaggcagcaggtcacttgaggtcgggagttcaagaccagtctggccaacatggtgaaactccatctctactaaaaatacaaaaattagctgggtgtggtggcacatgcctgtattcccagctacttgggagactgaagcaggagaatcgcttgaacccaggaggcgggctttgcagtgaaccgagatcgagcctctgcactctagcctgggcgacaaagcgagactccatctcaaaagaataataataatattaataaataaaaatgatttatgaggtaaaagagttttatgcccccatgttccaggaatagtttggtggtccacatggttctcggctggcctctcctctggcccctcagtcatccctggggtactggggaattagccaacccatcatgcagtgcttcttggccatggactgccccatctgctggaaacctgggttgtttctgaggttgtctgggctgtccgctctttggtttcaccatagctctgtccagcctatggacagacaggttccttgagaaacttccggctgggtgtggtggctcatgcctgtaaacccagcactttgggaggctgaggcaggtggatcacaaggcaggagttcgagaccagcctggccaacatggtgaaacctcgtatccgctaaaaatacaaaaattagccctgcgtggtggtgggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagacagatagtcttagaagatgggagagccctcactgttatccccaaagctgcctggaggaaaagccagagcaacctgggagctgggaccggggctgactctgggcagcagagacccgagagacctggagcttgaacctcactgttacgcctttgttgatttctctcactcaggggacacacagaccctcatccagccttttgcagctatatggcaaggcagagaagccacttgcggggtcccgtggcccactatgcacgtacatagtagacacatctggccatgagtggtcagattgagccactctctagctagctgacacctgtaatcctgggtcaaatttctgacagttgacacaaagcagggggtcagggagccaaaaaaaaaaaaaatggccaggtgtggtggctcttgcctgtaatcccagggctttgggaggccaaggtgggcagataacctgaggtcagagttcaagaccagcctggtcaacatggcaaaaccccgtctctactaaaaatacaaaaattagccaggctggtggtgcatccctgtagtcccagccactcaggaggctgaggcatgagaatcacttgaacccaggaggtggaggttgcagtgagccgagattgtgccactgcactccagcctgggagacagagcaagactctgtttcaaaagaaaaaaaagagtattctggagattgaagttcaggagttcagggttcatctcgactttgggcagccaagcaagaactaaagtataccaagatgttgaaggttgatacctttttatttatcgattcattcactcacctatgtaccaaagagctcctgagcctctcttctatacagggggcactgccaggagttgtagaggatgtgatagcaaagataggaaataccttttctctttgctctgacaacggtggggcaaggattcatcattgatttcagcaggaggcaggataaaatgtgtgtaggaatataggaatacatggcaatcagtaacatgtggtacctagcagcatgtctgactgttgatacggtcaggctaggtacatcccctcagggaagaacttctgtcttaggggcacacaccctatcttttttcccttcctgccaattcacaggtaagaacatttagtcccagggaactatgtcatctctctacttctcataactgaaaaagcagtgccaattatgtatgaggtataggagacacaattctccctctttttaaaaatgtttaatagctttattaaggtgtaaatgacataaaaactgcatgtagctaaagcatgcaatttggcacacatgtatctctacacccttgaaaccatcaccactagaaaggtgcatttctccccaggaagaggggcaagtctaggccctttgccagagttgctcccagattgttttcaggttgggcctgcattcacagctcagccagctgaagggtgacagcattagactcgtgacccaaatcttaaacccacacattccattttaacattgatacctgtgatcatcagccagtatagcccatcccatgtgccaggcggaggcatcaataagctggtctgtagcagctttaatcacagctggggagccaggagctaaggaatgctagactcctttgtaaacaatttaagtagggggtacttagcctggactctatgtgcttctcatccacctcttctcagggagattctggccaagtcctggaacctactgcagtccatctggtggttgacagatatgtggacggattggcaggctgggacccaatctatgtttgcccttgtgttcagttttgagacctagcacctttcctgatcctgctcacagaccccctgcggccaataggaaagaagtgttaatgcatatttgcttttggagggcccaaagccaggcccagagagttgtcaagggcggtcagtggtgggtggatggcagagttaaccaaggagttacacacctgcctagactaaggacaggctggaccaagtagagagggtggggctaagggagcctgagagatgctctggggcctatctcaaaatgagcactatagtcaccctgtcccctgcagagattgtctgacctggttttaggtcacacccaaccttgccagccaaggagtctttagaagcctgatattgggagacctgtcctggggtctacaaccccagaactcactgcagaagcccacgtggattgctagtctagctcagccatatgggtccccaaccctcacctcatgatagtcctgtgagaaaccgctgctgaccctttgttcatgttttcatcttttccactataaaagacatgctagctgggaaatagagcccatcatactcaagagtggcaggagccaggtcctggcccctgaagcttggcctcacacacagaggccggcaccctgtcatcaattccctcagctttttctccgcctccactcccagtcctagatttagcagccatgtgtgggtgggggccactgcagggatacttacccacctaccagagagatggcctgtgggtgctggcccttctgaggctgtggaggttggaggctgtggcagcctgggcagtcaggctgtggtcctcccatgttcttgactcctgctagtctgggctgcctcctgattaggggttggatgctccagttcttccctgggttggggattgccaccctactcccagcccatccaggttcacgcttattccaaagcggagcaccagcagtgtgcctgctgcgggagttctccgtgtccagcctgagggttgcctgccaacccctctgagaggtgcccggaggctgtgcgcccacactgcccagcagtgcggagaagcaggcttgtttttccctgtcactggcttggaagagatgctttgttctagggagccgcatgtccccttgcctgcgttgttggtgaggagccagcaggctccgtggagggcaggctagcagcctggcaccagggaggcaagggtctgagttcctaggagggtggttgctcatgtgagaagtctgcaaaggttactactgagcaccatctctctgtctgaaaaacatttttcatttttctgtgaaccactaagtttcccgtttgggctttcttcctgcttttggctcttgtttaggcaggcgcagccagatccaagcgtctggctgcttccccatgtcttcagacctctttttctgttcatggtaactatagatggaaccacacattggaagctggaaactcaagcggtgcagcctattccttaccccaatccctgttttacaaatggggaaatcaaggcacagcatggggtgatgcttatctgaggttggaagagttttaatagtagagtgggagctaaaacccagtttcttacctccaagctcaggactttcagctgtaattgagcctagtatagttggtgtgcagcatcagggattccagctctaaaggtcacaaaaaggacccgggggtcattggcccagggtgggaacccgagcagagcaggtccagatggtgcactctgtgccctggccttagtttcttgctggatgctttggcccgtagagccccagagccctgcttccagaaccactccagtgacgttcatgccaatggcctgaaccccactgagcgagggtgccctgcctcttccacagccctgggctccgctcagatttttaggagcaagcgttagaggccttgctttctccagggtcagcatgtggacagaacacttactctctgcctgtctctcctcctcaaaatggaagcaagacagtggggcctacaatgctatgaaaaacaggatgggaaagaagcctgctctctgccttcctgcccaggtgagccatcacctgactaagtgagttcacactcagagcgtgtggggatggcaggatgttctgacttcattttccaggatgcctttgctttaaaaccttttaaaaagaagtgaatgatacaccccctttgctcatcttgcagtggaacctggtgtgtgaggacgactggaaggccccactcacaatctccttgttcttcgtgggtgtgctgttgggctccttcatttcagggcagctgtcagacaggtaaggtgtctgtcttctggagcaccaggggacctcagcactgaggaagaagcgtgtgcctggcccttgatttcagttggtagtattctttcagcgcagggccctgtattttaaagaagaggaagctatgtctgtgatatagactccatgcctagtaagaagagccaacaaatctgactccgtaattcttgctaagtaaagaaacctgagctgtctaagctgaatgtatctgtgacccggttgactaggtaatatgccatgattcacttctgcagtagcctggcttgcctcccctgggtcactgtgactctgtcatgcccctgagcatgggagaggttgacatcatgcacacatgcacatgtgctagattgtagatctgtagtagtgccacggtgtctgcctctgtagtcccaagaagaccagcattctctctgcaaagtgaaaggagctctcaccagccactagtggtatgaaaagcagaactcttttgtccacaaggctgatgccccttagctaagtggcctgtggttttggcatttactttatgacaggagggagaatagtgttttgatccatttcttataagcaggttatttgtataattctaaagcttttaactcaaggaaacattaacggcttagagaatcccaaacccctcgaaattatatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatgacacatgtgagaacaccccacaaatcggtgggttagccggtggaaaggagtcccagcatcttccctggtttttaattcctggcctcaagcaatcctccctccataacctcccaaagtgctgggattacaggcgtgagacaccatgcgcagccagatattttttattgttgttgtttttttttggaaaaggagtttcactcttgttacccaggctggagtgcaatggcacgatctcggctcactgcaacctctgcctcgcaggttcaagagattctcctgtctcagcctcccgagttgctgggattacaggcatgcaccaccatgcccagctaattttgtatttttaatagagacaaggtttctccatgttggtcaggctggtctcaaactcccgacctcaggtgatccacccacctcggcctcccaaagtgctgggattacaggcgcgagccactgcacctgcccagccagatttttttttaaaaagcaggttaacctgtttattattcctactttacagatggagaaagtgagacagagggattaaataacttgcccagggtttcacagctggcaagtggcagagttaggatttggacccaggtagtcttgctcctctattgtgtatggactactgttctaggtccctgctgtcctaaaacttgctttctagcaaggtggaatgtattaaacaaccaagtgaggaagtcgttgttgtccttggccatggtaagagatacagagaagtgcagggtgccacaggagtgtctaacagaggaggtcaggggcagcatccctgagaaggtgaagcatgagcgagagtgggaagatgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtccttttttttttttaaagatgctttgacaaccttgtgaagaaagaattgaagggaagcaaaaggtgttgtagagagaccaattaaaaggttgtcacagtagttcatgccagagatgatggtggcatggcctagcatgacggtggtagaaatggagggaagtggtaagaggtaaaatcaacaagacttgccgatgggctggatgtcggaattgggggaagaaagctttctggcctgagtaactgggtgaatgaaggtacacttctctaagacagagaatgctggaaaagaaccacgttcatggatattgagttcaatttgtgtgtactaaatttggggtgactatgagacccctaagtggagaagtagagtgtgaagctggctgtatggatatggtactgcatgagaggttttggctagagaaacacatgtaggatttgtcagcatatagaaccctcagcagagccccagatagggatgaggttgcctggggagaggggagtggggaggggaggggggaactgggggaggattgtgctatgcttagaggccacctgagtggacatgggagattccttctcacggagctaagtgacagctgcggctcagaagaatgcccttgatgtgaaaaggagataccccaagttcagagtagaaatgcagtgtatttttctgggtcagctgtgtcatgggtcagcttaagaaccttcttgccatgtgacacaatgattacctgaggaaagcatttaagttccaaaaggtctattcccagggaaactggaaacaaaatttgtgagtgtgtttaggaccactttagtctacagaagggctaatatagtgtttttcaaacctttctaaacattttggccacagaactttcattaaagtaggataatttaagtctagtaaatgaaatacaccctaagtggctaaaagtatggctgttctgcctgcagcccctgccttcaattcccaatgccctgcctcaagcctgtctgtgcccccttggaaggcccagggccctgtgggatggacagcttctgagtgcattacttctgagtaaaccagttctaaaacctaagctaagtagattacctgaaagcaatcaattcatgccctaacttgtctaggacatcaatgtaactttttatatagtataaaggtttcaccttctttctggcctatgaatatgtctgaaattcaagagcaattaaagtactcctgggttgtcaaagccctttatgtaacactattgagttatctttatgcgtctgacttgtaagagatgcacaactctaggaagaagtagactgctgtgtcctgtttccaggtatgtgtgtgtttgccattttgttgacagactttaaaagcaaacatttctggccccaaccctgaactgccaaggactggtgctatgtaaagggttctctggatctgtctcttccctaccatcccagggagctcttaggaagggaaagggcatagagattataccagcctgccttgtggttaggaaccaccccttggttggcatatagaacatgcttgttaaaaaaaccatgcaggggaaagtagagtctactaccaggcgagagtttctcaacctcgaccctattaacattttgagccaaataattttgttctagggcattttcctgggcattttagaatatttaacaacatatctggcctctactcattagatgccagtgaaccccaagtgatggaaaaaaacaacaacaacagaaaaaaacctcttttattgaggaaaaacaccaaactcttccacatagttgcaagaccttgtgcaatttgcctcctagccaccactgtactcttgaattgcacgcctgatgccaaccacactggttcctcatgttcaccatgccccctccagccatgggggtgtgtggtcttctcagagtctgaagcattccccacccaccccaacccaccccctgtggccttctttaaccatgctggctaattcaggatccctagttccttatgactttcctttaaaacgtctaccagaaattgggggaaaaaaagtgttattataggattaatgttggtcttccgcactatactgtgaatatcattgagagcttggtccctacaccttaaatcccccatcgtcaactattttttcccatctcagtgtcccatgatcaaggagaccctccctgaatgtccagttccccaacccttacccccagtccagggtagcttccttccttgtgcctctcattaacctgcatgccgatccttcagtgcacttgactcagtgtgtaattgtatattcagtagcgtgttgttagattaaaatgtggttaatatgtgtttcaccagttatactatgacactccttaagggcagaaacagcatcttttttaatttattgatatccaagtgccctctataatagatgctcaataaacattgaatgaaagtgggtgtcagccagtactggccagactcaaactgaacccactgcttcccactagcttgactttttcctcctgtttgtggcactctctttaaaacaaaccaaaataaacccaattttaaaaactttttaaaatgagcacggatacagaaaaccacacagaacaaatgtgtagcttaatgaatttttttcagagaaataaccttatgaccaccaccaagtcgagcagtagaactttgctgtccactaagaagccctgtccatgtgccccatcccaattacagcatcctctctctctccccattaagtaaccgctagcctgactcctgtaataatcacttccttgtgagtttttttagttttattatcgaaatatgcatccttgacacaaatttagtgttgcccacttaatatatttgatgtcttttagtctacttaatctatggattctccttctatcgccttctatgccttactgattatctatgaagaacctgagctattccacctatagaatttcccagtctggatttgttgattgcacactgatgatgcagttcagcacattcctctatgctctgcatttcctcaaaattggcagttggatccagagacttgagattcaggttctgattcaggttcagtccttttggccagaccataggaagcatgcaattcctgactgtctctttatgatgttaacagtaattagtatataatgcatagatctattaatccattgggggctataaatggtattattctaattttattaccttttcatttaaaagttagaatacttttgtacatgatactacctcttatctattattggttgctgttcacatagtttacaaaggaaaatcaggacaaatgtttctttctctttatttgccagttttcatttataatgaattgtttctctgttattctccaaatttggcagattcttttttaaaaaaaatatcattatgaatgtatggattaaataattgatgtatttcagtctcttgcaatcattatcataattgtagcattgctttttaggcaaccctggtacccaggctgtacatttgtcatggggagtggggagggggagaaatagcatgggcactgtgagaccgagactgtccctggcagccagtattctggcaacactgttcacacccacttactggatggatcttgagaaagccccacttggtggagcccattcctgctgcccttttccagctggttatctgtcactctccttttcttcccaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctgggtatgaccatcaggttggagttgagtacttgatcctgtatttcaccatcatcccatcacctacctttctggagacaactgtgatgtccctcaagggggacagggtttctaacaaaactagccagagcttcctggtgaaccttacttacaggcagggaaactgagccagacatgagaccagcctggggtccccagcagcacaatggcctgacttctgatttccagttcttttctggcctctgggctgtggctccttggtcttagtacttgatggtcaatttactaggactcaccagagatcctccatttacaaaaagggcctgccactgcacagggctgagccagccccagaaagagggcggcatggttggaggaggaggggctgtgactggcaagcttgctaaggtagagaaccccttgtctgcagagcactgtggctggtgatatctacggacaagaataaattgataggaaggggctttcgtcaccttcagggttttaattcagagtgcacactgcagggctttgtctcaaatgtgccagcctgttgtcactgagaagctgccaggccggcctgtgtttggaggaacctgactctagctgataaggcctttgagttccttgggttgtattgttgaaagggttgttttttctttttatatttaatattctttccttgaggcttaagtcagcatgtgctgacttagtaatgacttcacttttaataaattcttcctcatgtgaggattaaagggggcctaccatggcatctttagcacatggcttcagaacatggcgaaattttcaagagagaactgttgcttgggggcctgagaggccacagggatgtacccccaggagacagtcagacaggaggggttcagaacgccatccgctccctagcgccatgaacttagagagagttctcgctgttttcttgtctgtgtattcacaaagataccataaaaaattaataaggaaggaacccaaattaaactgctaactcgacctcccttgttttgaacagggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggtgagtgtgaccttgtgccccatgtgcccactggcaggatgatttctgtctggccttcactagagggcagcaacaacccatgaatccctattttgtctcccagagacaggaagcatagattataaattatttcagaatgttttctccacactcaaaagagccaaaacaaaacagaatcccatgacagcaacagacttgctctcagccctgtgctgggttgccccaagtgtggggaaaaatagcagtagctgtgagaagatggggtccagcatgccctgtaggaagttcccaagcctcagggcaggacagtgtaggccctagttctggctgtgtgctgctgaagcctcatgccacaggcactggcaccaaaagcaagagtcctcagggtagccacatggaggaagccaggctccttctgcaccaccaaggtagaggagttgaacaggcagagaagaggccattccagaccaagaggggaacactgcagaggtgctaaggtgggaatcaccccttgcaggtggagaaggtgagatcaccagcccaagtggagcagagagcatttcagggcatagtgggagagtaagccgcacatcatggggcccagtcatgaccgagggtggggggcggctacctggtcccagcaaggtggaaaataatatccatagagcactcaagtgccttgataaacatgctaatttttttcctttttttcttttctttttcttttctttttttttcttttttttttctcagacaaagtctctgttgcccaggctgtagtgcagtggcgtgatttccacttactgcaacctccgcctccccagttcaagcgattctcatgtctcagcctcccgagtagctgggactacaggtgcctgccaccacacttggctaattttttttgtatttctttggagagacgggtttcactgcgttggccaggctggtctggaactcctagcctcaaatgatccaccggccttggcctcctaaagtgctgggattataggagtgaaccactgcacctggccaaacatgctattttaggtagagtatctgactaatctgttggataaatcaggggtagggtgaggagagaagagaagctaaaaggccagtgcagaagcttctgttggtgccggggacagggaggagagtgtagcagggcctgggctgacatagacatgcacagaagccaggcttccggagcccatcttgcacccatctcctcagcccagcagatggcaacactgctcttcagaaatggaggtggccagccagcatggggatgccgtcagggggtgcagggctctcccatttttgtgcggtgtggggtacacataagctcatccaccccaggttattgctgcgtgtggatcagctctttgcttctggcttgtgatcaccaaacattccacaagctctggttctgcaaccttattcccacctatggctgtgctctacctggtctgtgggtctgctgttggcagggaggcctcactgagattggaccttgtactgccaggttcatccctgagtccccccgatggctcatctctcagggacgatttgaagaggcagaggtgatcatccgcaaggctgccaaagccaatgggattgttgtgccttccactatctttgacccgagtgaggtaagcaccatgtgggtgtgggtgagagggacagactgaccgtgatttgagagcagcagcacccagccctgaagtcctccctgctcacagcagcccagccctctctccgcccaagccccaactgcccattccccccatccccccactccccacccccacacgggccctgttaacactcagaagttgaggaataggttacagctgcctcactcttttcaccacgggtttcagattttcattttttacttcctttctaggcaatcatatattttaaccattacttctaacaataaatactctttttgagtaataggcctttcataaagtcagcatttgggaaaatcattgtttcttatacctaaggtggcttgtcaccttacaaagctaaccccaaacgtaaaatgtaaagcacaaatagatttggagttagaagtatttcatctcttgagtattagcaattattcattaaaaagaaaaaaaaagtgtttagtctctttctgccctccaatggttaattattgcatatcatcttggagtcaggtcctttttgatgtccacctcttccccctaccccacccctcccgtcagccctgttctcacacaccatgactcatttcttggctctacctagttcctggttcttgcttttccttcccgttccctctcctaccatctctgtagcaggcagttttccttggtctcgtgactatgagaggttagaagctgtaaatgctgcctggtggggttctggaatgtgtctgtggtctgactggaagatgaggggttgggtgtgggaacagccacaagcagccctgctgaagtgtgagaggcaggcatggttgggcttggaaaagagggaacagttattgtagacagcggaggccaatggccactgccagccctgcagacttcccagtgagtggtggcccagcagccactgtcagcatgcaccagaaaggggtcctgtgcgcaaaggtcaggcaggagtgtggcagagggcttttaagttaggtggttttgggggcttttaagtgaggggtcaatctgggtgaatgcataagccccactggcatctttgaggaaatgaggctatttcaggggatactttcagtccaaagttgaccttttgttgaacttctaactctggaaaaacaagctccaaacctgggtttgcttaagaaagcaacatcagtgtgtttagacgtgtggtttattaatggccttggctgtgctgaatttcataggaagtcactctgggtgaagctcaggtcaattttcctgtttttctatttgaattctttttccctggaagcacaccagtaactacatagtataaggactcaaaacattaacttttaaaaaatatcagaccaataaaccacacagccaggtactctctctgacccagagggcagggagccaggcttcgggaggaatacttagaggcctccttggaatgtggccaccgacaggaatatgtgggggtgcagtgaggaagctgtcagcctgggcctctgtcttcctgtacccttgagggactggtcacttacttttcctcattttcattcactctgatttgttactgacaaggcctagggaagttttcacagcctaaaacacagtcagtatacttactgttcttagaaacgtaacactccccgacgctgagatgcagacagctaagatgccagggattcaagtatgttattgtgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctatgtcatcagagagtgaaaaggatatgtcttgtgttagatggaaaaaatgggcatgtcacaattcttaatgggatggaacctcagaaaaggagaatgaaaacaattgtggaggctgttgtgggaaatatggactcttgtggggaatctctccagatcttaagatgaatccttgcccaatttgggtcatttagttcccgtctcctacccagttaccgacagtggctgaggaggccaggtagggcttttaagaaggatctgagtgaagacaccatgtcctgtaggctgcagaggctgccagttactttctggaaatgtggaagtgggatgtgctcctcctgggatgtccataaacggtcctggagtcagggctatagcctagatgtccttaccaggttcccactaatgaggcaaagtatgtcagaaagggatttgtgaattaccagggagaggaaacatgtccaagtgcacatcgctagcttttgctcagcggccgaaccctgggattctaggcgacttctggagcctggtgggttagcggtgagaagatgggcgaggagggcggacttcatctcagagtccttattactagtctcatccagctttgaggcagtcagccactgtgcctactgagggagtgctatgagtcacccgcttccaaggaatggcccaggatccctccaggcagttcaccattccctgagttggcctcaagacaggagcagcatgtagcctgcaccacagacatgcaagcctgtgatgagtcacccacttttgtgttcacccaggctctcctccctgctctggatttcctggggactcatgcacatactctttttattgtaccagctgtgtgttccacctgcagatgagtcaaaacagtctaatccataaaggtctggtttgtcaaagagtgtgggtcatcaacagagagaatgcctactggggatgcccaggtcaggggtactgcagggcatcctgatgagaggcagtgtggcccctccattgggagccacctctgtgctccacaagtaccgcggggctggtgtcagctgtctctgaccagcctcttcctgactggtcaccacaggtagtgtgtgagggtctctctccaagtgtttgacctaatgttgttccttttgttatcttatcccccaaatcctatcacacctcacttgatgtctgcctcctgactcattctctagctccttctgcagttgctggatttgaggaggttcagcttaggatttttaaagctgaaaggcaggttggaatttttcttttcaatgaagtaaatctatctgaattatacaagcttttttgctgggacactgtctatatggaaggctctgagagcgcactggcgcagggtttacactgtaccacttgggctggggaaaattatcttttgatctatgaagtaagacgcagggttacagttactgctgccttactagtctctgcttaaagatggtttggaatttactgaaataattgcattgtaaaagttgtacaggttgggaaagatgtggatactgcttttccagctttcttctgcactctgtttcaggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccaggtagggaccatgtgcatctatggtttggggtcttcactgagtctcttactgtctaccaggctgtctcaattaataaagagaataaaatcaagcccatcacagctcccttgcttatatacattcttggcctaaaaatcaatagaaagtgtcttctgagactagaacacttatggcctgggctttgagggagtgggaaaaagcagccattggggctgttggttaattttactctgtacccaagttaatgtgctcatactgttttccactgcagaagaagagggaagaaatagctatcccattcctttttttcctggccctgtcttctttatttattcaacaaatagctatggcatgcctaccatgggctgggcactgtgctcggtgataacgatacacaagaaaacaagccaggcagaaccccaggccctcatggaacgtacaccctagatgagaagacagacaacaaacaagtaaataaaatgcttaatatagttcagactgtgttaccttctaggaatacaaatgaaggacaatgccgagttagtttacatagtcacagatagtgtccctgaacagggggcagttcagtagaaatgtacataaagtgacagaaagccctgaaaaagtctaggagaacattttaggaagaagaaatggcaaaggcagcgaccctgagcaggggatgagcctggcatgtttgaggaggagggagaaggggaggggccagaccactgagagggcctcacagagccttagcaggattttatttctgaaactatcttagtatcccacagatgggtgggaggtagccatttccaataatttatagaacagttcatgggccctcatctctccctctccatcactgtgcccagagacttcagtgtacctgtagatttgggagcctctgatggtcacttttgggcccatcaggctgagaacactgcacgggaacagctccccatgggatgtggcaggaggagcccagaactgatgtagaggctcacagctgagctcagagtgaccttcaggtcacacatagctctcccatcagcacagcacagagagattagaagatcaacttgagattctgatggcctatgatttttttgaggtctgagtgggaggaaagcatgaaatgagttagaactgaattctccattcatctaaacatcatgagttaattccatagtgcctgcagtgtgaggttctggggtgacagttaatccctgacagacatgtctttaatgacttatagactgggaagcaggttgattggactattaaggagcttactctggtggtctccaggttgaggaaagtgcatgtccttatagctgcaggtcccagcctcctttcagcaatcaatttggagggaaatcttggctatagccccttcccccacaataggaagtgatagaaactgactccccaaaaaatttgggaagaaagtatgtttgttttgctctcaatagctgcatgccatgggttggtacctactcctaccctctttcctttgcttctccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtaagtcccatgagccaagggcacactagagcaacgggatggaagtactaactggcttgaatgtgagctggaggttgcgtgttaacaggaaaacaagttcatacagtacatgggctccatccagtactggatctttggccgggaagggttcttgtcccagtgcactggccctcactttcaaatggaaaacaacctatagattacctagaaattgatgagaatattagagggtttgtttctgttttagccatcccaggccttccatcagagactacaattcctttatcctaagaacctacagagtggtttagggagccagtgtgcttagttggagaaatttcttggaatcagagtttaaaaggaacatgaggggaaagatgtccatgcaagaggtctgatgaacggaaaattattataacctagagcactatagagtgattttatcttgtgtgaagatccaccccatgccattttatgtagcaggtctccagttttctcttctcagaattatgtcttcatagcacctgtggtttcctgcacatccctagccagtacctctttagggagggtggcacccacctgagagtactcagagtgctttgtgaacatgctatgtagatctcaaagcaagcaaaagcaccctgcctaatctgaaggcagatcacatgggctgggacacatctgcagaggtggaagagttatttccatccctggacaagtacctcaggttccttggaaacccaaccttggtaaataagaataatcagcatggcccagaaataggaataatcagcatggcccagctcttctactgcaaccgcccctttgtactcctcccctgcatggtggaacactgctgggctctgggcatgcctgtgccagctctgggttctgaaacctgtctagatgccagattctaatctgactgctcagactgtgagagatgtgagaccaagaaggaaagtgatccccttccagagtcctgggagcataaaggggtagatgagagaccaagtctaactgcagccctgggcctgaggctccgtctgctttgccataggtgcctacgaccgcttcctgccctacattctcatgggaagtctgaccatcctgacagccatcctcaccttgtttctcccagagagcttcggtaccccactcccagacaccattgaccagatgctaagagtcaaagggtaagaagacctcctctgtcagtgttgatgcactgggtctgggtctggccaggtctcaggagcccctcacaatagagctactcgcaaactccctctcacagacaccatggactagtttagccattaaagggttgtaaatggcaaggtgcttacttatagcccatcctctctggtctgttcctgtgtggacatgtcactatacacatctccatggcagtagccgcactggataactcagaggctagaagaaacctttcagaatctgctgcaggattctcttcccagggaagatatcctcagttcttgtttgtttggagactgggaggcatctttttaaaatgtgttactgacatatttttgcttgtttttatagaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttattgtttatttgtttgttgttgtatccttttctccttgttatttgcccttcagaatgcacttgggaaaggctggttccttagcctcctggtttgtgtctttttttttttttttttaaaacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaataaca

SEQ ID NO: 767 - DNA, 60738 bp, Homo sapiens
gcaaaccttaagctgaatgaacaacttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatgtgagtaacgagtgggttgagatactctcatactattatgttgtggaccatgatgaggctgccagggtgggggaagggtggcctaccttctctccacaccatttgaggcaagagacattctgcctcagaaattgtgctgaggggcacaaataagctaatgtcctcctgccccagatttctctcacttgttcctatgcatattgttcttgttgctcagttttataaggtgagatattttctgcaccaaatatgtgcactgtaaaataatataactattcttaagattgtctctcagcttagagttttcggaggcttaatggtgaagaacttaaaaatctgttttcctatgactgacatctgtttgtgattatccatttagcagacggtgatccctccaggctggcctttgtttacaagctatgcctaagaggcagctgttggtggagggggaacaaaaacaaaaaacccaaaactattatcttaataacttatagaggtaatcattattgaacaaaagcatgatttggggactatggaaaggcttattctttccatataaaatgatcagcgaaaaggtagaaaaattaaacagaactgaaataattgctattgattgctcaccgcctggatgcactgagtagaagagcaaaggcaatgggttcatgtggaggggatggaggtggagaggctaagcctgagtgagattaccaactaatcaggacttttaacccaaaaatactatggctctgaggggcagggaatgagagacctaaattgacaaaatgcagagtaaaaatattcagtgtgagcagtaatgagacagttgtatcagggtcaaatacggagttggcctggatgtcctccaagctcctttccaagcctaagattctgtgagtggatgaacaatcctggtcctgctgctcttgccactggaacctgatctatttgccttcattatttgaggtctccccatcatcaggctctttgttgtctgctgcttcagggtgtcttctccccagatttctcctgttggtgagcttttccattgaactggagctcctcacaggcaagaagcacacctttaaggttctctgagtcccaagttcctagtgcagtacctggcaatacacataggtgcttagtgggtgcttgccgaattgttgaatggatttatttgatgaaatgtcaggagaatcaccagaaatgaaatgttcgtgtaatggacagggggaagtttgaggttgatttgaaaaaggagatggtagagacagtattatgggtcatgcttcagagtttatttgctttacaatacattggacagcaaccagtagattgttgtgtgtcattttaattccacatgctaatgtccaaatatgtcatatgtcttaattgttgcatacgtgggttactctgtaaaggggcaactgtagtatcacctcctcatgccacaccctgctccactgtagctgggctcgataaccttcaaatcaactcacagaattccaggacagacaagagcatctgaaaggttatctagccccagtcacctctgatgccttccagctgtctctaacacacctgtgggctgacttccagttcttagtcttcacggctccctatgatgaactgcccctgctttgagggattttcctccattgcctcagaagtactgccctgggggagcttctgatgctcttctgaccaccttgtctctgcctttttcactagtcctctgttcctgctctccaaattttgggacgttcctgagttcagatcttttctttataatctttcttttatattctccccatcagatggttcattcattcctcaatattaactaacatttccatattagaaataacttccttatctttagccctaaattttgtcccaaactctggacctacaattttttggaatgcttatgccttgcccagactaaaaccaaacttactgtcttccctctaaaatcagctccccatcttctatttctccctgccacccttcctcccccatggctccaatattgtcttgccagtctggtcttaaaaccacagtcaatcttgttgcttttctctttgtctcttgtgcatggctgatcagcagtcaattgttttgtcaattgtcttatatgtttcttcttcctcttccttgcttcctttttctgacctgaagttagggccttgttaccaaacatctagatgaatacagtgaccccctaattgagaggctgtctaccaattccacccaccctcaattctatactcaaaaaaaaaattagatgtaatctttttcagatactcctttggtattgtcacttagtttttgagtgactgccactatttcccgattggcagctctgcctggcattaagctcttgacattctcaacctaagtgtccagccaagttactctgttcattgtcccctcaacacgcctgtgcatttgcacctctgagactgcttctgagtcagctatgcactgccctttagaatagcttcaaccccaaatcctaccagtgcttcaaaggcccagttcaaatcctacccctctgggaagtctcccttcctttagtcaacttctagggcttttgcaattttatcacttgttttacatcagttttactatttttcatgtgtgagagttttaaccttccaattatggtacaatgtctttaagggcaagggccctttcttagaggaaaccctctatgaattctccaatgataaattattctatgaattctcacaactttctaatataaaggcttataaaaagtgggaactcactgtttattgcttaaaaaattgagatttaatttgaacttaaatgctctattaaattgagtagaatagcatcttaaggctactggtagtctatctatgccacagatggtttagagatcaaataattactcatatacctatgacagcagagtactggctgtaagatccccccaaaactcaaatacctattgggtttgtcaggcaacaaaaataagtgaatccagctaggtctaatacaatggaaaatggtaggacctggggcaaactctgcataacttgcccaaaggcattcaaattcagattatgttcagacattgctaattacaattagtgtcttagacacttggcttcaaaacagtggttagttcaggtatttcagatcaattgggtatgcatttatctaggtcttcatggatagccgggctctactagacactgggagagggaagaggcaaatgggataagactggcagtatttaacaaagaatgaagtattttacaaacatgatcctttaggctggttattgttacacaaaggaatgatttgctaggattcttgagatacttccatagaatgtctatgcctcacttattgcacagaccagagaattccataaaagcactggctgtgtcttatttacccttgtatactagagcttggcacatagtaaataccaagtaaatgttttgaataaaagaaagagataattaaagcttcagcaccacaattatttgtatttcatctatcagtttggaaatagatctccacagacagtagaaatggcaagaaactaggcctatagcaaccaagaagtgaaactgctagaacctaccatcatttctgatcctcttgcaaattttgcttgaaaaaaatttcctcattttctgtttacgaacttatcctcagaatttacagatgtttccttgatttctctggaaagatacaacttcctaatgcaattgagtaaattgatacttcttatgtagaaataagcagaataagctgggcaaggtagcccacaactatagtcccagctacttgggaggctggggcaggaggatcacttgaagccagagtttgcttgaggccaggaattcgaggctgcagtgctctatgatcacacctgtgaatagccactacactccaggctaggcaatgagtgagacctagtctctaaagaaaaaaaaaaaaaaaaaaaaaagacaaaataagatcaaaattgagtatgaactgataaatacaaggtagacaagaaatatcctgagaggcgcaatcgttctgcagacatttgcttgggaagctcaggggaggatttatgaaggaggtagccctgagtgagtcttaaaaaatgggtagacttttaccaggcaagatcttagtgaagttagtgagaggagtggtcatataggaattcatgggatttttagaccaaagattaccaccctcataagtgataatgacgatgaatgtgaagaatgtttaccacttgcaaagtatttttcacataccttgtccaagttcccacaagcatttctgttcactacctgtggtttggtcaagagacccagatattagagaacgtgttgatttctagtttctaactccgcccaataacattaagatgaaaatggatagccacataggaacagacatcaataaacatatttagaaaacacaagtgaattttaaaaggggagacttaagaggtggcatggttgtttgaacatgttcgtttttgtctcctggagaaaagtcagcacaatgctcattcagctacataagtgtttctgttacagctctttcagtccaccattcggcaggtcctgaattcttgtcccttgtccagaaaaaatgaggtatgtggacaactggagggtgagcaaggcggagaggagcttcgttgagtgacagaacagctttcaggagacccaaagtgggtagcacttttccataggcaggaaatgagtgttcaactctcagcagagaggagacccacaatggatagctccttaccacaggcaggtcatcccagagaggtgaggagacacaagccaggcacagtggctcacgcctgtaatcccagcactttgggaggccgaggcgggtggatcacgaggtcagagttcgagaccagcttggccaagatggtgaaactccatctctactaaaaatatgaaaaattagccaggtgcagttgtgcacgcctgttgtcccagttactcaggaggctgaggcaggagaatcacttgaacccgggaggcggaggatgcagtgagccaagatcacaccactgcactccagcctgggtgagagagcaagactccatctcaaaaaaaaaaaaaaaaaaaaaaaaaaagaaaagaaagaaagaaagaggagatctgaagtgagcaactgcttcccctagctggtagtcccaatgtctgttcaagtctggctgagtccagggttttgtgtttgtttgttttgtttttttgagacggagtctcactctgtcaccagggctggagtgcagtggcgcaatctcggctcactgcaacctctgcctcccgggttcaagcgattctcctgcttcagcctcccgagtagctggtattacagacacccaccactacatccagctaattttttgtatttttagtagagacggggtttcgccatgttggccaggctggtctcaaactcctgacctcgtgattttcctgcctcggcctcccaagtgctgggattacaggcatgagccactgagcccggtcgagtccagggtttttacaggctcagaagggaggaagagtgtgctgattggcccatgggcagccatggaagggcccagaaaaagcactgtaagttcttaccccaggctgtggactccacccacaattggcaacctggctcccaggctttgggccatccctggcttgaaggttgggtttcaccagggacctaacccctttccgccaaggaacctgtctccctcttgccatcaacatgctgtccatgatgcccaggctgttcgtgccgaggggtgcctgcaggcctgccctgagccaccctcagcccctgctcagcctccctctgtgcttgtcagcacccaacatctggaagaggtcgaggcagcagggggctagtgtgtcagtaccatcctgagcacccacatgcctggccgggttgtgacagcacctaggcttggccacaactttgcttcacccagtagcaggtgccaggagtgggaagaggccagggagtgggagcaggcactttcaaccttgtgggagcaggggacttcctgggcccctgagagtacagagatgcctgggtccagagccactgctgggcagctacaggggtgcctgggagcatgcggttcccaccccgccaactcagtacggggcgggactcccacctgttcttggcctccctggccacacctccactgctgcagctgctctaaacgggcagctgctgccatcactgtgagctatgattgtgccactgactccagcctgggcaacagaaagagacctatatggtatgttaaatggtaatgactgctttgggggagaaaagatgactaaggattgttgggaatgctggggtagggttggagtgctcttgcaattttacataagacagtctcaggagaaaaaacaatgaaagtgtccgggtagagggacatgtacactggcagcaaggtcttcccttagggattggatctgcggaagaggccacacaggcctggaagcaggcttaaggccattcaggctaggaattccagtgtttcaaagacagactgcaatggatggcggttggtaggtcaaaagctccagataacatctctcagccctgcgaacaccttactctcggggagaaggatgggcacagtgggtcctttaaagcatggggtccaggacaggggcctcttgtcttggctgttgaaaaaactgggttttacactgagtgaaatgctgagccatcggaaggttttaagaaaatatggtttgacttttattttttaaaaaccactctggctgcagaatcaactgcaggaaggcaaaactggaatcatagcatccagttgtcagactaatgcagaaatcaccatgagaaatgacaatgactctgaccgatatggaagcagtggaggtggtgagaaatggtcagattctggatatatttgaaggaagggccaatagggttggttaatgaatcagatgtagagtgagaaaagaaaggactcaagatgactccaaggttcttgtccttcacctcaataagtggaggatggagcagaggaaggcaagactagaaggtaaaaatagcagtgagaaggctctgctatggtataagaagaaatgataagaagctgaattaaggtgatggcagtggggtggaagaaaggagagccaccatgcaaaaagtatccaggagggagaattaacaggactaggggatgggccatatttgcaagatgagaaatgcagaggtctaagattctagcttaaggtgggtgttgctactattagcataataggaaaacaaggcacaaagacttttcaaaatttgtccaaggtgttagaggcttacaatttgtaaaaccaggattaaacccagatgtgtctgattttagagcctgagctcttactcattgcataaaccatattttccccagaggaggattagtaggaaaggaagctgctggttggaaagtatctttatagcagtgtctgttcctcggtttgctcaaggggacagtgtgccaggaaagtccccgtggaagggcaaggaagaaggggaagttaaagccagtggcaggtgatccaagaatcttttctgttgctagagctatgttacatgctgtcctttcatgctctaaaaataagagtgctggcaagtgccaggcctgttggtgcagcttaagatgatacctttcttggatatatatgcatctgaataaggaaggctatcttctggtcaagctaaggtatgccatgagcatttccctgtggaaagcacttaattctgttcccagttgttacctgctgtaagatctccctttctaaaataaaaacaagaatacagctcactgaggaccttacatttccctctagctactgactcatttctcttctcctttttatagcactcttcttgagagagttgcctatatttgttgccacatctttacccattctcttttgaacctattcaagctttcatctgtacaaaactcactgatactgtgcttgtcaggatcatccatgacctccatactgctaaatgcaactctcaagagtatttggctctactgatcactcctttgtagcactgtgttttaaaatataggttttattattatttaggtatggtgaggccaatatatcaggaaatgactgtcgttgaaaaaagtatgttgtactcacagatcccaagagaaggggggcacaccatgccacaaagggccacatggggaagcaccagggtcagccaggaggtgggtggggggtgcgcaagatctttattgtggtttcaacaggaagaaatgggtgaagcagggtgagtggatttaggattagctgatataaataatttcagcaggctctggggcataggggctgtccctagtcttctggtacttggccctggggtgattaaggcagttgcatagtgttgggaatgtgaaagcccccaataaatgaggcagttgtgggtatgggctctgaaatgggttggtttgcatttgaaaggtgtgctcatgggcaagtggtttactctctcttagaggttagaattggctaaccctgggagcggcagtcccttcagggtcagcaaggccccaggtgtcaaagcatcagaatacagaaaataaaatgcatggataatacacactgccatttgcctttgtacccttcctttcaatcttctctgctggtgaccgctcttcacaaagatctataaatgttggaataccccatgtctcagtccttgggcactctctttcctatctctctgtaggtgatgtaatgcagatatccatgactttaaatctttaacacttctgcattgatgactcctaaatttacatctctaccccaactgcctactaaacacctccacttggctatctaataggcatttcaaaccaaatctacaacaaacgtaactctttttccccttccttaatttgcttctcccccagccttctccattttaataaacagcatctccattgccttagtgactcaagccccaaacttaggaattttcccagatttccctctttttctcaaactatatatctagcctgtcagcagttcccttcaggtcttttttcaaactatagaaggcctaaacaaaggaaagacatgctgtattcatgaattggaagactaaatattattcagctggctgtattccccaaattgatctatggattcaatgcaatccctaccaaaattccagcttcctttgtctgcagaaatgagcaagttgaccctaaaattcatttgaaaatgtaaggaagcccgaatagccccctaaaaaaaaatcttgaaaaagactaacaaagttggaggactcacactttccagtttcaaaacttactacaaagctacagtaatcaacgctgtgtggtactgacataggatagacatatagttcaataaaacagaatcgagagtccagaaatacatccttatatatatgatcaattgatgttttgcaagggtgccaagacagttcaatagggaaagaataatttcctcaacaaattgtacaggcacaactgaatgcccacaatcagtagaacaaatttggaactaaagttcttatatttaggttcttgatccattttgtttaatttttgtatatggtatgaggtaaggctccaaatttgttcttttgcatgtggacatccagttgtccctgtacaattgctccatttatatttatcttagcagaaaatacagatgtaaatctttgtgaccttgactaggcaatggtttcttaggtattacacctaaagcacaaacaataaaagaaaaaagtagataaattggatttttttacttaaaatcaatttgtgtttcaaaattaaataaaatcaaaattaaattaaaacatttatccttcacaggattctataaagaaactgaaaagacaatgtgcagaatgggaaaaaatatttccaaatcatatatttgataaatagtttggcaattcctcaaaaagttaaatatagagttaccatttaattcagcaattctactcctacatatgtacccaagataattaaaagtatacatagacaaagacttgtatatgagttttcataggaactttattcataatagccaacaagcagaaacaatccaaatgaccatcaactgatgaatgggtaagcaaaatgtggtatatcatacaatggaatattatttagtcacaaaaaggaacgcagtgctgatatatgctacaatacagatgaaccttgacaacattatgttcggtgaaaaaagccagccacaaaagtccacatattgcttgattccatttttatgaaatatccagaataagcaattgatagagacagaaactagattagtggttgccaagggccatagggaaagggaaggggaaataggaagtttctgctaatgggtaaggggttccttttcagggtaatgaaaatgttctaaaattggataatagtgtttgttgcacaactccgtgaacatactaaaaaccacagagtcgtgcacttaaaaaaagtttgtgttttaaatatatatacacacttagacacatataaccctctttcgtatatcaattatactttaataaagctgttgaaatttttaaaataaaattttaaaacaaagaaaaaatatataaactcgccaacagaccacttctcacccctactagcccctctactctaagctatcagcatttctgcaaacacattcctaaccgatctcactgcttgtaatcttgccagcaacctctccctctcagcaatagtctattgcctacaccaaagcttagttgtctcttaatgatgtaaatgaggttctatcattctcctgacccaaaccctccactgcttttcatcacactcagagcagctctgctgttgcctgatttagatgtatggctccaacagatttcccctgaagaaatgattccatggctgataaaagttggaaagcctcctcagtttcagaccattatcagattagctgtgtgctctgtccctttcctcaaccataagaagtccatggataaagaaagcttcagagtaaaggagaaagcatgggaggtacagcaggaccaaggtggggcattcgcagcccccaccctcatcagagccagttccctactctccctgtctaaacctcttagtaagaggtagttcaagagaggggcaaactcaattccagcactcaaaagcacttgactactttgctcagtcaactagcaagtatttattgagaatgtagctctgttctatggagtcttattttcaagtgtcagactcccagacatccagtccaggtaaagaagatggtgtccattattcatttgacaaacaaagttggggttcaagggccagctattgaaaaaagctatggaaagcttcatgagacgtgcaggtaactgccaatatgtgtggttcacaaggactggttcatattcagaaacggccattagaaaaggaagaagaacttctcatttggatttataaagagtgtcttgtttactcttaatttatatcttctcttctccaggaaatcaacctataacttctcctcccagctccactctaccatggtctgtcaccttccccaaatgatttgttattcccctgttttcaaaagtgaacaaagaaccaaagacccagcaaagtttcacaaggccctgagactttcaattgtctatttcagatcaaatacagaacatgatcttcctcctgctaatgttgagcctggaattgcagcttcaccagatagcaggtaagaaaggacaaagggagaggcttaagaaagaagagcaggtggtggttcctagccaaagccaaaaatgagaatgtggccctcaggctgagggctttctttgagaggacgtatgatttctgggctattccaagcaccacaaaaaaaaaaagagtccccatggtggcttatacatgccaatgtccctatctgacagaaacggtgactgagaatattgctccatctattcccactatccagtgagggtaatgacaagaagacaggatcactcagaccatgtaaatctaaactgatacaagagggcaggggttgagttcccttaaaggtgagatgccaagcagctgtccccttcctttctggcagggagagtaaggagacaatggccagggaacaccgttactctaaagataatgtcttgaagacattctgcatattattagttgtttctgtgagtttcttttttgaaaagcaacaatagcagccgttggtcattcataccttaatgtggtttactgagtcttcctaaaacccaaatgaacaatgaaccttaaggctatccctttggacttgaagaaaggacttctattggaggatgagggtgagcagaaagaaaagcagtttcacagttggttgttctcctggggaaggtagttcagaccattcgagggtgtagttagaaccatgagtgcactattttggatgaacaccaggagctaagagagtaacatagaggtgtggacagaggattaagtcctcaagacaatagccccagccccatgggaaatcatctttctgctcatgattgagaaataatggctcccttggcacttgataacctttcgaagagctttctcctccctactagctggttccagatcactcttcacccagtcacattcctctcactcacttgagctgcccagcctggtctggcactagagacatgcacttggggccctcctcaaaggaagaccctgagatattctgcttacttctactctgctcctgcctgcagggccagctaaaggaacttttcatgttttctttgcaaggaaccctgcctggctggcattttagagacaagcaaaaggggcaataacttccttgctacaaaacagcttcaagtttccatagagtgataagggaaatgagggccaaaagacactgttccccatcctgtggcaggactgggggcttcaggagaaaacttggggaatgtgtaacctctgtgggtttgtagcttaaaaacactgagatcctgggttttctgtctttgttttttgccttttctcttaggaaaggagtgagctagggtgacaaggggcaacattttttatccctcattggctctttctacagaggaaggatcttttcttctaagataatcagcacaagacaatgaagataggcactagctcccagttaggtatactaatggggcaaaaggaagagcatttacatttattgaagattcactaaatgccagatactgtgctaggcaatttacatatggtatagttcatttaatcttcacaatgatcattttgcaggtgagggaactagaactcagaaaaggtacttaatttccccaagattacatagttattaggtgacaccggcaagatttcaacaaagctaatgtcctttctactttactgtgctaccatgatgatggtaatcaaaaatggcagacaacccataaatcttccaactttggaataggtttttgcactgaagtctgaatatggatacgtattgaatgtttattctggatattcacagaatcaaaaaatatgtgtaatgaattatgttgctgaattaactgaaaggaaagtaaaaatgtagcgctttctcattttcttcacgaatttggaattcttttctgctttccactatgcagataacatcagttcagacaaatattaaatacctacctaaattagaatgccttctcctcatgggatttttttaaaatcttgtcatttcatgtctctttaattaaagagttttgatttcagaggagggtacctgcaaaagaaaacaacaaaaaaactaaaggatctgagaaataattagtgtttacttctggggaggggaggaggtctgggatgggggtaaaaaggatagtcttatctattatgtatattcaggtttttgttttttacaagaagcatgtattaggtattatttgtataataaaatataattttaaaaatacaagaaatttctcatataaaaatatgaaagtaatcagactgcaacactcagtgcctgagacagagctacagctatcagggtgtccagacagacagaagattacattttcttccttgctccttgtacagccccagacctgcatgcttcattgaaaagaaaagaagatacctgaattaaatcaatgtgatgcttagtaccctatcagtgcacatttcttttctatttttaaattttaaaaataacacttggccaggcgcagtggctcacgcctataatcccagccctatgggaggccgaggcgggtggatcacctcaggtcaggagttcgagaccagcctggccaacatggtgaaacccctctgtactaaaaatagaaaaatattagccgggcatggtggtggccacctataatccaagctactcagctgaggcagaaaaattgcttgaacccaggaggcagaggttgcagtgagctaagatcatgtcactgtattccagcctgggtgacagagtgagattccatttaaaaaaaaaaaaaaagaaaaaaaaacacttatggcggtattctcagtcattacaaataaataaaaacaatccatatgccctggagaatttgattccaggagtaggtctagaagaacttcaactggagaatggatagagaaatcatggtatatttgcagaatatatattatatatataatagatagcatgtgaataaattaattacaaaaacatatgactacatctattattatatagcatgtagataaattacaaaaacatgtaactacatctatgaatcttagagcataatattgagtaaaaaataaataaataaaaattaaggccagaagataacacatagcacaatgtccttttcataaataaatatattgcttaagcataccttatatatagaagataaagcttaaaaagtaaagaagaggccgggcatggtggctcacgcctgtaatcccagcactttgggaggccaaggtgggcagatcacgaggtcaggagaccgagaccagcctggcccgcatggtgaaacctcgtctctacaaaaaatacaaaaattagctgggcatggtggcacaagcctgtaatcccagctactcgggagtctgaggcaggagaatcgcttgaaccagggagtcggaggtggcggtgagccaagatcacgccactgcactctagcctgggcgacagagtgagactccgtctcaaaaaaaaaaaaaaaaagtaaggaagagactgataagcccgatattcaggacgccagttacctctggtgcaggcagacatacatcattagtaatgtgctagttcttagggtaggtggtaggttcacagatgttcattttacttaattaaatatattttgaaaatttatttaaagctttctgttgtaaaatatatcacagagaaaaccacatgaaacaactataaagcttaacattactataaggtgattacttttgtaaccaccacccaggttaagaagaactttgtcagctccccagaaatgcttcacataccctagcccaataaaacctcctttgcaaatactcttcatagcactatctgatatgccctttatttttaccttttttaaattaaaacaaaactttttagagacagggtcttcctctgtcatccatgctggagtgcagtggcccaaccacagctcactgcagcctccaactcccaggctcaagtgagtctcctgcctcaatctcctgagtagctaggactacaggcatgtaccacccggtctggctaattttttaaacatttttagtgatggggtcttgctatgttacacaggctggcctcaaacgcctcgtctcaagcaatcctcctgccccagcctcccaaagcactgagatcacaggtgtgagccatcactctcagcctgccctttattttttcatgaaagaaattgctgaagaggactaaaagaagttttagtaagcattcaataaatgtatgttctttatagtttccaaatcagcaaatatagacatcctgcatttttaaggagatttatatattttattggacatgctgtaatttatttaaccacttccctgttggtagacattatttccattttcttctgctagattaatgcttgaaaaaaatgtgtgcctcctaaagactgtgatgaaagttgcctctgaataaaactcaaacaaatcattaatcattaactctttccttacttgtatgctctttggatgctctactgtgttatctataaaataaagtttgaagtgaaaaattagggtaaaacattttatatcatttttaaaggatatatacatggatgtacttacatatgcatgtttaaatttatataccataacatttattctttttttaaaaaagtcttatgaattttaacaaatgcatagtcctataactaccaccaccacagtgaacatccaggacagttccatcccttgccaaacaaacaaacaaacaaaaagcttcacccaagtcttaagtccaggcacttactgatctattttctgtccttatagtaatgacttttccagaatgtcatataaatgggatcattcattagatatccttttgtatctggcttctttcacttaacataaagcatttgaaattcattcatattgttgtgtgaatcaataatttatacctgtttgctgttgagtatattctagtgtatgtatactatattttgtttataaattccccaattggggcacatttgggtatttcccattttgggtgattacaaataaagttattataaatatttgcatataggtttttttgggcaaacctaggttttcatttcacttggataaatacctagaagtgggattgctaggtcacatggtaagtgtatggtttattgtgagaaactgccaaacctttccatagtggctgtaccattttttcattcccaccagcaagtatatgagagttctaattgttcctcatccttcccagcactggtattcttttctattttttctttttttttgagacagagtttcgctctgtcacccaggctaaagtgcaatgccgtgatcttggcttactgcaacctccgcctcccgggttcaggctattctcctgcctcagcctcccaagtagctgggattacaggcacccaccaccatgcccttcttttgttttgtatttttaatagagacggggttttgccatattgaccaggctggtcttgaactcctgacctcaggtgatccacccaccttggcctcccaaaatgctgggattacaggcatgagccaccacgccctgctcttttcttaagtcattctaataggtgtgtagaagtggttctaacttgcattttcctaatgactaatgatattaagtatacatatatttatatattattttataatcttatatataatatacatattttatatattatatatatattttatatatatatacacacacacacacatatttttttctttttttgagacagggtatcactctgttgcccagattggaatacagtggtataatcatagctcactgcagcctcgatctctcaggctcaagcgattctcccacctcagactctgtagtaactgggactacaggccatgccaccatgcctggctaattttttttttttaattttgtagacatggggtctccttgtgtttcccaggccagtctcaaactcctggactcaagccatcttctcgcctcagcctcccaaaatgctgggattacaggcataagccactgcacctggccttagttaagtttttatgtacttattgtatatcttcattggtgacattcaaatcatttcatcctttgtaattgtatactaaggaattaaacgattgtttaattattgtttattttcttattgtaaggttttaaaaattctctatttttttgagacgcagtctccatcagtcgcccaggctggagttcactgtcgtggctcactacagcctctgcctcccaagtttaagcgattctccagcctcagcctcttgactggctggaattacaggcatgtaccaccatgcttggcttatgtttgtattttcagtagagtcggggtttcactatgttggccaggctgtctcaagcttctgacctcaagtggcccacccaccttggcctcccaaagtgctgggattacaggtgtgagccactgccacgaccttaagagttctttattctagatacaagttctttatcagatattgattttcaaatattcttttgaagtctgtagcttgtcttttcattttcttaactgtgtcttttgcagagcaaagattttaattttgatgaagtttgatttatcaatgttttcttttatggatcatgcttttggtatcatatccaaaaactctttacataacccaagatgtaaaagattgtcttctatattttcttctacacattttgtagttgtatattctatatgtaaggtttataatccattttaatttttatataaggtgtgatgtataggttaagctcattttagttttacatgtagatgttcagttgttccagccccatttgttaaaaaacacccatcctttccccattcaatagcctttgaatcttcatcaaaatcaattagtcatatttatgtgggtctatttctggactttttgttccattaacttatgtgtatatccttttgcaaatatcacacttatatttgttttttttcttacatttttatttcaaaatctaaggacatcttataacccagaaatattttttataccttgtcatgtcttagaggaaagagccaccccagtcttttttcattgatgtttttcttctctcttcgtactccagaggtagatgaaaaccagagggccacaatgaccatggtgatgcctgaggtcattctggggcacagacctcagcctaggttactccacttcgcctatctttagatccaaaactaccctgctgactgctgagataaacaaaggagaataatcaggttggggaaaggatttctatgcgaagacatgtctccatgcagtcctcctacactgagcagagcatgagtcaggtgcttagagcaggattttgtcctaaaccaggaacttcagagttttctgaagaatgtggctatgtaaagcacccccccaccccacccttacttctcaagtacattacgtggcaagtctgaaaaaacttacacttctgttgttaaatgtgggggataaaatataaacttagtttcaagaggaagctatcttgggaggtaatgcaaataattcgttgtgtgtttcctgaataagtgacaggtgctgactaccattgatgcttcattgcaataaaatgcaaagctcccccaagaatttttgaaatgcatcaagctaggtgttctaatctagcaaaaggacctgcatacatgaatttttcatgcttttgccaagtcttttgccctttagtttagttaagggccccacatgaatggaaagcctgtgttgtcagcttaattttgtagttgtggaaaccttccagttttctcctttgtctaataccttcaggagttcaatcctaggttgaagcttaatttaataaccatgtggcatgtaaagtagaaaacaaaacatcttttccttagcatacagcaaaaaaaaaaaaaaaactcactcatggatgtagtgtacacatgccagtggatatatagtcataactgcagtcattggtagcacagaaataaatgtgcattgaagacacagagatgaatttgaattccggttccatgagctaccattctttgaccttgggcaagttgcatcacttctttgagcctcagtttccccatctgtaaaatgtggatagcaacatctacctcgcagagttgctgggaggatcagatgaaatgatgggctagcccagtgtctgacttactgtgtttaagaaatatcaactattacgctacttcccagtgacagtccaaatgcagaccagtgttataactctacttctcaaacattaatgtgcatgcaaatcaccgtgaccttcttaaaatgcagatcctgattccctaggtctggggaaggcttgaaattctacatttctacctagcttccaggtgaagttgaggacaacactttgaaggcaaggtggtaaaagacgcttgcacgtgcaaatgttactttgtgtaactaatggttcgcaatactgtctgcactttagaagctcccaggaaaagaaaatctttaatgatgctgacctcatctccaaaataatgtaattttaacagatccaaagtagtgcctgggcattagtgtgttttaaaagcctcccaggtgattccaatgttagccaagattgaggccctctgcttagtgaatctaatttgcagctgggcttgagaaaaaacctcttcatagaattgtttgcatcagtgtcttgattgcctctgtaacttacaataagcaagaatgtttcaggatttcaaaaatctattgcattgcctaaacctcttattttgtatggagtaatcaagctcaaagtttgcatgtcttagaaactttacttggggcaaaattagaccaagtaacaattaatcttctaggtattctgagctattcagacatatgattcatgtttgctaattgctcttttctcttgtaaatattagctgaaaaatgtcacctgtctgacaagtagcatattttatgcctatcactcctggcacgcattcttacaaggcagacaggaaaaataggaagaaaatggacttttatcaaaggcccaggcagtaaagaggggagttctgctgtaagctaaggggagttccagaggaagttataggcgttccctttcttatgacaagaaagcatagtgcagtaaataaatttgctaaatagattcaacagtctctacccaaagtcatctatttaattcttgttgttatgcagactcagcaactaaccttccttgtaagccccattttcttccctgtttcctgtttatcaaatgtaattaaacaagagaagtattatagaagagtaaaagtagtaggtaattcttgaacttggcatatgattactacatatttgatgaatagttgaatattattcttcaaggacagattggatttggtatcaggtggctctgcattaagttataagggacttaataactcaagtatttaaggacggcttccatcataaagggatctgcccttaagagggtcccattatggagattctgaggtgagagctattccaagtgtgcagtggattaaaataaaagaatcatacaggaaatctctttttacatgccttattccagggtctttgcaacctggcacagcaagtgcagatatgattagcattgttttacacatgtacactcaccttatagccctgcccctgtgcccctcctgcacaaaagaatgctgggcacacgtgaactcctctctgtagaaaggcacattaatgttctagccatggttaaaacagggatagaggcaagccaaaaatgtcggtcatttgaaataaatctcaagtttgtgcatatcactatcaagtgtgctgtgtggcaattaagaatgccaatttgtgtgatcacaggcaagttgcagtttgatgaaaggaaagcagaggtgaatatataaccagggtcatcctttctttctccctctctctctttctgtcatttatttgccaagctcttaactagaacttgctatgtgctaggtactggatatatcaaagcaaactcagcctggtctttgccttcaaagatttgcaggatagtgggaagaaaaacttgaatcagaggacatctgcagtgggaatcattcaagcagcagaaaacccaaaagttacttatactgtgaaatctgatcagagaatggactgtcctggttagtaaaatatcctggaggataaagattggccatgcattccacatatgaattaccactttcccaagaattaaaacatggtacgaaagaaaggaacgaacatttgctgagtgcctactgcctgccagatctaggcacttcacatgtaacacctcgtccagcctccaccacaatactgagaggtagagttcaacctcattttatagataaagaggctgaagctcataaagattaaaggacggactcacagtcaaaggactcctaatcctgagtcagcatttgaacccaggctcacctgtcactatatcctatgctcttccgtatcacattttatactgaaacaacttctggaatagctaatgcttagaagcagctcccaaatatttgttgaatgaatgatttgattgaatgaatgaataaatgaatgaagcaagctctactgaacataatttgatctaatcttctgtgattattcagaaactacttcaagattttcctatacctccatcataatgaatacccattcattaatgatggaagcagcctaattttgtcatttttcacactttattgatgtaacactacctttactagtttggccactccttatgctttttttatagaactatttagatcaattcaacttttaaaaaataaagccacatacccctgtggtagatgaaaaacaagtatcatttgcactggtaaatagagaataggaagaaaaataaatgcagtgaaaataaagcagtgttatcaaatcctacccagatactgttatctacccggaagcttcctgtttgattaaaaggaaaaatagccagtgttagaggtgtggaagtctagttgaaattatatgcaattgaaggattaaaatagaattgaaaagggaataaattcctctctgaataatttaactccctttaggctttgattctgcctcatctaaaatcatcttacatacttctagtggcgtgtccctcacattttggtaaactctgagtggaaactacggattttgtagtcaaacatctgactggctctggattttaactttactaacatatgtcctgaagtgaactgcttggagccagtttcctcaactatataaccataatgacaaaacaggtttcacggtcatgttttcagtattaaacaatatagttaaaagtacctagcacagtgcctggcatagaacatactagatatacattaagtatcagttccatttttcctttccctttattgtcagaaaatagaaagcatctacagtgggcttgtatgatgtggtggttagaaatacctgatctgattctggctgtgcaatcttgggcaagttacttaacctttttgtgcctcatttttgttttctgaaaaaaaggatagaatattattacctaccttgctggcttctgggaagaagctcagtgagacgatgtgttagcagagtgtctgacaattgtaagaattcaacaagtaatagttattattaccatcactggtgagaggaagtgatacctggcacaaaaatatatggattaatcaatatggattgagggaaacaaacctggagaataggatgtgaaggtatttaagtaacatgagctcagaccttgatggtagggaagtcgaaaggaagcattttgttcttatatgacagatgacctggaatgactgcagggcttggggggtcagggactggaggtgggagaggcctctgagagcaagcagtgctgtccaccagaagctcttgctggggtgcccagagaggagcaaagggcagtcagctgcacaggagggaatgtttggaggagagagccacctcagatcagcgggtcaagaatcccactcttgcccagatggatggggcaaaggagaaaaaggattcgccacgggaatgtccagataagacaggtgccttttggaaaatgggggtgagatgggtctcaggttacacttcgtaagaactggaatgtaaagtaaaggcagacaatgacaaaatatcttgttttcttttcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaaggtgagtggtgtcaaggactagaatccatggaagcatctctccaacagaggatctgcaagtcacagaaacccattaaaggtagctcaagcaaaaacaagcaggctgcttttaaggagacagctatttcagagaaaatgaaagcatctgctcggaaataatttttgacatctgagtacaaagcagccgaagtacaagtgaaagggggtaggacctataggaataaaatgggactggaggaagccaggaaaattagtccctgaaatgtgggagggtatgaaaaataagctttgcctaattcacaattctcccatggaacatccctgacttgattattaagatactctttttcaatagtttataccctgaatccagagtttttaaaaccatggtttgccgcccattcatggattaaaatatcaatttagtgagtagcaaccagatgcacgtttcccgccctttaaaaaataatgtatagaagagaatagacagagtagatcagacgacatcacagagtaggactgagtactgtaaaactaatttctgagggacgtgtgtgtgtgtgtgcgtgttgggtcatggtataaattttttttttcttactttggatcataaaaagttacaagtttggaaaacactgctcaaatgcaagccctatttattgcagatgaagtagctgagatccagagaagggaagtgggtagcccaagagagtcccatgaagtctatagctgtccctattcctctggattcagggatctctccactccagcacaattgaaaatctaaatataaagagaatcttcacactcttgtttgttctagaaaaggtgatttgaggaaagacatataacaactataaaaaatagattttgcttgttcattggcttatggtctccaggcttgaatgctctgagataaatgatgccaatatttctctggcctcttcccctcccacgcattggacctcagatggtctgtactgtcttctagagggtttgtgggttttggccccaaaaaaccattaaccttggcagaaagtgtgtgactttatgatctggtacaaagaaggacaaactagagggactggacatgaggatgaatattgtgttcgcccttatccttgggcaggttattttgcctttcataacctcacattttgcttatttgtagaagacgaacaatagtagtaccaaacacacaggattgttgtcaacattgagagagataatgaacataaagaactgagcatggtacccggcatataataagtgtccagagacttggttaaaagaccctcagttgttacaggggcagtgacctcctcacacctcaaccatcaatgagtcaccaggaaagccattagcctagatgtaactgttttctatctttattgcatttcctacatccaggcagcagctgggaggaactctagaacactgaagtttgtctgagttcccttaatgtaaggctgtacattctcaggatgccttgatgtactcgaatatctgcaaccctaaatcaccacctctgtttttattgatctctatctgaatgctgtattaatgggccaggccttctgcccattctctcaaactgagaactgtctctcattcctggggaggcaccctgcctactccttacctagatcagggatttctcagttgtggagagatttgttccttatagtgttggtcatcaaactgggatatttggggattacaaagacttttcaagggatgtatgggcacaggcagttttaggaagtgagttcctagatcctcatcttccccaaatactcgttcccaaaattgacgagcctgacaatgtgcatgccaggcaaggctcttggggttcccctaaaacacttcctcttttaagcctaccactcactcatcatgaatatagtccattgtcccagggtgtaaaaccctctatagtgttaaataaaagaatgattgggaacattgacacctgatggaactgttatgactaaaaacccttttgcaaataatgtggtatctaattttctgctttcaacaaaattgaaggaggcccttataaagttaataactgataatcaaaaatgagtaatttttgccatgtaaatcaggtcaaagaatgaaatggcattgctgtaacgaaactgcttccattcccattgatttactcatacgaacaagattccttagcctttataagctacaaaaaaatgaaaaatagaaatagaattgaggctgaattctattatataaaatcattccaaccatgtcatatggttcttcggattcatgaataatttggaaaagagagccatatccatcttattaagggacacattcccaataaattttcatctttcatgtttaataattatcaatattcataacattttacattttgatcaaatatgtgttaataataatagaaataaatgtccaacaacgatagactggattaagaaaatgtggcacgtatacaccatagaatactatgcagccataaaaaatgatgagttcatgtccttcgtagggacatggatgaagctggaaaccatcattctcagcaaactatcccaaggacaaaaaaccaaacaccgcatgttctcactcataggtgggaattgaacaatgagaacacatggacacagggaggggaacatcacacactggggactgttgtgtggtcgggggaggggagagggatagcattaggagatatacctaatgtttaatgacaagttaatgggtgcagcacaccaatatggcacatgtatacatatgtaacaaacctgcacgttgtgcacatgtaccctaaaacttactgttaaaaaaaaaaattagatcttaatgcagaacaccctgaacatttaaagcttcatagtcacaagagaaaagttttcatttcaatagctataaatattttgttgttgtaaagacatataacgataatcaatacaaaatctgtcaaacaaaaatatgttacattaagataaaattctgtagggaaggtgaaattggaagtgagtttcaatgaatgaaaagaaacaatttagacagagaagaattttttcatttaataatttatttatttttacttagaaggaattgaatagattaggttccttacccaaaaagcctctgttatttgtcttatttatttattctcttttttccacattctccagtctcattccccttttttaacacaggaaattattccagcatgtttcatacatattcttttgtttgtaagagcttatttaaaatatgtaatattgttttagatgcatatattttttttcttgtggaaactatattgtactatatatatatattttagaaatggacacattaggccgggcgcggtggctcacgaccgtaatcccagcactttgggaggccaaggcgggtggatcatgaggtcaggagatcgagaccatcctggctaacatggtgaaaccctgtctctactaaaaaatacaacaaaaattagccgggcgcggtggcgggcgcctgtagtcccagctactggggaggctgaggcaggagaatggcgttaagccgggaggcggagcttgtagtgagccgagatcgctccactgcactccagcctgggcgacagagcgagactctgtctcaaaaaaagaaaaaaaaaaaaaagaaattgacacattaagtttattgtgaaaacatgattacaagcaataacagatataacagcagaaaaaattgtgaagttatgtgcaccttcttttgagatcatttttttgggtatatgtgaatgtattttatctttttttaattgacaataattgtacttatttatgggatacatagtgatgtttcaatatatacaatgtatagtgatcagatcggggtaattagcatatttatcatctcaaatatttattatttctttgtgttgagaacattcaatgtaccccttctggctatttgaagctatatactgttgttaaatatttatatgtatttttcaaggataatgttgtatataaaagataacttcttttatatttagtcacctttggatacatatgtaagagtaaaataattgttttactaaaaaaattcataagatgctgaacattatatgtttttccagtatagaaacttatgaaaaattataagaatcaacttaataggtgagaagagcatactgcatcatacttattttaggaggaatacaagcaaaaaaaaagttggaccatcacctaagagtaggctaccctgatccagggtctctaaaagaagcaagatagatctgaggccccaatgagggttcccatgaatgaagtaggactagaagaaggacatgtttttatcttaaagtgcctgatccatggcataaagcttgaaaatgggtttgtttatagcaccttcgttgatgtctgggcagaaattcttatcaaatataatgaaaagagttaatttcaaaaggacagaacaaattatgaggtggaatgaccggagattctggaagagacagtgataaaggactgtggtttctgaaaagccaggtggcacctacatttctgggggcaatccatctgaggaaggggcgggagcatggccaaagaacagagaggccccaggagcccaggggtctctcagaggagctggggttgagaactggtctgtgcaaaggtttccagacagggttgcagaggaggcactaaaaacaagaacaccaagagccaaaccatcctgaaggcctgggcagggcagggggatgggaagagccaacaccaggaatgggctgaagctgacagaagtacttcaaaccagaaacaatgaatttaaactatgccctaccacaaatagacttaacagatatttacagaacattctacccaacaatcgcagaatatacattctattcatcagcatatggaacattctccaagatagactatatagtaggccacaaaacaagtctccataaatttaagaaaatcaaaattatatcaagtactctcttagatcacagtggagtaaaactggaaataaactccaaaaggaaccttcaaaaccatgcaattacatggaagttaaataatgagtgatcattgggtgaacaatgaaatcaagatagaaatttaaaaactctttgaactgaacgataatagtgacacaacctatcaaaactctgggatacagcaaaagcagtgctaagagaaacattcatagcattaaatgcctacatcaaaaagtctgaaagagcacaaataggcaatctaaggtcacacctcctggagctggagaaacaagaacaatccaaacccaaacccagcagaagaaaagaaattacaaagatcagggcagaactaaatgaaattgaaacaaaaaaaatacaaaagagaaatgaaacaaaaatctggttatttgaaaagataaataaaattgataaccaagaaaagaagagagaagatccaaataatctcaattagaaatgaaatggagatattactactcatatcacagaaatacaaaagattattcaaggccactatgaacacctttacacgtacaaactagaaaagctagaggagatggatacattcctggaaatatacaacccttcgattaaaccagaaagatataggaactataaacagatcaataacaagcagcaagattgaatggtaacttttaaaattgtcaacaaaaaaaaatccaggaccagacagattcatagctgaattctatcagacattcaaagaagaattggtaccaattctattgacactattccatgggatagagaaagagggaatcctccctaaatcattctatgaagccagtagcaccctaatacaaaaaccagggaaggacataacaaaaaaagaaaactacaggccagtatccctgatgaacatagatgtaaaaatcctcaacaaaatactagctaaccaaatccaacagcatatcaaaaagataatccaccatgatcaagtgggttttacaccagggatgcagggatggtttaacatccacaagttaataaatgtgatacaccacacaaacagaattaaaaacaaaaatcacatgatcatctcaatagattcagaaaaagcatttgacaaaatctaacatcctttatgattaaaaccctcagcaaaattagcacagaaggaacatatcttaaggtaataaaagctaactacgacaaacccacagccaacattatgctgaatggggaaaagttgaaagcattttccctgagaattggaacaagacaagacactttcaccacttttattcagcatagtactggaagtcctggccagagcactcaaagagaaagaaataaagggcatccaaattggtaaagaggaagtcaaactgttgctgtttgctgatgatatgatcatatacctagaaaaccctaaggattcatcttgaaagctcctagaactggtaaacaaattcagcaaagtttcaggatacaaaattaatgtacacaaatcagtagctctgctatacaccaacatcaaccaatagctgcaaaaataaaataaaatacttaggaatatacctaacgaaggacatgaaagacctctacaaggaaaactacaaatcactactgaaagaaatcacagatgacacaaacaaatggaaacacatcccatgttcatgaataggtacaatcaatattgtgaaaatgaccatactttgtagattgcaaaagcaatctacaaagtcaatgcaatccccatcaaaatactaccatcattcttcacaaaagtagaaaaagaaatcctaaaattcatatggaaccaaaaaagagcccacatagccaaagcaaggaagactaagcaaaaagaacaaacctggaggcatcacattgcctaacttcaaaccatactataacaccatagtcaccaaaacagcataatactagtataaaaataggcacatagaccaatggaacaaaacggagaacctaggaataaagccaaatacttatagccaactgatctttgacaaagcaaacaaaaacataaagtggggaaagtacatcctattcaacaaacggtgctgggataattggctagccacatggagaagaataaactggatcctcatatcttaccttataaaaaatcaactcaagatggatcaaagacttaaatctaagacctgaaaccataacgattctagaagataacatcgaaaaagcccttctagacattagcttaggcaaagacttcgtgaccaagaacccaaaagcaaatgcaacaaagacaaaggtaaatagataaatagggacttaattaaactaaaaagcttctgcacagcaaaagaaataatcagcagagttaacagacaacccacagagtgggagaaaatcttcacaatctatacatctgacaaaggactaatatccagaatctacaaggtatgcaaataaatcagcaagaaaaaaacaaacgatcccatcaaaaaatgggctaaggacatgaatagacaattctcacaaggagatacacaaatgaccaacgagcatatggaaaaatgctcaacatcactaattctcagggaaatgcaaatcaaaaccacactgcgataccaccttactcctgcaagaatggccataacaaaaaaataatagatgttggcatggatgtggtgaaaagaaacactcttacactgttggtgggaatgtaaactagtacaaccactatggaaaacagtgtggagattcctttaaaaactaaaagtagatctaccatttgatccagcaatcccactactaggtatttacccaaaggaaaagaagtcattatacaaaaaaaagatacttgcacacgcatttttatagcagcacaatttgcaattgcaaatatatggaaccagcccaaatgcccatcaatcagtgagtggataaagaaaatgtggtatatatattatacatacatatatatatgcatattatatatatacaccatggaatactacttagctatgaaaaggaatgaaatcatagcatttgcagcatcctggatggaattagagactattattctaagtgaagtaactcaggaatgtaaaaccaaacattgtatgctctcactcataagtgcgagctaagctatgaggatggaaaggcataagaatgatacaatggactttcaggacttaggggaaaggatggttgggggtgagagataaaaaactccacatttgggccaggcgtggttgctcacacctgtaatcccagcactttgggaggccgaggtgggcagatcacgaggtcaggagatcaagatcatcctggctaacacggtgaaaccccgtctctactaaaaatacaaaaaattagccgggcgtggtggcaggcacctgcagtcgcagctactcgggaggctgaggcaggagaatggcaggaacctgggaggcggattttgcaatgagcagaggtcgcaccactgcactccagcctgggcgacagagcgagactccgtctcaaaaaaaaaaaaaaaaaaaaaatggccttcaccctaagaaggaagaaaccaagggcagaggaaggaaacaatcaaagagaagcaaggcagcagtgaaaagacaactgtacgtttaagcctctaaggcccaaggaaagcatttgctaaaagagccaagtctcagtgtctttttttcccttggggaaacagaagggtgtaagaaaatcggagtcaagaaaatgtcctgagctccgcctgcagtagcgggaagcctaggagtaaaataacacgttttttaaaaataaagaaagaaattattttaaaaaagaaaacaatgtcctgaatttcaatggggtgggggggaggggaagctcctggggattacaaactcgttaacctgctattccttttcaggcaatttaacagatgaattgaaagcagtcctaaaagatttaactgattactagaaacttgcatagatcctctaagaccaaggcatgtaaaactacatttttccatttatttactgtcattatgactataaaacagatactaccatgtatacatttcatctttatttcagaaattacagcattgcttgtaacatatctgtcagacagccagaacaaaccagggaaacagaaaccatttaaacctgtggaaatctaaagctgaaactagtaattcttttaatgagggagactgagaagccaaacagagaacagggaagcaattcagaaattagcaatagcagaaagctgctcctaccactaggctatagtgaaaagggggaaggcagggttaatggagcccagggattaaagtcacttgacagacactggaacccagtgggcctgtccattggtatctggagccagggaagagatacatcttctgctggagaggccacaaaagtatagagcataggggagaaataccttcccttctccctccagtccaccctctagtgttcctgtcttgcttcctattggctgtcacgttcctaggctatacaggccacaggagtctgccttcctgcaacacagagcagagaagaaaaagtgagagatggatctgaaggcaaacagacccaggacacacaaagcacacacaccttgtgtattgggtggtaaaaggtgggataataatacagttgactagatctataacagactgaaaagctagtagttgttgagtcagggacaacgaaggctggctgatggcctcagtcaacttggagacaatctccaagtgctaaggggtctgttattcaggttgtaaggatatagccaacctaactgagcagcagatcatatatttagcaaaactgatcttatgaccttaggttacattaaaaccctggatatttgtgctgcttagataatatctagaatatagattgtgttacatatcctttttaaagaacgtggcaaaactaaactataaccaaagactactatctggaaatgggtctgaagactgtatcttgtgagatatagttaaaggaggtaggcatgttttacttagggttgaaaagactagatggagtcttcccagttatattcaaatatcagaagggttacctgcaataattgctaacactaattgagtgtttactacgttctagacatctaactaattatttaacacccttgttaaggataagtattgctgtatccatttcctaaacaagaaaactgagggtttaagaggtcatataactagcccttggctaaagcctactcaaactgctcagattctgaactcatgtttttaactacggtgcttaccatatgttgtgttactaaactagacaaataccaatgggtagaagctacaaagaggcacaattttgcttggcatgaagaaaatctttccaatggaagtttaacttgcttattgtataatcatggcaaagactgcttctagaggaagtaggagtttccattcatagatgttttcaggcaaaagttatttagcagtttactaatatcagaagaaaaatattactaaagataacaagggacacttcataatgataaaagagtgagttctaaaggaacacataacaatcctaaatgtgtgtccatttaacagtatagcttcaaaatattaaacaacaattggcagacttaggagaaccagtcaaatccacaattacatttgagatttcaactcatctctattacaactgatagaacaaacaattaagaaaatagaaaatctgaacaacacaattagccatcttgacctaatagacatatgatatatagaacatacacccagcaactacagaacacacattgttttcaagcgtatgtggaacaatcatcaaagcaattatctaggagaattgctgtagaaggtgtttttcattgagcaataagtcagatgacttgaatttttggagtacttccgcctcttaaattctaaaatttactcatcttttcctaagaatatcaccctcagtccagcttccccactgtgggaagcgattccttttccaccaccttccaaataagaaagaggctgtggagacatttctgatactgcaaaaatgtaggatgtgggctcctgtcccttccccaaaccttgctgattcttgtagtggaagagctctctctctgtctccctatctgctccctcatgtatcccaagtcaaagcctcagccaagctcccaattcctggcatccctacttctgaaatcacttctcaaccaggacaccaagatcagtttcttggtccaagccacctgcaatagtgggctggaccctcacccacagtactctgctcctgttcttgttctacttcattccccaaaagacttgagagcttacagaaataatctacagtatgatcatataaaatgattacaaaagacattgaaccaagggaaaataagtgtagataaataatacaaaatgagagataaagtgagtactcgaaatacacacttcgggtactgtttgattatgaaagataggccaaagttttggcttcaaggagattggtgagtctaacaggtcaagtccttcagtaggctgcttcagtgtctgaattgccttatcttctactactgctgggtgctcctaagaacctcagagcatattcctctatctgcttatgttgcaccatccctagacatctgcaattacacagagacacatcctcttatggtgattccaattaagaatgcattacaaaatagtaatatgaattttacccacctcatagggtctgcatatcatttaaatgacataatgtattatatgtattatgtatatttatacattagggggaaagatgtcagagctttttgggacataccaggaggcccagctgggtgtgctgaccacatggagacgagaacttcaagggagagccaaagtgcacgcaggttctggtggatgtttcattgtgcagtgaccctgctctctagtgaacccagatctagtgggtgttgtttgctataatgaatcaaattgtcaactcttaacattgagacccacaacacaggaggggaacagaggggcaaaaattgtgaagaacggcatgaacattccttctcttccataggatgtaaaaggacgtggcacaaagctcaacacatagaaaacaataagtaaatcatacacatcagatggttttcacatggttgttaccattattttaatgtgaaattgtttttcacaaagtttgtacctatttatacttccaacaatttaggagaaaaaagttgtatcacacctctgcctttacttcaagactacacttacttcaaaaattgtattgaaatttaatttcttaaaagaatatttcctaccgaatggaagccagtgctcatcccctcttcctctcaccaaatatcaacaggtgactttccacactgcctggtaactgcatatggtattgatatttgtttatttttagctattatctaagaccactggaaggtttgttcttgtgtcttctagtctcttggaatatcatgcctattttacttatttttaaagtttttataaggttgtaatgttttattttaattttaaaatttatttttaactggcaataatgtatatttatggggtacaatatgatgttttgatctatgtatagattatagaaagagtcaatcaagccgggcacagtggctcatgcctgtaatcccagcactttgggaggccaaggcaggtggatcacctgaggtcaggagttcaaaaccaggctgaccaacatggtgaaaccccatctctactgaaaatagaaaaaattagccaggcatggtggcaggtgcctgcaatcccagctactcaggaagctgaggcaggagaattgcttgaacctgggaggtggaggttgcagtgagccgagatcacgctgttgcactccagcctgggtgacgagcgaaactctgtctcaaaaaaaaaaaaaaaaaaaaagaataaatcaaactagttaacatatcacatcaccaagttgtttttttgtggtctttatttttttctcttcttaatctcaaaacagagaatgtaaaaaattcatgcttttagcaaatttgaatacagaatgcattaactgtggtcatcacacatggcaatagatcactaaaacatttcctctactctgagactgagcaacatcttccacatccccagcctctgataaccacctttctactctgtttctatgggatctacttttttagatttcacaaataaatgagatcatacattatctgtctttttgtgcctggcttacttaacttagcataatacccttcagttccatccatgttgtcatgaatgacagattttacttctttctaagggctgtaagtattccattgtgtatatataccacattttctttattcattctctgttgatggacatttagtttggttccacatcttggttattgtgaatcatgctgaaatgaataaaggaatacagatatctcttcaacatactaaattcaattcctttggatatatacccagaagtaggactgctggatcatgtggtcattctatttttagttttttgaggacctctatactattttccaaaatgactatacttagatctcagctttcttgaggcagggagccatatctgtttaattcactcagcatatactgcaaagaagcaggtgtgtgtatgaactgtgtgtgtttgtgtgtatgtatctgcatgtgttagggagaagtgcagaataaatatacccaactctttactatgtatagacattatctaggtctttattttttttctcttcttaatctcaaagaaaacagaggaaaggaggaagtaaaaagtaaatttttgcctgaagatgtttggaaaaaataccaaataaagtgagatagtgggtaatctagtgatttttatttttccgtcctctttctggcctccaattgtgaaataatttatagcactgtaagaaagaagccacaaattgtggtagcttggaccactgttgaggtctggaatcagaattccaatgttcaaatattggtcctaccagttataagctctatgactatgaacaaaacactcaacttctctatcttcagtaaccgtccacaagaattgggaatatcaacaatgccatctttattgcattgtaagaattaaataattcaatatatgtggaaaatagcatgatatcagggatatacaatgtgtttacaaatgataaccattattacttaatattgatagtgataattttattcatttcacatggcatgaagtaccaagctctataggaatcagaaaataaagtcttatttctttttcttctctattgtccagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtaagagctgcccccacttcctaggtctatcagttagggttcagacaagaaacagatggcatactcgagtgatttgaggagagtgtaataaagggactgtttacaaaggtgtgatcaccatttggagaaactacaaaggatagtgcagaacactggggcttcaatgttgggagggcaattaccactgttggagaagttactggaatcagaagggagctgtagggaaagccccacttcccaggagctgtagccacagaatagggaagctgccacatgcagcgactccaaagggtggaaactggatgaatgaataccccaactcattctcctcccaccctccaatctcctgctagcacctcccattggctgaacccagctagaagtcagagaatacaagggtccactgttgtattccataaaagtcaacttctcagggctcagagcaatattgacatgtacagaatagatctggagaggaaacagaaaatatctagtacaatagctaatcactgtgattcatgcacagtgtcatgagccagcaggatgaatattcctttgctgtacttgctgccagtcagctggttatgggtttttccaagaaatttggtctctaacaaaattcttcagagcctttactgactatgctggatatttttggaagggatcccatacttttgaacttcatacagcagaatttcaaacaatcttgggaaaataacaacttttatctgcccagtaaggacaactaacacctagtatcataatcatttcgtaagagacaggtaatttcatcaccgagtgcatatgttttctaatgctcttatatcaaattaccacaagcttcacagtttaagacaacacagatttattatctgatacttatggaggtcagaaagccagacttgagtttcactgggctcaaatcaaggtgtcagcaggattgcagaggccctaagggaagattccactttcctgtcttttccagctgctagaggccacctgcattaattgcctcatggcccctccctctatcttcagaggcagcaaccctatcattcagccttctgcttctgtcaccacatctctctctctctcttttttttttttgagatgaagtcttattctgccccccaggctggaatgcagtggcacgatcccggctcactgcaacccctgcctcccgggttcaagctattctcctgtctcagcctcctgagtagctgggattacaggcacatgccaacatgcctggctaatttttgtatttttagtagagatgggtttcaccatgttggccaggctggtctcaaactcctgacctcaggtgatccgcccgcctcagcctcccaaattgctaggattacaggcgtgagccatcatgatcagccacatctctttccctaactagcttgcttctctttgccacctcttaaggacccttgtgattgcattaggtactccatccccctggttatttggggtgatcttcccatctcaaggtccatcttcaaaattccttttgccatgtaaggtgacatattcacatgttccagggattagaatatggacatctttggggagagccataattttatttatcctactgagaagggatatactctcagactaaaggacagtccctagtactgattcaatctggctttatagaaaattcactatattgtcattgtatttcacagtttgccctttgtcttagctggtaagacagagcctatgataaggacttgtgtggcatgcaggtatttaattggcaaccccagagggcagaagcaagagatttaggagtttaagagagggtaatataagagtatattatcaaagttgtagtgtggacaacagaaactcaaatattcaaggaccagcatgtagacagcctcctaagatgtctactcagacaaagaatttcaggtggaaggacttgttcatctgcttcacgcccattggttgacaggaatatgaactccattctgctgctgggctagacatgcatgtgggctgagtgagctttccccagtatccgtagcatcagaaaagtcgcagggcagaaagaaaagtatccaatttgaggtgaattactgaccttgaagtgagtgtaagcctaactagaattctaccccagctggctgaagtgaaaggtgaggctgagaggaaataaggcaggactgcacagtccccaattgtactgttcaaatccactcatgcccttcattaagtcagctctgccactgagccttccagctgggaggcagccacaatctctgcagaagatttaatatacaccagtttgtggaacaagctgtagttcctgctgctgctgtggatcccaagccacagttgatatttgttgtctcactcatccaccatacattccagatttccctcacctaacaccccagatggaatggtttctttgcctgatagggtgacccagacttaacgaccctaagagatctgagcttttgatcagcatgcccttaacagactggggttgttgcaaatatcttttcattatcactggatatggaagtaaaaagaaccagtgaatcagcggacccctgagttccagacatactcttccttgtctccattatgtagcagtgttcaagattttcatgataatcaagattgatttctccaccagtatggtaatttttttctttgctcactggtctgccaatattaagagctcaaggtggccaggccagtagcagagctttagatgcagtagaacaagcagagtatcccctgctagaattccccgtaggaagccagacctttgattcagcagagcctaaatgtgtggggttgagtgaacttctatacgtgagtcattagaagtaatggtgagaggggccaacctgcagcactgggatagccctggtacagacgtagaacatgcttgaggaggttgtcaggaggaaatgagttagaccttgcacagaactaccaccatcaagtacagttggggtgaggcagacatggtatgagttgaggcatcagagatatctgatgctttatgccaaattaaaattaattttttcatggagtgacactgatccacagaccagactccaagaactttgcagtgactaaatacccatctcatcataactttcctggtattttcttctggaaaaaattcttccctgatacagttttcagaggcagctagatgcactgtcatctctccccttttcccacttccctacctatccacaatttactacccaatgccaacactaaagttagcccaacttccttctaactaaattattagtttagaaggaaagagaggagtcatgctaaggatcttaactgaaatcaaaacattagaggctgggcatggtggttcttgtctgtaatcccagcactttgggaggccaaggcaggaggatcacttgagcccagtagattgaggttacagtgagctacaattgtgccattgtactccactccagcctgggcaaccgagtgagactctgtctccaaaaaagaaaaggaaaggggagaggaggggagaggaggtagggaggggaaagaaagaaactagaaatccatcaattttaggaccaacttcaggtaaaaaaatgaattaggcaagttggtctttcaacattctctacctctctttatatcatggttgagaccacagacttctcacctcatgaaagatgaactctaactaattcatactaaagctaaagcctctaaagaggattaaatatgagcaatcccacgagaacttttttcccctggaattgtttattcaactgtcgttcgttatatggaatttcctgcctggttaagtgtaggccagtactttggatgaattgtagttttctagaaagacgcttcttatataagaacctctccagggaaacaggggcctgtatgagatgaattgagaaataactttacaccactgattatgtcagtgttctattctgcatggtagagatgtgaaagggcagactgaccattgctctggaagcctttacgctgtgagaagttaacagtggagtaaaatggccactccactctcttcatggaagccaacatggcttactaaatagtcaacaaccatgggagagacctgtggggtcttcatcagagctcaggatctcctagggtatcactcataaatacagccatcagggagatggagaaatctttgtgcagccagaaattctcaacctggttttacccatccttcccaactttgtattcgtcctactgtttactgacatggatcctctgcttcattaaccatcccttcctcaccacatgctctctgaacttggctgcaccttttctacctccatgccttctttgctcaggtttttccacataaatatcattatttccctctctactagctccaagcccaccctctctctggggcagctcagtcactccagggcacaagggggtctttccctcatcccacattttgagacctactacctggaccatttgtttgccttgtaactatgcttgcctttttaattgctattttattttccatgtattttcattgttcacacaagtcttctttattccacactaaggcaaaagcagagtcctgtgttcataataagtgctcaacaaatgttgggttgattgggttggagattccatcttagataatcgcagtcccatcatgccagctaccagactgtgtggacagccaggtcagagcagccaaatgatattctagcttgtggcacaaataccagcaacaaaataaccaaagtcacacatctgcctctgagttcctggcttctatttctcaagggcatttttaagttgtcttatgactgttccctttctactcattctcataaattgagctgtggactgctgtgacccacaagcttctccggaagtcaatgtataaaacaaacacggaaacgaagagtatggtgggtggagggtactccactgactctagaatggatgactgaacattccaaatttcaagcacaagttagggagcaacagatcattttccttttgaaatagggtttcttctgctcagccagttgttgtattttcattaggaaatggaatgggactacagcacaaaaaataaatataaaaggacccttgtagggctggcagaaaagagaatccttcctaggagacctggaggtgattccaggcagtggttgagagcatgggctctgatgtcagacaggcttaaatttcaaactctctctctattagctttgagaacctaaatatcctacttagccactctagcactcagtctctcatgtgtagcatgagggtgagtagtggtagacagtttatagggttatagtgaggattaaatgaaatgtgcttataaagtgcttagtactcagaaagtgtgcaaacagtaaaaaaaaatggtatatctagcaagttgcatgccttacttgtgagttcatgaagttgtggcaaggataagacaaatattttttgccattgcatcattatatcattgctaagagtatgccattattggccaggtgcggtggctcatgcctgtaatcctagcactttgggaggctgagatgggtggattgcttgaggccaggagttcaaaaatcagcctggctaacatggtgaaaccccgtctctactaaaaatacaaaaaattagccaggcatggtggcaggtgcctgtaatcccagctactcaagaggccgaggcaggagaatcacttgaacccaggaggcggaggttgcagtgagccaagatcatgccactgcactccagcctgggcaacaagagggaaactccttctcaaataaataaattaattaattaaattaaagaaacgacaaaagagtatgcaagaattttaaaacaacttagaggaatatgtatgaggatacaggctaagctaccataatgaagagacctcgaaatacagtgagaagcgagacagaagtatctttcgttccatgtaacactcaggtggttcagagcagctaagcagctatgttccatagagtcattcagtgatccagattattttcatctgttgctctgccattctccaggatgttgtccctataaaattgtcaaagctcagtcagtgccaaacccatgtttcaaccttcagaaagtaaacgagtggtggaaaacacattcaatgttttaaggccaagaccttgaaaactcactctcttagcctgaacttagattacatggctgggcccacttaactataggggaggcttggaaacatagtctctgagaagccatgtgtccagctaattccctaatactaaagttgaaagaaagaatggattaaccagcagtataccacaaggtaacaaatgactaggaggatcaggctaggtggactagaaaagagacagtcaattcagtgcaacaattccatattggcacttttcatgtagctgttgcttggctctatctagagaggactcagaggtagtttagataaggcctttgccctccaaatacagtctaagcagactgatttcctactggatgttcaactttggagtcttcagggatgagtagggcttctgtacgtggaagagactatgagggaacctgcacaggacaagggtttgcataaagacactgaggtagggacctctcctgttgtggggacagtgagaggcccaggtctccttgactcacaaagtgcttactaagcacttactagaaattaagaagcagattataatcaatatgggttatccaatgtttggatgagcaaggctccttatcttttcttcgttaatgttaatcacactcttttggatggagacaaatatctgtgggggctgagctttgggtcagatagatctgggtttgcaatcctggcattgacttttacttagcagtgatgacctcacatagattatttagcaactctgagacttacttcctcaactctaaaatgaggggctcagactaaataatgtctaatctcttctccagtaaaacaatccgtggttctcagatagcactgtgctggaggtagtggggtttgagggctgggaagttgggaggactgagcccttcccgctgagcagtttcgtccagtttttcctgtaccagcctgtcatgtttattccatgtgaatgactccagaggcaaaattcaagcttttgaatagggcacaaattaacttgagtaccctttcatttccctgtaggtgaacactcctctagccctgccttttgtcagtctggagcccttgttctaatctgtacacaccagaggactttacaaggctttccccagcctccagaattattcttctgatccaccctctactaaactcaccctttcctcagtgctaggacgttgaaaaaccgaaacaaggcaaagggccaattgtaataattcacactaaggcatgagtgactaggtttagtatattaacactacctaggatattctatttcttccaaaaggatcctgttaatccttgaaatttaacaactaatggtatagattctaagcactgtgagtacttgtcagtgggggaaagacatttttgggctgagagactttgccactgggaagagagagaggatgaggaggagaagggggatagggaggaaaaagagaaaaaagaaagaaagatgattagatgatagatggatggattgatggatggatggaaaaaaataacatgagagagtggtaaaaagcacagaatctggaaccagactgtatcttagctgggtcacttactatgtaacttagggaaagcttcctagtctctctgtgcctccctttcttcaccagtgaaatggggatcatagcagagccaacttcacagagtggttgcgaggagtggatgagctgataggtgcagagcacttagaatagggcctggtgtggagtaaatgctccacagagctagccgtgttggctgtcacccactcatgtggccagcctgttggtctacctcttagttgccatgtaacaggattctggtgcttttcctttgcccaggtcagatggaacccaggacccatccaacttggctgcttcacattttcatccccttctgcatcattgctttcattttcatagccacagtgatagccctaagaaaacaactctgtcaaaagctgtattcttcaaaaggtaagtgagttttattcatggtaacccaatgcactgggtgtctgcagcatgagccactgctttgcactgcaggcctatggcttgctgctttcatgctaaacccactcagagcttatgaaccactttgagcttgtcttgatgattatttttccccagaagaaaatggctctcatcgtcagtgagctgaacttcttacactgagttttttaaagggaatgttttgttcttatgtctgaaagagtttgtcttattctttgagccaagagctttcatcagcctcatgagagtgatgttattttggcaatgcagagagctacgtgctccgattttgctggtgggaggttgccaggatcctttctgaggattccttccattttcacccctcttttccccagtctggatatgacctgggttaaacccaccccctctcccaggaatctcaacctcacggttgggtaaggaaaggagaaaggtttgtgaggccatttggggataaggaaacagctggttggtggtgcattaacgtctttcagcagctcccttcgagtttctccttagcctgttgtattcttaccaacacactcctgttctgttgtaccagctgggacagagcatgctgaagcctttcagccctgatttcattgcttcattgttcatgtgtctgtctttggtttcctgggtggagcctgcccacaaaacccccagaatgtatgcaggcctagctggtgctttcctaaacggctcccttgtctgcactcaatgaacttctccaaagatctatacatggcctcatctatagaaagagaaatgacatgtggaaataattcagtaggagtttgcagcagcactatctgaggactaggggaattttaagtggttgttatcttacatttatactcataacttctatattttcatctgccataaaatattgtcatgttctatttgtccattgccctatgtgtgtatgtattcacttgggtgctgaccacaatatttctaactgtagaatgcaaggaattgttgccaaaagaaaaagacagagggagggaagaagatggccaggggagtgagggagaaagagaaaacaggagatggagaagaagaaagatagaaagaaaaataaatgtgggagggaagggagcttcatggtaaaggaggaggtatgtccaacagaacttcgacttttaaatagaaccacttcagagagttgtgtcaggtgcacctcagttgtcttatcttctgccattcttcttttacctctcacacccatacctcagggttcaaggcctggggcctgaggactccttaataacttcagaaatgagcagctgagtgttccgttccagctgtctttgggagaatggaatggagtcacactcaaagatagagtggaaataaatcctctcctcatccttcaccccaatcttaagagtgagtgaggatatcagtagctccgagctgggaggtaaagctcaagttctaactgtgattaggagacctttcttacaaataagaattaagtgaataaatgtgcaaacaatttcttttatatttttaatgaaccagagagaaatcatggttgcctatataacccttgtctccaactcacttgcattcagatctgctttcttacatgtgtctgccatgcacacaaacttgtgtgccatggaaaagggttgagaactgctggtgatgcagacagagctttaaaccagggtcagagggctaggctgggaccttgtgctgccatttgttggctttctgaccttgtacaaattgcctatcttctttgagatggtctttctatctgtaaaaggggaagcagcaagagaaggaacattttacagcttattggccgaacttcactgccgctagtgtggttcaacttggactacagagaaatcttcctaactggtttccctgtattcactcctgctacctccaacttggtctgttctcactttttgctataataggcttttaaaaatcataaatctaccatgtgtcctctgtccagaccttctccatggcttcttattgctcactggatgaagttccaacgagcccaggatggtttgactcatgtctccagctttaactgcatcaccatcaccttcattgtctaaagctctaaccacacaggattttctagtcctcagaggcatggcagtctttcaattccgagttttctcatacaatattgtctcttcttaaaatattttttcttgttgtccacctgagttggagtcatcttttaaatctcagctaagcttatacttcatcaagtctttcctaattctacctccacgcaccacacccattacattaaatccccttattatatgtttccatagcacctacttcttctttcagtatactcagcacacaatcacatgtctaggatctgttttaatagcttggactaccaattaaattgcatcccttttaattttccaattgattcctcaagtacccacatgcccatcttagcaagaagttcagtgtctccctcttatagcatgtacttctccacctcccacaaactgccagaaagcttacttagcccacagggccagtgctaggcagctaggttagtcctccagagggccctggttttgagcagttgctgtctactccggccatgcagaatctctggtccttccagatgtctccatccactgtgcaaaggtaaccttgctggttccgatccccacacagaccacagtgctacaagattacagttcttatggttccccaacacatgctctgtcattggtcccaaagcaggacccctatgggttgatgaggtaggaggaggtccctgccttagccacagctgcacacagccagcctcttcccttctaggccctcatgttgagcctgggacgccagtcctaacttccttctcttcagttcctcttagggccattggtatcctgaatttcttagtccattgcaaagttaagtaaagaagcagcaggcttggtccctttccttccagatggcttcttagctcctgaacagatttacccacctatacctcagtgactagctctgtgtactaaagtgtattgggagggcagccattattggtccataaaaggtcctgcttaccattttcccctaagaggaaccattcaacagtttggggctcgagggtgacctgctgggctctagagaagaagctggcaacttctgttgcaaaataatgttaaattctgcttcatctgcttgtctttacgtttcaagaatacagtaactgtgtttctctgattcaccaatatatgcccagtgtctaaaaaattacctggcatataataaatgttcaatgaaattttaaacattgaacctactatatgcaggtgagtatgctagatctgctctgtccaatataatagccatctgtggctctttttaagttaaataaaaattcatcagtcacatcttaagtattcacacactgtaagtgctcaatagccatgtacagataattgctcctgtattggacagtacagatatacaacatttccatcattgcagaaagttctactgaaaaccactgtgctagaccctttacaaacttctcatttaatttcacaaaaattgcttgtggcaaggagaagtgtctttatgctggagttaagaaagtgaggctcagaaaagttatatgacttcccaaagtcatacagctgggatttgaatacaggtctgtttgactccaaaacttgtggcctatttgttgcaaaagtgcttaatacaaattggttcagtcaatattattatctttgaacaatggaaggagaaagtaagtttcaatccaaaataattgagtgacttatacattgacttgctgagccaatggcaaagtcaagttagaatccagcagaagtcaccagctacagaatctagatctttagaacatgtcttcagatcttcagaacagtgtttcttaaactctcttgtgaaggaacagttatcatcataggctggtaacagttcacctaccagcaccagcccatgaaccagactctaagtggcacagccctagaagattgagccagaattttacagaggtttaaagaccaaatatgctggtttatggttacctgtggcccacagagaatggcagcactaacctcaggcataaatgaggtacccactgaagccaacattcaagagcaattcctatgggttaaccattgggctcctttcaaatgcaaaccctcatgaaagagactacagtgctgaatagagacctccaaattccaggccaagctcaggatagtcatgagggaattactaaaaacctggtatatagggcaaaagcagaattaggaatggactgatttcaggaacccaggcaatggcaggagttgggcattaaatcctaaaagagaatcagagtgggagggaatatgtgaaatcagaggttaagaaaaaagtgaaaacctattcatgattgcaaagatatgaaaccaacctaagatcccattgacgaataagtggataaagaaaatgtggtatatatacaccatggaatactactcagccatgaaaaagaatgagataatgtgttttgcaacaacttggatggaactggaggtcattattccaagtgaagtaactcaggaatggaaaaccaaataccatatattctcacttgtaagtgggagctaagctatggatatgcaaaggcatacagagtggtataatgggcatgggagactcagaaggagagagtagggagtggcagtgaggaataaaaaagctgcatattgagttcaatgtacactatttgggtgacgggtgcactaaaattcagacttcaccagtatacaattcatccatgtaaccaaaaaccacctgtacccctaaacctattgatataaaaaaaaaattaaaagaaagatgtgaaatcaaggaaacttactggtgagcagcatcccattatgtgaacttgtgcttctgaaccagtaacttgagttactttgagccagtatcagtcacttataccttagtgcaaaattaattgatcagacattctgacctggaccagggaaggcaggcagaagtagcagtcaagactaaagcagaaaagggagagctaattctgcagccagacatttcctggattgaatacccaaattagtccctcagcctttaagtgcctgagggccaggagtagacagaggaatggaaagtgtgagacttctttgttcacactctttgcctaggggccagattttgctttatgcattaccatccgaagtcccaggccacagtgaacatttgggcttcgctatgtggatttatttagatttactttttgtcctgccatattttaatctataagccaaacagttttctcattaatcttattccatttctggaatttttccttttcagacacaacaaaaagacctgtcaccacaacaaagagggaagtgaacagtgctgtgagtaagcatgatttttacttttctttcttactttcttttctctctcagcttgaattttaaagtaaccactgttctattaattcatggaaggcaactgaatagttccagcttatagaatcttcctgtttggtagcatttcagcgaagcctcgttcttagccccagaacaatcatgccatcttttgctcggtctatattcctaagcactcctagatgatactgcactggacctctggtctcacatagttagaaacagagttaaaatcgaacagcaaagagaagatattcaactgcgatgcaattgacaatggatgtttttgcaacaaacaatgattaagaagtacattgttgtgggctctgagtcaagagtaatatgggaaaaacacaagtctcttcatgaggttgacaggtttggagctggaatctgtggaggaggaaggatatgatctaggggtcagaagaagtgggttactaaaatcattaagcctggttggatgaaaagcttagactcaggggaagcagcacatgattgtgggggctggcaagtttgaaatgtgtagggcaggccagcagtctggaaacccaggcaggatttctaccttacagtcttgaggcagaattccatcttttctgggaaacctcagttttttgctcttaaggccctcaactgattgaatgaagccaacctacatcatgggagataatcagctttacttcaagttaactgatagcaaatgataattacatctacaaaatactttcacagcaacatatagactagcatttgactaagcaactgagcaccatagccaagatgacacataaaattaatcatcacaggcaccaagagatgaggggggcagtcttggccatatatttggctgaagtaagtcaatttgtcattcctgcatgagcctttataaacagaagtaagtaaccaactactatttggtcattggagttgtccaagaggccagggttctgtctaatacctgttcatgcatgaacatgccaacctagattgcatgcagactaccagttttgggtttttgtttagttcagcaggatttttctcagctcactgcctctcaaactttcagcaacaaaaggacatctgtgatatcagaatctaccactctaagtatttggatgcaatagcaatgaatatctgagtaaatctaggtggggagtgggggcaccctgtagccaaaatgatttaacaaaatcaaaccaaaattttggaaatgatgccttggtacaatgaagagactacttgaggtaggtttgacttatctaatatcttattttctttaccaatacctaatgaggaatttaaatatttctagatagctttggaaaggtcccttaaagaggcaccagcataccactgccagatctaatccccccaaacactgttttcatcatcatcatgtcatctcttgtctctatagatcatatcaaatccttcccagagtttttcaggccttttgacaactagccacatttcactaagccaactcatctaccactcttcaacaaaacttttcctcaagttgagctgctccaccaacaccactgccatgagctcattcccacttctgtggctttgctcatgttggttatttttttggagtgtcctccctattccttcttacttgtcccaatcccaacttttggcatggtctactttaagatacagtaatgagtaactttattattataacaccaggcttctgttctaagacattagaagtgtgtttagactagctcatttaatcctcacagtagccctctgaagtacttactccctgcttcccattttataggtgaggaagaaaaacatgaagaggttaactaacttgcccaaggtatatagctaataatataagggccaataaattgattcagcaatccaggtgtccaagtccagaatccacacccatacactacactctgcttttttaaaatttaattcaatttttttttagagacagagtcttgctctatcacccaggttggagtgcagtggtatgaccgtggctcactgcagcctcaacttttggactcaagctatcttcccacctcagcctcctgagtagctgggactacaggtgcatgccaccgtacctggattttttatttttattttttgtagaactggggtctcactatgttgcccaggatggtctcaaactcctcggctcaagcaatcctcctgccttggcctcccaaagtgctgggattccaggcgtaagccactgtgcccagcctacatacacaacactctcttgcttaatctgtaagactctctcccccactcatacctttttatttttcctctgcattgtacacacaatctataccactcttaagcacatgattacagcgttattttctggctgcttctatgtgtctatattttaggtccacctggtcaatataataaagtgggatattagtgttaatgcaactatatggtatttgatatttgtctttctgtccgtttatcaatgtttcttatagtttattatataataaatttaaaaggtgtctgattttgaccaaatttgactaaatactaaaaaacaatattaaaataaattttgtttaattttagttgagtctatcaactcaaaaaagaataacgtacaacaataacaagtttcagaacattttttaaattactgattttatgagtataaaaataaaaaataaaaaagtataaagaaaacaaaaataatttagaatccattgcctagaaattgccatggttaagattttaatattgctcaggcccagacagctcagggctttgacattcccacacccattctctgccatcccagttctatctcatcccaaaaccatccattatgaggagagtgtacagctctaggctgcccgggagccatcccgcactctcattttgtgactcggcatcttgggagatggagtcttgggacttagcctggacatgtcccttgcatgtacttcttacaagacttttattcagatgaatattttcccttccaacttaagaagcacagggcttgctggttttgcttcactaaccagcaactgaagcaagacctgacttgtgaaaatgcctaatagagttcagtattagcgctgtttcaccatttcctggatctcttgcctttgtgcacatgatagaattgcacttctctgtgattaatttgtagttaagtgtggtcatgtaactcgctttggtcaattaaatgtaagcataagtgatgcgtgttatttctgggtagaagatgtaagagttggcatatgctttgccatattttctttatccatctggcatggtaaccagtaacattctaggtagtaattgctccatcagtctcagtctctgagtgactaaaattgacagagtcccctgctgaccctcaatgtacatggaacatgaacaagaataagcttttgttttttatattgagattttggagttgtttgttcctacagcattacctagtttactctaatacaacatggaaaaaactggaacctataataaatagaccctacgttgccatttaaacttctagttctgaggaataataatgtggggaaatactttctatataataaaaaaatagaaaattgcaaaataaaaatatacttatgtatcattcatgtcctattaaaaatgttatttatagactcaccatattcccttcctccagaaaaacagaagtaaaaatatgaaaatgcctgtaatcatgtttttggattatggaatcaagtattgctttttacttttatgttttctgaatttttgttgtacttcactacatttttgagtgccctgatgtattactttcaaaaagaagaagaatactttctgaagccatttcaaccatccccactcacctctctagatcccagtaaccaaatacattatataggactcttcatcagtccttatcaagtttaggaagggcgatgctataccttctttaaaggacacctaccaatgtcttagttgcctttcaaagactcctagcacagctaaatgtgatggatatgctctaaggatataagagctgaagtgacttgcataaggtcatatcataacttactgttagaaatggagctagaactcagacccactgagtccttgtctgtgacacactgccctttccatttgtggaagttgttcttgtatctaactttatctgtgctactatttgggcctagccattctccctcttatgcagacaagcagataaacagtaaaactttaggagtggattatgataccatagatatatatcatctatcctttacaaaatagttattacagtcatcaagccttggttagagtttacagaccatgtatcctagctacctcatttcacagattatgacattgggggctaagagatattaagtgacttccttaagtgaaacagtagcagaccaaaagaagtcatgattcccagcatagtgctactcactcatttattcattcattcacccactcacaaacctgtattaagtttctgttatttgcaagaccctgtcagttaggccatgtgggaactagaaggatgaatttatcagtcatccaagattcttacaattaagtattaccgataaggtactcaagaaacagttctcattcacataatttgggttaaaacaaaaagaagccagctttctatatacttttggtccagtctttacgttttttgttttgttttgtttgttttcatgagtatcccgacttccttctaagaacttccacctgagaactgaccacagcgtcagcattccacatgggtgtgtttcctttcccctttcccatttcagtggtttccaatttctttttcttttggcactataaacctttcgcaaaggaaatattagacagaactcctacatgtcaagcaaattaaaatagtggtgaaattagagtggaggacataatcaccctatcatataggctatttgtccatatcatatttgtccctacaaaggcctctaaggcaggggtccccaacctctgggccgcagaccggtaccagtggcctgttaggaactgagccacacagcaggaggtgagcgggagacaagcgggcactactacctgagctctacctcctgtgagatcagcagcagcattagattctcatagaagcgtgaatcctattgtgaactgcacatatgagggatctaggttgtgtgctccttatgaaaatctaatgtctgacgatctgaggtggaacaggttcatcctgaaactatagcctacccccactcccacacccaatccatggaaaaattgtcttccctgaaaccagtccctggtgccaaaaatgttggggaccactgctctaagataccttgtgcttcttggaacatatttggaaaatcatgtagctctcaaattatccctatgtcctgaagcccaccttaccatcaatcctcagaaatacccaacccatgtcaggcaacttcacactttctttcttcaggcagcacagttgtctcagggagggaggagagtgctattagcaagaggagtcactaacagcttcactcacctgtgcccatgaatttttaatggtgtgaaaagtctgtgtattttttatggttctctatggctcatataagagggacaaacaatacatgaaagttcagagatggggacaaatatcactttaagctggggataatcagggaagaagaaagttttcatggagaaggtgacttttgaatcaggaagaaatggaaacagcaaactcttctagatagaggagacactaacaggaaaggcagagaggcaggaaggtgtgggaaagtgcacgtgaccccgttcagagagaaagccaggtgtgagataagggggaaagactgttagggcatgtattgtaaaccactaattccaggcaaaagttagattttacttactaagcaagagtgcttcagttagatcctagcaggaaatggagggtatgcttagaagaggtaactgaggcaagtttaatttataaaggtgtgtgcagcattaagggaaaccagcaagggatactgagcatgccaggatgcaagagcaggcagggaaggtgactattcctaggtctgaaggagaaaggggagggagcagttcccagaaccctagtaaaaatggcaatgagaaaggtccatctggcaggacctatggtctttaacagagggacaaagtcaacccacaacttgtctgggaggttgctgaggaatagataccccaacctctctctcaacccactgcaacactctttttcccctagactgagcccagtcaaagacagagggaggagcccagtgatgcagtctgcaatgtcatcatcctggagcatgaatagagtgcagcagggtgaataatgagtctgcaggaattaatagaaatatctgacacaatagggaactataagaggttttgaataggagaggcccctgaaatgtgctccaatattactgaactatgtgtggcccaaagaatggaagaggaacagctcttgcaataggtctgaggagagaagctgaagacttggactagggcaatggtaaaaactgtggaaagaagttttaaatgaaaagttttaaaccatgcggcttccagctagatgaacttttttaaaaaaattagttcctcactcaaattttggggaggttatatattttctaatcataaaaaatgatttttcttatttgtgggcttttctccccagatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaacgttctttatatattctacttttgggta

SEQ ID NO: 768 - DNA, 78063 bp, Homo sapiens
ggccgggcgtccccgcggcgctcctcgtggggcggggcgcaggcggggcggggccccctctccagccgcccgccctccggccgcgtccccgccggccctgcagacgtggcggggcgggacccgctgggcactcccgcgcgtactcggccgcctgagcggtaagagccccgggcactcggtccccatccccttccccggggggcgggcgagcgcgggggcggctgcccgggggtggtgggaacaccataccttggcgcctcgtccgggacccacgaatcctgccctctgcgttagtgagaagcagtggtcagggaggacccggctctggggtgagggtctggggcggcgcggccgagggacctgcgtgggtgcgggcgtgtgagtgtgtgtgtgtgagtgtgtgtcgctccgggtccacgctcatgcacacacccacacgcccacactcagggtctgccccctcggcctgcgtgaacctccgcggagcctgcctggatctcccaaagtatccagtcctggcaccaagcaagtctggaaaagtgcccccaatggctcggggccaagtcagaggtgggctgcagggtcccccagcccgggcacgaagggagcaggtccctgtaagacagaggcctcgtcccagggtgcgcctgccctcggccttggcacagggagctcaggccttgacctccccgctcccctcgccttactcctcccccaacagccgacccacgccctgcctgctcttccagtccagccaacactctaagcaggcaccgcctccactcgcagcccccgggatgggtcccactccctaccgcagatccccaggccccctccacccagtcggctagccctcgcctctgccatccggtgagtatttccaggcacctcagaccaggcgcctgaacgtcactgccttttcttaagtaggaagacatctctctatgggctgtgagagcattacctatgccctactgatcccatcatttcccatcctaaacatcttgaaggacacaggcaggtggcttcttaaatcagtgtgctctgaactccctgtgacctcagccaacctgtgacaactgagaatgagacaggctctatcctcagagcctctttttgccctctctgcagcctagtggctccttccctaccccacccataggcctgcgtccccgccctcctttcttccatcaagcctgagcttgggaaagaatctgataaacttcttacattgtaacctttaagtgaaggaatgagacgttagggatggatttgaggcacaagtgagacagtgcagaaggaatttgagggttggagggggctttcttgaatctgagcgattcagaccataaaagtaaacttgtctttgtttatttgaccaggcttacatcaaacatggtttctcttttattaatatcaaacacaatgtatttcaattcagtaaatatctgagggacagaaaccaacctaggtgctgttggtcacagtcttggaggacagaatggcagaagtaaatactccataaatacatggaatagaaatctgtgcaaagtgccaaaaacatagaagaggtagcagttatttcattggaagcagtggggcagattaaggaaaaattcagaatgaaaggtaacattagacactgggtgtctagaggaataggagtttgccaggcagctggaggaagggcagcaccggggcagaggaaccagcgtaagcaaaggcagggagatgtgaagagttatggggaatggagaaaagactggtgaggcaggagtggaggatactgagagttgcaagaggtggagagagattggagctggattatgatgggaagtgtgaagatatttacacctaatggtttttgaacaggagagcaaataggtccaaaaatgcctggcagcctcacagagaataggctggagcctgggtacgtagacttgtcaagctttatacaaactcatacaaactgctacaacctgattaagagcctctcatccagagtttttattcctggtccttcgctgactggcactgtttttgttttttttttttaactgggggagatgacctcacacaggatatcatgctaaccaaatttttatgctgccaagtcaggccattttttttaaaaaaatccatccactgtcactatttcataaaatgaaagacattttaataccaagaaaaagcacaaaggctaaacttgaaagatgaaggcagtcctttacatttaataaatttagatttatgaaaaacttgcaatcttgtcctcatttttctctatcatcacagacttgccccagtcctgcaggtggagtttggaaaaaaaagcatccagatcagtttgtccatcctagctttacagaggagcaggtgtaagcacagtgaggatcaagttgtgtgcccacaaagggatactgggaccagaggccacatcccttgacgcctgcaggacacaactctttccacctcagaataccatcgctcccacctctcatcattcctccatgcagcctcatgtcctggcctctcagacacctgtcctgaatcactacagtccatcgctgatgcttggacatttgcacatgctctcatcccaccaggcctgaatcaccacatcaaagacactttcaagattctcccttgcacagggtcagtctagttcaggcacatctgtccttgatttgctgtgctgttttgcatcactttttaactgttttgtgttagctcctcaaacagatgattgatttctgaaggatagtgaccatgtcttctgttttatacttatttttggagctgtgatgttgctgcttaaataccttgcatagttctgggagcattttaggtgatgaatgaatttactcacgaaaaactaacttattcccagcccacaaaggcttctttatatgccacccttcctctccttagagtttcctgaagcagcctccttgtttctgtgggttgagtctccctagcctccagtccacgagacatggctacagtgatcagtgttcctaaccataaatcaggaaaggtttctaagtctggcttatggaacacccagacggagatggaaaccgtcccaggaaacacagtgcttgtcatgactgtaatcctggtggactccagcagcccctgctcagaaacagttctgtatttcaaacacacagtttctagtggtttcatacaaaagggtatagtctgaaaaatgattacatttcccccatcatgatagcatccacagtcgataaagttctaccagaacaaccaaacaaaaaataattttttttcgttttgatttggggaaaattagacctgtaacaagtagagataaatatggattagagatacacacaattagaaattgaattagagctgatcttgcatggctttcttttttttctttctttttttttttttttttttttgcgacagggtctcacactgtcacccaggctggagtgcagtggcatgatcctggctcactgtagcctctgccttccaggttcaagcaattctcatgcctcagcctccagagtagctgggattacaggcacatgccaccatgcccagctaatttttttgtatttttagtagagacaggatttcactctgctgggcaggctggtctggaactcctggcctcaagtgatctgtctgccttggcctcccaaagtgctgggatgtgagccactatgcctgaccgatgaccatttttaaatttaacagatgtaaagatctagtattaataaaatttataaattatccataaatattttaaacaataatctataaatattttaaataataatccataaatattttttgacaatagtccataaatatgttttaacaatgcctgtttaacatcttacagctgagtttctggggtatttctgaagggatggtttgtgttggttgaatgcagaacagccacagagaggagttttactgcagtactttttctacatttgggataaactgacctaaggtaatttggccatcagagataggtaagggctctaggtttcctcctctgcaacttccctaccaagagttaaattaccatgaatccaagttcactgatggaattctgccataaacccacacatgtattagcaaacaggcttagttaaccagtctgttcttataagctcaaggaagtcctagctcactgtccttttaggcctgtgttctagaggcaggactcaactaagcttctagtcaccttcaggctttggagtcctgcattcagctagagaacctagaagaacgctactccaaagggtaagtcagctgctggattcagtgcaatctcatgtcttgggtatagaagcagagaaggcacctgtacgttatttcttgtcgatccacatacctgaggcatctttcatgtcaccagtgaaaaattatttctcatatcccttatgctaattagcataccctggagtgcccatcagagaagacggtagatgaaccctctaaaaagaggtggtcacctcattacggatttttaagtgcttactaaagacccctggatagtatattcctgaataaggcacttcaaatgtcatccagccacccttagggcacaaattaaaactaagtaacatgcacgtgtcacatagtatatgctgaactattttaggatacttcatgaacaagataacaacacatgagggcaaggcttgtacatttaggcatccataatggtttttatttacccataagtgtttatcacagccagatttactctgatgttcctgcttatagaaaactgaaatattttgggacttcctaataatccagattaataataaggattttcaaattaccttacaaagaaataaaaatatcagacaatgtctaccatctaccgatttaaaaaaatgagaataaaagtgatggcaaggtatcatttattcatgaacccattctcctcattgttgtgtccatacgactcatgtgaggataataaattaagacagggaaatctttaggccatggcaatcaagcaaagtcctaggccatgggtaagcagacattttcggaaaccggccagatagtaaatattttaggctttgtgactttgcagcccatatggcctgtgttgcaatgactcagctccgctattgtagtgccagagaaaccatgacggtcccatatgtaaacaaagggtgtatctctggtccaataaaactgtgtttaccaaaacaggcagaggacaagagttggccagcagactggtttgccaacaccctgtcctaggctagtcctgattcagagagaggttttcacaaagattttgtaaacttccaaatgacaacagcctttttagcagcccccatcaattctactcacctcccataaaccacccacaatactaccccttctctatacagtgggtttctatcgttctttactatttcagctaggcttgaacctggctccttgacagcccacggccaaccttgaatatcctaaactttgtataccagctcaagggaagtctgcattcgttgccattcttacatgtagacttgtttacaggaatattatcactgaattcaaggtctggcagatatttttgcttacacaaatacattctaactcaattaactgggaggtgaaggaaaaaagaaagacaatacggaaatgtcaagtcatttggaaccatctgctgtaagagagctcctgagtgtctgtacacaaatattaatctaactcaacaggcatatttgttgagcttcctactatgcacaggaagccatgccaagtactatgtagaatatgaatacaaaacaaggaaggtctttgtctttatagaatttacaaatcataggaaaaactgaagcaactctaatcaaagaggactttaactgtctaaagtaagataaacacaaaatgccctcagaagggttcagaaggaaaatgttcaacctggaggaacaaagaatggaggaggcggttattttaactgggtcttcaatgtgcaaaagaacaacatatggaactaacagcccccgagggtctcttgtggatgtgccaggcattgcacagatatttacactgtctcatttaaggttttataggaaatcgtgggaggtaagcctggtgggatcagagcacagaggtccctggatactagctgaagcatgtggcctcatctcaggagggagaggaaggggaagctcctgaggatgtgtgagcaggagagccatgtaattagagccgtgaggtgaaggatgggaagtaaggggaagagctgcagtgaacaggggaacccaatactgaaatagtcatcatgaaccataatgaggaccttgccatgagaataggagtaaaagaatgtagatagattctcaataaagagcctctaggatttggccactgactgaatgtaagaaaagaggcagatggcattgctgatagggctctgatgtggttcagtctcaaagtcagacacgggttcaaatttcaaatgtagaatttactaaaagtgtgacttctgagcttcagtttcctcgtctgtaaaatggagctgataacattcaactcacaggagataatacatttaaagagcatggatacagtaagcactcaataaatgatagctgttgatactatatattcttgagagggtgaaagcgtggtaaatgacagctctgagttattgggaaaatctatgtgtgagatggtgtctcattatggtttttatttgcatttctctaatgattagtggtggtgtgcattttttcatatgcttgttggccacctatatgttttcttttgagaagtacctatttatgtcatttgcccattttttaatggtttttgttttgttttttgcttgttgatttaagttccttacagattctggatattagacctttgtcacatgcatagttgcaaatattttctgccattatgtaagttgtctatttattctgttggtagtttcttttgctgtgtagaagctcttttgtttaattagctcccacttgtcaatttttgtttttgctgcaattgcttttggagtctttgtcatgaaatctttgccagggccgatatccaggatagtgtttcctatgttcctaggttttcttctagagtttttatagttttgggttttacatttaagtctttagtccatcttgagtttatttttgtatatggtataaggaaggggaacagtttcaatcttctgcatatggctggccagttatcccagcacaatttattgaatagggagtccgttccccattgtttgtcattgttggctttgtcaaagatcagatggtttaggtgtgtggctttatttcagagttctctattctgttctgttggcttatgtgttttatttttgtgccagtaccatggtgttttggttactataaccttgtagtatagtttgaagttgggtagtgtgatgtctccagctttgttctttttgcttaggaatgctttgtctatttgggcccttttttggttccacatgaattttagaatatttttttctaattctatgaaaaacatcattggtagtttgataagaatagcattgaatctgtacattgctttgggtagtatggccattttaacaataatgattcttcctatccatgagcatggaaaatttttccatttgtgtcatctctgatttctttgagcattgttttgtaattctcattgtggagctctttcatctccctgattagctgtattcctacgtattttgttctttttgtggctattgtgaatggaattgcattcttgatttcaccgtcagcttggacattattggtgtatagaaatgctactgatttttgtacattgattttgtatcttgaaactttgctgaagttgtttatcagatctaggagcctttgggcagagactatgggattttctaggtgtagaatcatatcatctgcaaagatagtttgtcttcctctcttcctattttatttcgttctcttgtctgattgctctggctaggacttccactattgtgttgaatagaagtagtaagagtgggtatcctcgtcttgttctggttcctaaggggaatgcttccagtttttgccccttcggtatgatgttagctgtgggtttgtcataaaaggctcttattactttgagatatgttccttcaatgcttagtttgttgagacagaacatttttatcaccaccgaaagttccattgaatagtgctgttctacatgatatcaataatttgtaagctttaaaagagttttctgctttaatggctacattccttatttggtttctacctcacttcttaccctttaagtttatccttgactaaaccatggtctagaccttcatcagctggtccccaacaaggaatactgtgtgtgtataggtctctttctcactgtgaatttctgacaaagatgttacaaagctaaatggcaagtattttttttgataagtgctcaggtattttctagacttattcttttttcttttttttttttttttttttgagacggtctcgctttgtcgcccaggctggagtgcagtgacacgatctcagctcactgcaacctccaccccccaggttcaagcaattattgtgcctcagcctcctaagtagctgggactacaggtgcatgccaccatgcccagctaatttttgtatttttagtagagacagggtttcaccatgttggccttggctggtcttgaactcctggcctcatgtgattcacccacctcagcctaccaaagtgctgggattacaggtgtgagccattgcaccctgccttcctatgcttattctcattattgctacaaatataattaataaagccagagtcaataattttaaagatacaggtattactcttagttcccataggcgtagtctttcatgccaagtaagagctccaggaaagtttaaagatagccctgtaggtttctgttagcttcctatcagtgctgtgacaaattacaactaacttcacggcttttgccaacacagacttattctcttggagttctggaggtcagaagtctgaaatcagtgtccatgggctaaagtcaagttgctggcagcctgattccttctagagtctttgaggggagagtggtttcttttcccttttcagcttctggtggccacccatattccttggctttgggccccttcctttatctttgaagtgcgtcactccagcctctgcttctgtcatcacatcaccttttcctctttgtaatcaaatctccctctgcctccatatgataaggacacttgtgattacatttaaggccaactcagatgatctaaaataatcccctcatctcaagatccttatcttactcacatctgcaaggtcccttttgttatgtaaggtaacactcacaggttccaggaattgggatgtggttatcttgggggccattcattattccagcagtccccaacctttttggcaccaggaactagttttgtggaagacaattttcccacagatcagcagaaaggggtgcgggggagatgcttttgggatgattcaagcacattactattgtgcactttatttctattattattacgttgtaatttataatgaaataattatacaactcaccacaaggtagaatcagtgggagccctgagcttgtttccctgcaactagatgctcccacctggggatgatgggagacagatcatcaggcattagattctcataaggagtgcacagcctagatccctcacacgtgcagttcacaatagggttcatgctcctatgagaatctaatgccaccactgatctgataggaggcggagttcaggtggtaatgcgagcgatggggagcagctgtaaatacagaggaagctgtgctcactcacctgccactcacccactgctgtgcagcttggttcctaacaggccatggactggtacaaggaataatgcagggttggggacccacaaggttacatagagtattggttaaaaaaaagtttgccctggccgggcgcggtggctcacgcctgtaatcccagcacttcgggaggccaaggtgggtggatcacctgaggtcgggagttcgagaccagcctgaccaacatggaaaaaccccgtttctactaaaaacacaaaataagccaggcgtcgtggcacatgcctgtaatcccagctactcgggaggctgaggcaggagaatcgcttgaacctgggaggcggaggttgcagtgagctgagatcatgccattgcactccagcctaggcaacaagagcgaaactccgtctcaaaaaaaaaaaaaaagttttcccctaccagatttatttatccagggctttgaattgaagcttaacaattcgatgaaagcatgaggtgtttataattgtgttgacagatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggtaagaatgggtcattcaattcacttcggcctaagttcttgcttatatctaccgtgtgcagagctagcaccaagctctgtgggtgggaattgggagttcaaaatgtactgtgacatcccctctgtcatcagaaatgtgtagtgagattagacatatataaaaataatttgtcataatatttgcattttgataagtgtattattaacagtaacagccaccaattatcagacacaagccgtgtgccaggcactctgctagccactttctatgttatgtaattcactccatcaacagttcaaacctgggtattactaactccagcttatacctgtggcaaccaggctcagaggtggtagcttgtcctgggctacttggttgtaaatggaaaacattgtaatatcacacatcatgactccagataattaacaagcctgattccaccctaaacaagtcaatgtttctttaagatcacttaaaatctgatgtatatttacaagtccatagtggagatcttcagccttcagatcactgttttatcatcacacatcaccttccaggggaacagaggcagaatgcactcatcacccctcccctttcagtgcctgcacctatctctcagggtatgagataagccagatctccctgttggcacctgggccaccaagaagactatcccagcagggttttcctggagctttcacctccagccatgtggggccgggcaggggtgggagacgccccgcattaaagaaggagacaggctgctctcctcatcctgtctggaatggactgccttctagaagggtggtgcaggagggaggaattggggtcttccctcagccaggcccagccctgttcatcctgaagtgtgccaccacagatcacccccttgaggtgactctgcagcatgatgtgagggacaggaactaaacagggaactaggggccctgggcattcaccctccaatctatcattaactccatgagcttgggccagacaaactaatgtctctgcgcttcaggtttttcctctatgaagtgaagaattctcacatgaagactttgatgcatccttctgactaatgttttatgactcctgtattcaagattgggctaccctcccacccacttttctcaaggggtttgaccctcagaactgtctgcgatgggcttcctcaggggcaaggtgtttcccttcactggaagtgtttaaacaaaagctgaacagtcattttgtagggatgttatggaagcaatttgaggaccagctgggagtttgaatcagatagggtaaacataacacaaaattttgtttatgagtttcaagaggtcgctgaccctttgaagccatccatagatgccctaaataattaagggcccctagaccagaagttctcaacttcagctgaatgttaccaaccactgggggagatttaaaatgtattgaagcctgggcaatgtggcgaaccctgtctctacgaaaaatacaaaaaattagccaggcatggtagtatgcacctgtagtccctgctacttaggaagaggcaggaggatcacctgaacccaggtggtcaaggctgcagtgagccgagattgcaccattgcactccagcctgggcaatgacagtgaaactctgtctcaaaaaaataaataaaataaaataaaataaaataaaatagagtagaatagaatagaatagaatagaatagaatagaatagaatagaatagaatagaatagaatagaatagaaaatattgatgctagggtcccaagcccaaggattctgattcaggaatggggcttggacatcagcaatttttaaaagtaccccaagtggttgtaatgtttggccaggattgagaataattagtttaggctaaagaattttcaaagtcctttttatgattctttgagtaagtggtcttcagtatcattccagctctaaaatgctgtggtgctacaataacacttcaaaagtatctggagacaagccctttcattcttttggctactaggacactttttcatccattgatcttagaacaacaacaatagcaataacagccacaaaacacataggaagtaaaagtgggacattaataagccgcaggtttggcagtttgcatggtattggtgaagagatggaccactagattatgtcaagaatcagcccaaataggaaatggcagagtgaggatttgaacagagtcttcctgactccagagcctgctttgcctccacactgtctgtctcatgtagggagctatggttcccaattttcatcctaagtgctactgttaacaaatatcttggtacagtaagaaaaatataacttagccacaccattatcacctaagatgacttaaactatacaagctctactaattcaaaatccatactaattcaaaatccatatacattccaatttcagacataataattataacaggactgttcatgaagatagcatagtaaggccgggcacggtggctcatgcctgtaatcccagcacttggggaggacgaggcaggtggatcacttgaggtcaggagttcgagaccagcctggccaacatggtgaaaccccgtctctactaaaaacacaaaaattagccaggtgtggtggtgcatgcctgtagtcccagctgcttgggaggctgaggcaggagaatctcttgaacctgggaggtgaaggttgcagtgagctgagattgaggcagtgagctgagattgagccactgcactccagcctgggtgacagcgagactctgtctcaaaaaaaaaaaaaatcagtatgcttctaccacatttgccttaaatgttttggtcaaatggaatgaatcttgctttgaaaacaccttataaacctcctgaatgctacagaaattgagctggttggtaacaggtactccaccttccccaccccctacaacactgacagcatttcaaggaccttggaaaggggagaaattcctaataatagagcaccacggaattacctggatggaagtgcaaacactggccacagagtcgggcccgtggctctggatgtattgtgttgggtcagaagctcagagggaacaaaggagtggggacagtacctgtgagtttgttttaagaagggcaggaaagccgataggttggctgaaagggcctggaagagaggatatcactttcacccaggtcttatttaaaccattctacgtaggtgcaaatttagtctctttttaaagattaccaggaaaggggattctactgtctctcttagtagcttatccttttattagaagtcaattttatgcctagtctttgattattgttcatttttttctattttatttgcctcttgttgcatactcataagaaatcattttgcactgatgaaaacaactctttccctgttgctccagagcagagtgaattgtacaaaacaaattcttgaatctaaagttcattacaaggtggttgtttggattgaacacaggctgcccctgaggaatggcaggttctgcaggaaaatagccaagtgcaaaagcctatttgaccccatgtacatctacacctgataaattctcatcagccctttaaaaaagtttctgaccagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggcgcctgtagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaaaaaaaaagtttctgaccaggtgcagtggctcacacctgtaatcccagcactttgggaggccgaggggaccggatcacctgaggtcaggagttcgagaccagcctgaccaatatggagaaaccccgtctctgctaaaaatacaaaattagctgggcatggtagtgcatgcctgtaatcccagctactcgagaggctgaggcaggagaatcacttgaacccgggaggcggaggttgcggtgagccgagattgcaccattgcactccagcctgggcaacaagagtgaaactccatctcaaaaaaaaaagtttctgtgaggaatgcttgctttactaaaaaaagaaaacgggcagaatagactttgaggacgtacttctaaggcacattagattttgtgataatgcgcataaatgtgtgtgtggtgtgtatgtgtatgcatatatatttgtaagtacctggatctggatccccttaaaatccacatcattaggctcacatttgcctcaggcagcaaggccaccataacttggcagatggggtgttgcgactagcaggtggccagagtcaaggaggaggccacctttctggctggcacctctgtttttaaggaccacaccatttatgcactcggataaactatctctatctttagggcttctttgctttcttgtcctttctgacatacagactcagaagccattgaattgagccttctcctgtaggaacccactctacaacctccgtgagaaatggtcctcagcattggaggttggaccggattctctaaggcctctgccagcatcatgacacaatgcattatgcccagaaatctgggtggtgtaactatcttcaggatgcctacagtctagttgggggaaacattgttgtatgagagcaatgattacatgtcctctagtactagataggacaggcacaagggaggctttagacagagcatttaaattcgtcttaaagaatcagagaagtcttcagcctcaattcaaagatgtttgtcttgagtactggttgggagtaacatttgttcccagagctcttatgggaccttattatatactagccagtcaacccttaaaagacccaatctagattaaatttctctgaattcttaacaccaagaaaggttacccagaatttttaaaatgtcatccctactgctcaacaccaacgcataaggccgattatggagaaggtcaagaatcccaatgttaacactgttgagtactctcatgggaaaacatgggagtgtggaccaccatggatagttctctccctaaaaaaggagaagcagaatgtttaaatgccataaagttatggtcaagagagacaaggagtaggggacacaggctgagacatgacagcatttagcctcctaaaccggatgagcagagttttctccggttctgtttgagtattttccctttttggcctgctctaaaaggacagagttccctactgcctacgttccttattctgtgttccctgaacggtgacacccagttttggcttggacaaccaggtggatggaggtgccattctgccatagagagcagtgcttcccagatctggaggtgtattggaatcatgtggggagcctgttaaaaattcagattcctgggctctaccctaagagattcttaggcacaagatcatagtggaagctgagactctatttttaatgaattcccccaggtgacactcttacagtcagtctgtggactagagtttgggaaccactaacactaggacacagcaagagctagttggggtacggggaataattgagaagatggtgagttcagttggtttttggtttttggtagagacggggtctccctgtgttgcccaggcaggtctgaaactcctagactcaagctcttctctcacctcagcctcccaaagtgctgggattataggcgcaagccaccgcaccggcctgagttcagtattaaatatgccatgcaacatccaagtgaagatactttgtggacagttggttaaaatggtctggagagataggtgattcagaggctatcagcacctatgtggttatttcagtaatggaagtgggtaagatggctcaggtgttaacatataaataacaacagaggccaagccctcagccctggaaggtttctgtctctaagccagtttggttgggcacagctcttagggttttgttttgctttttaaatagattatggtagctagcaaagaatttatagtacaatctcaccactaccacattctataagcgaaatcaagtttcagatcacattgtaccacactgacatttttaaatgaaacggtaattaacaagagagttgaaaatggtgtatgagaactctttctcatgtaggcttgagaacatcccattgtttaggtgctttgatcaccatcttgaatgaaaggtttactcaaggcaactgtctggatttcagagctaaggtttcttccctgatagctggcatcaagtcaccagaattccccagagttgaaagatggatggaagaccatttacacagggcaaaatcctttgtaacaccctattcatataaaactgggaggagcagaaaatatacttaactatttacacatcttgaatacttttaaaaatttttatttatatttatttatttatttgagatagggtctccctctatcgccaggctggagtgcagtggcatgatctcggctcactgcaacctctgcctcccagattcaagtgattctcttgcctcagcctccagagtagctgggactaccggcatctgccaccatgccaagctaatttttgtattttaagtagagaccaggtttcaccatgttagccaggctggtcttgaactcctgacctcaggtgatccacccatcacgacctcccaaagtgctggaattacagacatgagccacaaagcccggccccgtcctgttttaaaaaaatagtctctctctctctctgttgcccaggctggagtgaagtagcaagatcatagctcactgcagtcttgaactcttgcattcaagtgatcctcttgcttcaccttaccaaatagataggactacatgtgcatgccaccacgcctggctaattttttaatttttctgtagagaccagatcttgccatgttgcccaggctggtcttgaactcctggcctcaagtgatcctcctgcctcggcctcccaaagtgctgagattataggagtgtgccaccgaagccagctccttgaatacctttatttttaccatctagaacccctttcagatattgagaatgctagtaaatagtccaccatgtgtaccaattaaaacccatttttgcagttaggtgtggtaattggtaaagcatcagatgttaccagatacagataatagaacctctataaatagctgcctccagagtatggctttcctgattagaatgctggctgaccaccctggactgtgcatattttattggaatgctgacagcacttggattgtaggttaatttgagaagcacccataatgtcacaatatgcatgtagaagcattctaatgtaaataactgaaatcatactaaaagatggtaaaaaggaaaaaaagtgagagtcagaagataggccatcagaatagaacactctaaggcagatgtaaaagtgggtgagctttggatgctaccgagaggtcaagtaagtaataaaaagactaaaatgagtccgtggctttgacaacaggaagccacttgaccttgatgagaacgatttcatgaagtagtggcacaggagtcttgctgtggagggaggatggacaagggaggtgaatacagaagataagcacctttttttttttttttttgagacagagtctcactctgcctcccaggctggagtgcagtggcacgatctcagctcactgcaacctccgcctcctgggtttaagcgattctcctgcctcagcctcccgagtagccgggattacagcatgcgccaccacacccggctaatttttgtatttttagtagagacggggtttcacctttttggccaggctggtctcaaactcctgacctcaggtgatttgcccaccttggcctcccaaagtgctgggtttacaggtgtgagctatggtgcccggccactataagcaccttttttaagagacaaagaagaaagatgtggagcagacaccagataagtttgaaagacacattttgttcatgtcgtgattttcatttgttggctttaagatagaggaatcatgtgcatgattaaatgtaacctatatagaaagcatgtatagaaatgtagcctgggccgggcacagtggctcacacctgtaattccagcactttgggaggccgaggcgggcagatcacctgaggtcaggagttcaagaccagcctggccaacaaggtgaaaccctgtctccactaaaaatacaaaaattagccgggcatggtggtgggtgcctgtaatcccagctactcagaaggctgaggcaggagaatcgcttgagcccaggaggtggaggctgcagtgaaccaaaatcacaccactgcactccagcctgggagacagagcgagactccgtctcaaaaaaaaaaaaaaaaaaggaatgtagcctgtacagggaagcagcttgcatagaaaaaggccgaaaagctaggagagagtaaaaccaacctaaccagatcgggagatgtgtaggtggaggtgctatggtacctaagaggaaggtgcatttccataataatgagagggaggaagtaattgtgaatcgcagggtagtgtacttaatttgtgtttagatgggtttttggtgtaggcctgtgtatattttgtgcataaaaagaactactcaaatgtttaattgggtttaaacaattcgtgttccatctatgaagatgacaaactgaaaaacccaatccttaggcttcacgtgaatctcacaaatctcactgtttagaagtccagcaaaatcaaacagtcactttcaaggtacttttggttaatgtttgatttggtcctttttaccaagttacacacgtttaaatactttaaactgcatttataatatattctacttccttttaaagtacctgaattatctacttatacaaaaccttgctaagtacttaataattgttataaagctactaaaataaatttacagagttgacttaaagactcttaataatgtgcggaaacttgggatgatttcagcttaaaatcagaagtctaataattcaattattcatttttgattgattttcaaaaactgtcactctaataggtcagattccttcaacattagtagtacagaaaagaacaaatatgcccaaaaatatgaatagcgtatcttccatgctttcaacctttctatgtttaatttttaaatcttcccaaagttgaatgatgcatacttaccaaggaagaaaattagctggaaataactgaggccattttcaatcagatattttgacaagagtttcagactccagagcaattttcatcctcccagctgtcatactgaccccctttttagcgtagctatgtcatgagttacaaaaattaaaaagtgttgatcaccctatgagttacaaaactcacaggtttcattgcccacatccctggatacaagttatacgcagcacctgattcttgatctgctcaaggaaatagaagaaccaagttgctccttcagctttaagataagtacatatgttttccatctaaatgataaaggcctttgaatttgatggagttctgggattttacttttttctatctaataatacctttaaacttgatagcttaaaataaatgcattttctatttaatgataaagacctttaaatgggatactagatatgaaaatgtctttcctatttaaagaacgttgaacttgggccaggtgcagtcacccgtaatcctagcacttcgagagaccaagatagaaggatcacttgaggccatgagatcaagaccagcctgggcaacatagtgagatcctgtctctacaaaaaataatttttaaaaattacctaagtgtggtggtgcatgcctgtaatctcagctacttgggaggctgaggcaggaagatcacttaagcccaggagttggaggatgtagtgagctattatcataccacacactccagcttgggcaacagagcgagactctgtctcctaaaaagaaaaaagaactgtgaacttgatggaatcctacattctttcttagtaccacacaaaggtttagatgtttaaatgatttccagttgagttttgaatatcccttttgattaagccaaatctaatttgctgttataagagttatggggagcaggcaggaagctgagagagttctcatctgatggctttttttcctctatgtattaggatgtgaagttgtctatggaaggaggtgggagttatgggggaagggtgagaaaaacgtctttaaatccctctattggtaataggcaatctgagcagctccatgctgcctgttgtagcatctcctaattgtgtgacattaagtccatttaaagtggagaccatattcatgatgagatatatttataattcatgcttaacattttttatattaaatatgtgtatttaatcatttgaatatttaccatttgataacatatttatagctgatcaagaagtcacagctcaatgtcaaaggactttattaataaagcaattgaagtagtcacttattatacagcaaaaagttctagactcatttaacatttatttccatttgctagtcaattaccagctgtcagaacataataaatattataaatttgagtcagaagctgtcacctctaattgtattaactcttcctaatcataggtagtgatttgtcctgtgaaagaatgatattaatcactgatttccatctgtcttcataatggtgtaaaattgctactggattccattgctgaagtgaagtaaatcaatgtagacaccaaaaatgaaagcaggcagtgatgagtcatgaatatttccattcatgttaacaagcttctcattgtttccagacagaaagaaaaaaaaaatgacagctaactttcaaagctttttgcttcttagtcttaaaagcatagtttcttcttattatttctagctcacacttttggagtacttcttatatgccaggcactatgctcgcaacattatatgaattatttcttttgatcttcacgaaccggtgaggttattggttcctatacttatggctcttatgccactattgtttgcattttataatgaggaaatgaaggcttaaaacaatttgagtaacttgttgtccaaaacagtagagcctggagtcaaacccaagcaatttaacttccataactcagtctcaaccagtactctacactgatgggtggcatttgaatcagttaggaatgcttttgagtcaaagtaactaaaatccaacatatagtagttcacaaaatagtgattttttttctctcacttaatacaaagaatggagataggcagctacttatgttggtttagtagctcagcggagccaggaccagtgactgagactccttggcctttcccttgaggcagcaaaaatgactgcttcaatttgaagcttcaggtccacattcagggcagaaaaaagagaaggggaaagagtgggcactcgctgtaactataatgtatcatgaaagcaaaaacttttccatttatatatctcattggttgaaaactgtttcatatggccatccttatctgcaagggtagaaaataacaagggaggctgggcatggtggctcacacctgtattcctagcactttgggaggccaagggggcggatcatgaggtcaagagatcaagaccatcctggccaaaatggtgaaacctcgtctctactaaaatagaaaaaatcagccaggcgtggtggtgcgcaactgtagtctcagctacttgggaggctgaggcaggagaatggcgtgaacccgggaggtggagcttgcagtgagctgagatcgcaccactgcactccagcctggtgacagagcaagactccgtctcaaaaaaaaaaacaaaaaaaaacagcaagggagttgggagttggggatgactaatggaccagctgtgagtcaaaagttatggaatctacaaactctgtaggaattttccactgcctccttactttctttctgcccgcccttccttctttccttccttccttcttctcttttgagtaaaaaagagctatgattctccatacaggtaactcatagaatatttattcttgccttgttttctagaatgtgttcccagatagaaagagaaagctgtggttccctacttgagttaggactcattggttgcaagtaacagaaacacgcatacctgagaaaatggatgagtttcagccatttattcaacaaatatttattaagcattcattatattccaagcactcttctaagctctgagagtatatcagtgaataaaacatttaaaaaaatgaacaagaatatgagagaatctcatagaacccaaagatcagaaagcagcagggccttcagagggacagaaaccagggactgagaagctgtcaggaatccaaacagcagctctaagccagtctccattctgctcactctgccttctcttaattcttagtctgcgtggtggatataacagggtcatccacatagcctgagttttcaacttctgttcatgcacacagttcacactgaaccacagtctctcagttccaattccaaaaacctaggcaaacgaattggaatccactgaggtcagggacagtcttatccctgtgttataggagtcactatgagtgaagcagggcaccttgaatcaaaggtttctaccttgcaagccttcctgtcactactgcccatccatcgccaggtgtattgacgctttttagacactttgcccatcatccatgccaaagcacctgcctactgccccagagtttaaaagttaactctaccttgaagagcacattttttaagccctgtaagaattgcctgggtccagatcattttgaactttttcaaatccctcttgtgccctcatgcgtatctttttcccatgcagccttttccctgtcttctaaataataagagagaatcgaggctcagttaacatcaaactcccttctcacttcaaaccaagccttcagaagccaacatcagcactaatcaatttggttccaaagtacacattgcagtgtggtttgggatattcttttatgacccttataaactataagccaattagatacggttgttggtgattcttttccaaacctcctctttgtttcaaaccaataggtgtttttccattcagagatatactgaatttctgacctgtggctaatttgtttttctccaggctgtggattcccctccaagtggaggaggatgggcaggctggggatcctggggcaaatctctgctgtcgtcagcatctgccacagtaggtaagcattgtatgttgcattggaatagacaaagtaccaaagcctaataggataggacgttttgatcgtactgtatactaatagagtttaacattagcccgtgagcaaaccatgtttagtgcttactattctaagtgcttcatttattcctccaatacatttgttcctcaaaataaccctatatggaggaactgttgtttgctgcactttacaggtaaggaagctaatcagagagagactaagaccttgaccaaagtcaggaatgtctgggttgcaatttaaaagccaagtagtatggcttttagccactatattatatggtcttttaaagtataatatattcttaaagcttcgtgtttatcgtcccacttgaatttttttagtgcacaacgcatctactcccaaaaaggatttgagatatcttgataaaaggcatttcattagcaggatattacaatataaggagaaaacaatgtgctggtagggaggatacatattttatacatcccatggctaatagagtttttgtaattgagtattgacctcaactctgagcttcttggctgccagtacattatttatttctctttgaaaacaaaattttaatttaaataaatatatttttctggttttaaatttttaaagaaatttcctgtatttgttcttatacaaagagaaaatatgatggacagtgtagtgtcttcctgagtgcaaatttgtcatgatattcttcatgttaccatttcttatattctctcttcatgagaactgaaggtataacatcaatatgtctaagataatttagcaaaggcatttcatcttgaaggtggaagataagaagataggggaagccacaggtaacagagttttcacatcatccacttcaggtattctaaggtgcagtccatggccatgaggaccttgcgataggccatgaattggtccacttcactgttactcctaaaaccaggaaggtcttcaggccttttgccccaccccagtggaccatgaccacagtgttaagggccagatatctaacttgacagagcttaggctgcctggaagaatggatagattgcattcctctaattccatctctgtcaaatatcagtttgctcaggaaggctctgggaagaagtagcaatggccaaataaatgttgacctctctggtaagcctggagagcagattttctctattgcttattaaggggatggctatgccttgagtaccacatatgcagatgacaaatttaactaaattcaagtagaggcgcctgttttgttttctgaacaggatgctatctcttcacaagggtgaggacaagcacctgcaggcatcctctgtccttggaaaaatgtttgaacttagtggctatcaaaaggatcttgccactggtggcacttagaagtgacatgctttctaagccaaaaactaaaaaggaggttctaaaagattgttttaattggaataagtcatgaaaaagtaaataatatggtcactaaaattatacagctcttctcgtggtttatatcataaaacagtcatgtgtcctggatgtttccagttttaaccgcatccaaaccactctggtttataatgaattggtggttcgagggttctagtatagatggaggacttactctttcattaaacttttaaatataagttcctgccacagtaaacacagaaatcatctgctctgtggtagcagctataggtgctctctgtgcacacttaaaggtgcatctccctgtaactgctctagccctggttggtcagaccatttgctgttgtttctcattcagtgtctgtacctcatttgactttgggctttgttggaccctcccaaggttttctgtccatgaactgacagctctcccattgaatttactatccagcaccttcttaggtgtcttgctataatctgacctttgcacacatgcagctttggttccagtggatggtgctccaaggcctccgggttttgtcacctggttcacatgtaaccagtagatggcgctgactttactgcttaaaaagtgggatgtggccaggcatggtggctcacgcctgtaatcccggcactttgggaggccgaggtggatggatcatttgaggtcaggagttcaagaccagcctggccaacatggtgaaaacccatctctactaaaaatacaaaaattagctggacgtggtggtgggtgcctgtagtcccagctacatgggaggctgagacaggagaattgcttgaacccaggaggtggaggttgcagtgaacagagattacgcccctgcactccagcctgggcaatagaatgagagtatgtctcaaaaaaaaaaaaaaaaaaaaaaaaaagcagggtgtgatttttcacagcaggtcccttttgacttgatccgacgtcattgtcttaatctgcggcctgtgcttgtgtttggggttgctcttaaagtttctctgtgtctgagccaccatgcagataataaatactgcatcttgttactctcacaacaatttataaattgtgatggttcgcatctggctctgagtaatcattgatccagaagagcctagagaggtaaattcctgtaggccatcatgagcattgtgccagtcacatggtcactgtgccatgaaaaataatatcccgctttttaagtagtaatgtcagcaccatctactggttatatttgaaccaagtaacaaaacctagaggccttggagcacagtccactggaaccaaatctgcacgtatgcaaagatcagattacaaaaggacacctaagaagatgctggatagtaaattcaatgggcgagctgtcagtccgtggatggaaaaacttgccacttttcttctagggtgagtaaacacgtggtttctctgagagtgtatgacatttgcacattcctcatgcaatatcagaatgaagttcagtataccctcttgtattagtttctgttgctatgtaaggaattaccacagttaaagaggctgaaaacaacatgcattcattattttacagtttccgtgggtcaagagttcaggtatgggacagctgctcatgtaaaataatgtgagcttaacaggctaaaatcagggtggcagccagctgtattctcatctgaggctcacttttacctgaggcagcatggccctggggttgacactatgcttgtacataatggaagttgttcctcgcttgcctctctcaatcccaagataatggctcaacatagaccacagatcaggaaggcacccataactttaaagtctctggaggatagggtggtgcagctagaagggggcccagagtcgaagatgaggccagtggctctgccagctgctcagctggcacctctgctttgaagacgtcatctttcagggtcattcacgttgttggcagaattcagattttgaagttgtaggactgaggtccctgttttcctgctgattattgaccagggctcactttcagctcttagaggctgccctcaggtcctccttcaaagccagcaggaaaatctctctcatgcttcaaatcgctaccttcaggaagggcccctttgttttaaagacgctcctgattagttcaggcgcactaaggatgatctctcttttgagtcactgaaattcaactgatcaaggaccttaattacatgtgaaaattctccccatcattgctggatagagtaacctaatcacaggggtgaaatcccatcctgtttacactccggctcacactccaaagggaagggatcacatagggtgtatacatctggggacaagaatcttggggccgtctctcaatacggtcatgcttcacttaacaatgggaataccttctgagaaatgggtcgttgggtgatttaatcattgtgcaaacctccaaagtatacacagacctacacagctaggctatgtggtaaagcctattgcgccgaggctgcaaacataggacagcttattactgtactgaatactgtaggcaattgtaacacaataataagtatttgtgtatttcacacatctaaacatagaaaaggcacaggaaaaatacagtattatgatcttatgggaccactgtcatagatgtggcccgtcgttgaccgtaagtttgtcatgtggtgcatcccgcctaccttaattctcttctcgtctctgtttgagatctttgtcagttacaccaccaattacagaaccttagtattttctatggttctggctacatgctggaattttgaaaagcaaggaaatcttggcatttttctcttgtttgcatacaaaatggcaaagggtacatgaggaaagtcattaaaattttgaaatattgatgctcattctaaaagtccctttggagaaattttagagctgtctttagaaaagcaggtactaaaattgttcatcaccactgatcatcactacccacctcctccccccaaaatgaatgcaatagaagtataactgaaaaccctgcctaaattgctcttactgcatattttggagatttctgatgaggacatgctgtgactttatgtagtaatagtagttaaaacaaaagcaatgtatatttcaaaattggacaagtgtctttgtagacctgtacagaactaaagcatgtagcctaacaggaggctgaagtcatgggttcccaggctggaaacaagcactggtggttgggagtttgactgctgaaaggtaagagggatcataagttgcccacacatggagccaggctcacagcctgaaacaggttggaatggggctcaaagatctgtgaacagagaatttaaagttatgtgtgccttcctgatctgtggtctatgttgagccactatcttgggattgagagaggcaagcgaggcacaatttctgctatgtacaggcatagtgtcaaccccagggctttacagcattagcagtttattatcatcaggcaaagaaacttattggaaaacagatcattcacagtagtagacaagctttgaagatttataaattgcctgtggaaagtaaggaaagaaaataaccacatgttcaattgcaattgatgtctactcagaaacctcatgtatacccccagggtaattccagctgcagacaggggtgcaaaacatatagacattaacaaaacacagagctgtcaattgagcactagaaatggaaaccattacctctaacagttgttgaaaaactgcagttagaatagttagaactgttgagagttggcaggagaataacaggagaatagaaacaattgaaaaatggtaatctcttggaatgagcactgtaccatgagtcataagacctgagacctggtcctgaatgctgctaacttgtgatcacaaggcactgttactaactagctacactgtgcccttaacctaagactcaggttctttgtatggaaaaacgtgggtgaaaaaactggagaaattctaaggtctcttccaacttccagaatatgttgataccatatcctgtgtctatgcatagaaggagaaagatatttgtgcccactgtgctaagtggaaaaatacagaaaattaattgaaattatgtctactctatttttatattttatcttttgcctcaatactctttcactctgaggttaagggaaaatgagaaaaagtgaccttcctaatgcttatacaaaatcaaacatttttcagccaacaattattttggagaggacttaactcttgcattaggctcaactacagctacactgtcatcacattcttagaagatttgatcacctgtcacccatgcctttggacaagtttgtgaaatgaagtaagcttggttattatttccaggcagacacaagaatagaaaacattttagaaaagagggtttttggggaggctgaggcaggtaaatcaacttgaggtcaggagttcaagaccagcctggccaacatggcaaaaccccatctctactaaaaaaaaaaaatacaaaaattagctgagtgtggtgacatgcccctgtagtaccagctgcttggaggctgcgacagaagaatcgcttgagcctgggagatggaggttgcagtgagccaagattgcaccactgcactccagcctgggcaacagaacaagactctgtttcaaaaaaaaaaaaagaaagaaaaaagaaaagagggttttgatagtagttccaaatcccacaggatcttatagacctgacttgcttccaaaatgtattactaggctaagagtgatagaccagtagtcaaaatgaaagtcaacaatgctaaaacatgtataagtatacaaaaggaagagctctatagtagaatacagtaatttatttctagataccaccaaaggcttaaatgtttatttgaaattctagttttgacagttttatgagtttaaacatcttatgcaagagtacctgaggttgggggttggtgtgtacggaatgtacctgatatgtatatttactttttccaaaattatcattgttccccttactcatcctctcccaaggtacatagttttttccttctgcacattttaatgaaactcttctagcagcccggtcagaaatgacagtgtttattacagagaatggcaaacttgtcaaaatgatactacgatgagaaatcatcaccgtataaatcactgtcgatagcgcatggattcatttttgaaggtgacattgctgatgatatgaaatttctcaaggaacattgagacaaagagaataggaataatgcttagagtttgtccatcgtcctttagattctatgaataaaacacaggggttaatgagtttctgttggacttctgggcaaatatcatcagttcagtaacacttcttgtctattttgagcctaaagggaagtaagcatctgattacagagtggacatcaaccatcatatggagaggaaagactattccaaaggaaggttgattggctccctttttgctgcactatagttcgctttggttgagcatggcagtatcaacttgtgcttttctgaacaattgctcttcacaactttttataatatcttgaactcatctatagaagagtctgaaacacagtcagtactttatatatatgagtaatatatatgttatatatatgttatatatttatatgttatatattatatatgtaatatatatgttatatatgtaatatatgttatatatgtagtataagtttcatatatatgttatatatatatatatagacagatatatctatctccattcagtggaatactatgcagccattaaaaagaccaaggtagatcagttttctaggttggatgcccagcagagggatgagtcagaaattgtgtgctggagttttactgtgaagtgctttctggaacaagctttgcaagagagcaaaggattgggaagcaaaactaagccaagggagaagctgaactgcagtgtcgttacagcagaggtcttaacctatcccattgggagcttggggtttgggatgactcttaggagatgtcttccattaatccacagcaccgggcctttatatcaacagctccctcattgaccagtcactatagtatagtcttggtggaaccaactccctttggtcaagggcaattcaaagggaggcatttatttagttgagcgctgtcagtagacaacactcccagaatcaaggagaatgagcactgtgattccaggcagcacatagcacacagcactatctgtgtgtgctgagacttcaactgtgaactgccaaatgggaaaagccaggtccagaagacttatatttaggtaaatatgcttttatattcttgaaaggaatcacaagaaataattagaactgttatctttagaaggaagtctttcaaaagctccaagcattgctttttttagaagtcactcctatatcagagcaaatacattagaatgtacccacatttttcattaaatttcctacacacacacacatatgtaactatgtaggagttgaatttctttgaatgataatagaccagctgatccaatattacattttgaatacatttaagtaaatattaattactatctaatttgcaatttttttttcttttaaagccatcagtttttgcaggccttacttatttccacaggaccttataagctcatacactctattgcttattacgttactggaatctatctaagcagaaagaggctggcccaccttctgttatctatgtttctatactctttggacttgctaatattatgaaatttttattttttaaatctgcacatgaaaacatgctcaacaccactaatcattagggaaatgctaatcaaaactatgatgagataatacctcacacccattagaatgacgttttgaaaatttttttaccactaatatttcagtataagaatgacgattattttaaaaaaaaaaaacagaaaataagcgttggtgaggatgcggagaaactggaacccttgtgtgctcttggtggggttataaaatggtacagctgctgtggaagacagtacaacagttcctcaaaaaactaaaaacagaattaccatatgatccaccaattccacttctgattatatttccaaaagaattaaaggcagggtcccagggagatatttgtacacccatgatcatagcagcattattcacaatagctaaaacacagaagcaaccacagtgtctgtcgacagacgaatggaaaagcaaaatgtggtctttacatacaagggaatattattcagattttaaaaagaaggaaattctgacatatgttacaacatggatgaaccttgaggacattatgctaagtgaaatgagccagtcacaaaaagacaaataccgtgtgattccacttctgtggggcacttagaaatagtcaaaatcatagagatttgagaacgttctgactactggaatgtagaatgatggttgccaggggctggtaaaagaggagagtggggagttattgtttaaatgggtatagagtttctattttatacaagggaaaaagttctggagatggatggtggtgatggttgcataatattgtgaaggtatttggtatctctgaactattcaggtaggaaaagttaaggtggtaaaatgcatgtcatgtgcattttaccacaaaaaaaaaatggagtaaaaattcaaccagatatatcagagatatgatattatgggatttttaaaagtctctttttaatacattcattttttgaaaaagaaggaaaaagagaaagttaaaataagaaaaagaaggaaatattgtcttaaaaaataaaacaagctaaaagggagaaactttcctgatgagttagcgtgggcccttctcgtgatcctttagcatatgggaccaataggaagtagccattgagctatccagtcatccagggtgctgcagagaactgctgttgcttccctgagttaccacttggtcagagagaacttcccagcatattctcttgttttttttttgagctggagtcctagtctggctctgtcgtcacccaggctggagtgcgatggtgcaaactcagctcgctgcacccatgcctcctgggttcaagcgattctcctgcctcagcctcccaagtagctgggattacaggcgcctgccgccacacccggcaaattttgtattgtatttttggtagaggtggggtttcaccatgttggccaggatggtctcgaactcctgatctcaggtgatccgcctacctcggcctcccaaagtgctgggattacaggcatgagccaccatgcccggtccatcatattctttttgcaaattatttcatcttgattatttcaaatagccagcagttatttcatctttccagaaagaggagagacttcccttcaatggctttttgatcctggtggaattcacaagaagagagcttcataagatcacagtgctttgcgggaagaaaaagatcaaagtggatgtgtaagatagccctacacagtgtcttgagaatacagcctgcacagcacagggatgatcctaaaaacactaagctatgccatcactagacacagttgacagggagagggttagtgtcaggtttcaccctggaggtgatcttcaccttgttctttggtcaaggtaaggtaagtcaagtgcattttagaataaaacaatgttttaaaaagtaggaagctccaaaccaaggatctgatttccaaggagttacagaaatgggattaaaatgacatttaatcaactataaatgacacataaaactttcttaacataacatagtgattacacatgtgggttctagagtcagaaggactgagttggaatcctgcctttgtcactgattggctttaggaccttgggaaagtgatttcacctcaccaggtctcagttttctcagttgtgaaatgagtatactaatatcccttacctcataagatcattgagaagattaaatgagataatgtactgtactaaaagtatttagtacagtgttaggacatagtaagtgctcaataaatgtcggccatagcagagatttcacatgtttcttctcaataatctcgcaaaactctgagaggtaatcctcctttcagagaatgcacagccgcagagactcagagaggttaagcagctcaccagcattacacagctcataaatgatgggagcagaaatcctccacaagactcctgactcctaagtttaaggtattttccatttgagtatagatggtaaattaaataccagccaatcattcagcatttattttaaaatgatacattatcgaagcatttgtacgacattctcatcttctttgcagcactcaccttctattgcagtgagccaaagagtagaggatattccatctttagaaccatggagtttagaggggtttcagattttggggatacttggggtttgggatgacacatgaagaaattaatccatgaactgtaccctatagtattattcatatttgttgtttttctcttattagtaggtcccagtcagtacctctggagatgaaatcactcccaatcaaaaggcaacagtgacttcatattattattttcttgttctggacactagatgtcacactaagtaaagttttagaggttactctttagagtaaggtgtggcacagtgtctaaaatcttagctatgaaaaattatagctcatacataaatataaagctgaactttatatttattttttgtttctttttttttgtaaagctgaactttatatttctggtagaatgcagtaaaagggtactttccctaacaaaaaattcagaaaaagaattgttaataagaaaatgtagttggaacagcagcctattttgatgtctgttaaatagatagatcccatttacatgcacataaaatcgtatttccttctagtaacaaagtgatttttctagaggcagctcgtgtatacatatctgtgatcgtttatgttctgagatggcgagaagccattcttcctgcaaaaggaaccagacattatcctaacctgcaagggacggagaaggtgaaagaagagatactgaatatgagtttcattatctcctgaaacagtctcagggaaggatgtgtgatcatctttcttgagtggcttaagcaaagaagacagagaagatggtgcctcccagcctccttgacctcatttttttccttgattttggctctcagaaatctagacgagaatcataggttgagatttggaggcacattatttccttttggaaaatgcatatatatatatttaatggcagggaagttggactcagtatgtaaaagagtaagatattctatcctctaacttaaatgtgttattgaaacttcaataagtttccattgaaatgcttgaaattcattggacgctagagataattaattcaagccttaacagtcgcaatacacctttattttttcaagtaactcagtaattaatttgaactgtgtctaatgatctgcacatgactataaacacgtatttctatatgtgattacagttgtaaataatgtttacatttcagggttttctaggtagtgtataaggacaggtgatttccattggacataattccttctacatttgtcaaatatcagtgccttgttaatgctaagatcactaggataaataaggttacaactgctaaaatgctactctttaggtttgggagtcatccatgtgttcccctttcttattcaggaaatgggcaattggttattttaacagtgccttctaagactaggtggttctagttagctctcaaattctgttgggacttgggacgtttttcctcatattactgccttgtgttttagcaacctgaggtcacccaggtcccgagagaaatctttcattttctccgtgagtgctcgggggatggggagttctgtgatgatggcagcctgtgctgtttctccttcaagaagtcagacagccactttggaccatccgtaggctattcattccttcaacagtttgacaactcagaaaagctatagctcatcgtgaaggcctcaaagggaggaaaatctctccagaataaaatgtagacaagactatgtccgtatcaggtcaaaggttggggtttttccctgtgggtaggaaggtcagctctgtatttaccaaatagttattgaataaccgctctgcctggctcagggaacaagggtattatccctgcttagatggagtaaaacctgtgctcttcgcctgcctgactgctgttaaggttgatttatatcattattaagacaactgtcggggctgttgggtggccttcctggtttctccactgacttgccttttgatttttggatgtcagctccaggaccttcactctccatgcctaaaggaaggcctaatgctttaaagaaacattctgaggctcaggtgatttcaatccaaccaatattaattgatcatctgcaatgtgctaagcctgcaaggaatcaaaaaaatgaatgaagaatatcttccataaggagcttacaaaagagtaaagaggatgagacaggtacactatacaaagactgtgttgagcttagaattccaggttgatagctaggtggtgtgagaagcaaaagcaaacagtgaagcatccgggagcactttacctacgtgtatctcatttgcacgtcacaataactcaatgaggaaactgagtcacagagaggctaggtaacttctccaaggtcattcaaccaggcaggggtgaaactgagctcatattggaacccacatctcagggagcagggattcctctttctttcaatcaggatgtacttctacaggccaggtgcgatggctcacacctgtaatcccagcactttgggaggcagaggtgagccaatcacctgaggtcaggagttcaagacaagcctggccaacacttagtgaaacctagtctccactaaaggcacaaaaattagccgggcgtggtggtgtgcatctgtaatcccagctgctagggaggctgaggcaggagaatcacttgaactcgggaggcggaggttgcagtgagccaagattgcaccactgcactccagcctgggtgacagagcaagactccatcttttaaaaaaaaaaaaaaagaaagatgtacttctgcaacttgaaacagctttgtaagatttggtggaggatttgcagaccgtggatttctaatgtatccatgaaccatatttttatttccaacaggtcatggattgacggcagtcaaggaaaaagcaggagccactctacggattcatggtgtaaattctggatcttctgaaggagcccaaccaaatactgaaaacggagtccctgaaagtgagtgatgtgtctcctctgggtgttcttggactttattacaccatgtgcataatcagaggttttccaagttcagatcagcgacgtgaactcttaaaggatttcttttttctctttagtaacagatgcagccacagatcagggccctgcagaaagcccacccacttccccttcatcagcctctcggggtatgctgtctgccatcaccaatgtggttcaaaacacagtgagtcgctggctgcttcctctctttcccctgtatttcccagggccttcttttgatatttccatttaccagtgacctagatacatcagagaaacgatggccttgctcagaactttggattatggttttttttttaatgttttctgctacaaagtagacgtaaccttggattcaaaataataagggcaaaatgaaatatattttatgtttaaaagaagggagctgtttggaaggaacatttttcagtctgatttaacagtgtcctttccagctgcggcaaggacagcctctggttgaggggagagagaactctttatcagagctgggacagctgtttttcctaaatgctctgcttatcttatccctgagtttgaaaaagcattaaaccgtttaaataaaaagtacccgttacaagacaggaaaaacagcccaaatatgtttctgaagtgtttccagagaccagcgttcttcccccatccctacctcttcattcccacccttcctcctccttacaccaccctaagtgtatccccctagatccctgcctacctcttagaagaagctccatattagcagcaaaacattggtgaataatgaaaaaaggggaggcacctcaactgagataaggcaggtagctggtcatcagggtcagggagcaaagatttattttgttttttcttttgtttttttgagatggagtctcactcttgtcacctaggctggcgtgcagtggtgcaatctcggctcactgcaacctccgcatccctgattcaagtgattctcccacctcagcctcccaagtagctgggattacaggtgcccaccaccacacccagctaatttttgtgtttttagtagagatggggtttcaccacgttggccaggcttgtcttgaactcttgacctcaggtgatcctcctgcctcggcctcccaaagtgctgagattacaggtgtgaaggtgtatttcttactatgtaaactaactagtttttctaaaaatatggctcgtgtctcatttagtcattcattcattcattcattcattaaaagaaaaacaacaacacaaacatgattagccctcactatgttccagtatctatgctagatcttggatatatgctggcaaacaagagggcacaatatcccagaggactgaggcgactgaacaaataaacacaatgtaattcgggaagaggtgagggctgcggtcaaacatgagaggatctcacccagaccttggggtcaggacatgccagaaatatagaaaatgactggtcttctccttgctatttgaggacctctagactggggtgggggaagtaaggaggagcagcaaatctgtcttaggagtcaagtagcaatacaagtcaaccacccccgtggggggtttgtaggatgggagatggatggagctctgtcagtacctctggtataagaaatgaattcacggcctatctgagctaccaagagggcactatgagtttgtcttcagcagcctcacattcctttctgtgttctctccaaccttcttgacccctttttcccaagttccagacactacccctccaagtctatccttaacacaaatccctgtgtcctttcttccaccattttattctcaataaaataatttttcataggatgttagcaggcactaagtcaaattacacagaagtgtgaattgctgctgtcccatcatccccccgaagtgtgcgcactgaaaactgatttacagcatgattactggttggctcccaaatctaaaaacaaagtctaaatacccaagatgaaaataaagtatattaattctatgaaattaaatacttctatttaaatgataattatgaagattggaaaatgcatatcagtaataatatcataataaaatacaatttatatcatttttatatatggtggggaaaaacacagatgtatgcatattataattgcagttatacagttggagtgtaagtatgaaagagttgcaaagacatgtatgcagttctgttcacttgaatagtttatgtgtgagtaagtctgggttattttaattttttaaaaaaagcaacaatgactgacaaagggatttgcaggaggatagctatataatacaccagtttctaaagccagaagtacaaggaaatcaacctgtctcatttcatggatatactaattataggcagttattgctagtttctgagagtatgcaagaaccatctgaaacagcctgagggtcttaccctccagggccctagattaaagaattccctaaattagcaggactgtttgacattttaatagactgctccaagcaactctgttacttgggttaaaaaaatttttaaacagaaacagcaatttattttatgttaattttatgtcttagcaatttattttatgttaattttatgtcttagatacacatccattcatacacagagagccagtaaaattaatccctttgtgggattaattttattttatgtgctttggtttttttctaagcatcagtctttaataacattgtatgtcctacaaattatataacatatgcttttccaaggaaacgagaataggattaaatggatgataaatctcctgatgagaaaaaattgtgactttatattgattttaatatttgaagatagtgccagttacctaggagttgctgactgctgcgaaacagcaaaacctaaacatctaatctcatgcagttatctcatctgcagggtaaaagtgtcttaactggaggccttgatgcgttggaattcatcggcaagaaaaccatgaatgtccttgcagaaagtgacccgggctttaagcggaccaagacgctcatggagagaactgtttccttgtctcaggttggattatatacgtttgcaattttttctttcagtcaataaagtaaataaattttttatttatctttttgaatagctcatttaaagcatgtgattcaaatcaaatgacaccaaagagcagagagagaaaactgagcttctaatacccccatttccccagtcacttaattcctcagaggagacaaccagttaacagttccttaaggattctatcagagaccgcagagagatatggatatagatctatagatgcagctatacataaatatacagatgtaaaagtacatatgtatgcatgtggatagacatgcacataaatacacacatattttttcaacccagtggtaacatactaaacacactcttgttccttgcttaattcacttaatattatttcttgaagatgatccatttatgtcatggtatgcatcccatctctaccacttagtagctgagtgaccttgggcaagttacttagcccctctgtgcctcagcttactcatctgtacactggggataatttaaatacctaccaataactttgttgtgaggatacgctgagttagaatagaacccagctcttagtaagcattcagaaatgttagttgttgtcattgccgttattatgtgtcggtataataggtggaaatggtatctcattggaattttaaattctgtttctcttgatatgtgcaaggatggtcttctcctctcacacttccagcactaaagttttccagcccttcttgcaaaacataaaacaaagaattcaatctgtctttgcttacttacaatagttaagaaaattggaaataatattagtcttgttttccaaatatgactctaatattaaacttacttttccagatggaacatgcctagcttaccccacaatccaggcatgccccagtccacctcctccacgagagactgatacaccaggtctctgtgctttcctgaaatcagaagcagctgatgcagcagtggattttgtaaacgtcacaggcaggacttggtactaggaacccatgaaggttgccttcatgaacagctatcactgagaatatgttcatggcaacccctagaagcttttgttttaggctatttcttcttgtctcttctggaataacccaagtatgagcactccgatgttatagtccagggagggactttgcaggatcatctagaccatcaccctgctgctccttgaaaaagaaaatagatggctgggcacagtggctcatgccggtaatcccagcactttgagaggccgaggcgggcagatcacctgaggtcaggagttcgagaccagcctggccaagatggtgaaaccctgtctttactaaaaatacaaaaaaaaaaattagccggatgtggtggcgagcacctgtaatcccagctactcgggaggctgaggcaggggaattgcttgaaccagggaggtggtgattacagtgagccgagattgtgccactgcactctagcctgggcaataaagcaggactgcatctcaaaaaaaaaaaagaagagaaaggaaaatagattagtattagttaggtaattagcactagatgtcatgaaagaacaaccacccctaagtatcagtgtggcttagaacaaaaaggtttacctttcgctctcacaaagtgcagcatgaatattcctgctcacacaggagctcgtcccagggggctctcatggctagcacacttctgagcccacatcttctggcctcatcatcttgaaatgccttacttccagcctcacagagaggggatgtggaaggcaatatctggtatttcagaaagtgacgagcgagtgccatggggaaaaagacaaagtagaacaggaagaggtgatgaggaatcagaaatgtgggtgtgaggggcaggctgagtgttaagtaggatagtgagggggccttgggcagatgatgacatgtgagcaaatccttgaaggagatgagagcattggccatgcaggaacctgagtaaagctcattccaggccaagggagaactcacgcaaaggccctgagtcaggagtgtctggcatgaacacagaacagcaggatgcccgtgatggagaggagtgggctccgggcgagagctgttgaggaggacatcagagtggtgatagggagtaggtgatagcagatcatggcagacattcgtaaggaccttgggtttgactgttagtgaaatggggaaaccattgcagcattttgagaaaagaagtgacagaatctgatttgtgctttaacaggaccactctggttcctgggtagaaaattggctgggaggaccaagggcagggagactggttagagtgactatcagtctgtgccctcccagaaacagacaccaagatgggcttaaacatgcaaggatttcattaggggaagtgcttgtgtgagagaaaatggggagggagcccaggaaggctgggagaaccattagaccaggatgccggtcccaccccagtgaagagaagagggtgagaaaaatgggtgaaagtgtcccagactgcagtgcggcatgggaaaggctgggcgaagccatgggaaagcccttcagccaaaggctgctgacaaaggagacctcatcttccaggaacaggtctgccttagtgccctgctgcaccagtgattgacagggaagagctgtgggaggctgaaggctggatttcgaagtccagcatttatgctcccaggagtaggagggaggtctgcaggttgcactgtcacaccctccactggaggcaattgcactttcaattgctgttatctaaacaagagataatggtggccctgtgcagcatggaggccttgtaggtagtgaggaatggctgattctggctataatttgaagatagatccagatcgcttgttggaatgaatgtgagctgtgagataaaagcagttgtcagggatggctccaaggtctttcggacaactggaaggatgaagctcacatatttttcctttacacactaaagaaatatataactatggaaactagaagcgtgcacgcgtgcactacctacatttctcacgtatttttatcctagtggcacagggaatactctttctttttctttctttcttctttttttttttctttttttttcttttttctttttttttttttttttgagacagagccctcactctgtcgcccaggatggagtgcagtggcgcgatcttgactcactgcaacctccgcctcctgggttcaagcaattcccctgcctcagcctcctgagtagctgggattacagtgtgcaccaccacgcccggctaatttttgtatttttagtagagacggggtttcaccatgttggccaggctggtcccgaactcctgacctcaagtgatccaccctatttggccttgaaaagtgctgagagtacaggcatgagccaccgcacccagccaagcgcagggaatactctttaaataacacggggacagggggtccttggattccacacatggaagtctccatagcttctctgtgtcaggaattcttccaggccaggatcattccctgctattgaaacccacttccctttcttctctagtgggaaaatagaaccagcctccgttgtcaagctggttatccctcaggcagctttaatttcactccccagttgtgttttgtttgtttgtttgttttgagatggagtctcactctgtcacccaggctggagtgcaatggcgcaatcttggctcactgcaacctcctcctcttggcttcaagtgattctcctgcctccctcctgaatagctgggattacaggtgcccgccaccatgcccagctaattttttgaatttttagtagagacagggtttcatcatattggccaggctggtcttgaactcctgacctagtgatcggcccaccttggcctcccaaagtgctgggattacaggcgtgagccaccgcgcctggcctactccccagttttgagtgagtccacatctttccagagtgaccctttccctttctcttcaatttcatcccttcttttttctctcccgaagcccacattcggaggtggaagctggtgtagagaaaggaagtgatttcagtgtcactttgttattttattttaccaccaccaagtcctgagatcagtgcgggtaattagtttttattgccagtgttaaaattttccagtgatggtttcattgggttgtttgaaaaactttaagattcagagtctgtgctaatttagtcttaaagacagacaggagagagaattctctttgcggccctgtgggttcttggcagataacctcgagaacccagaaggaaataaggctgattgtttttctggcacacaataaaaaccaaagtctattcttcagttgtcttcccctgtgaccttgtggtggtggccagtgtctttacagtgctttccacagaaattaaagaaccccatacacgtaatgcctcagtaaacttaatgaggaatcacataaaagatgcttagaatcaaaaacgcaagtgcagaaaattgagagtgactgatggacttgtgtttatttgttgtctttttgcttaaccaacaaaaaataactggagaaaagttattaatggggagaggaaacttggttcacagtcatatttctggaaaccagacttaagaatctataagctaatgttcttttttgtttttttgttttgagaccaagtctcactctgttgcccaggctggagtgcaacggcgcagtctcggctcactgcgcctccgggttcaacctccgcctctcctgcctcagcctcctgagtagctgggattacaggcatgcaccaccatgcccggctaatttttgtatttttagtagatacgtggttccaccatgccaggctggtctcgaactcctgacctcaagtgatctgcccatctcagcctcccgaagtactagaattacaggtgtgagccaccgtgcctggccctaagttaatattcttaattgcagtaagtatatgatgacaaatacattatgagattatgtttattaatttttaaattgaggaaatttaataaccacgtacacaaaatttttaaaatattaaaactcggccaggtgcagtggctcacgcctgtgatcccagcgcttttggaggccaagctgggtagatcacctgaggtcaggagttcgagaccagcctggccaacatggtgaaaccccatctctactaaaaatacaaaaaaattagctggctgtggtggcgggtgcctgtaatcccagctactcgggaggctgaggcaggagaatcacttgaacctgggatggggaggttgcaatgagctgagatcgtacccttgcactccagcctgggcaacaagagctaaactccatctcaaaaaaataaaataaaataaaaaattataacttagaaaaaatcaggccagcttatttctgctttgacgtctgtgtaggtgcaggacttaaagttaatcctgtcataagagattcaacttttcaagcatacataaaactcgctcattatagaaaatttggggactttagaaaataagaaatttggccgggtgcagtggctcacacctgcaatcccagcatgttgagaggctgagggaggaggatcacttgaggtcaggagtttgagaccagtctgggcaacatggtgaaaccctgtctctaccaaaaaatacaaaaattagctgggcatggtggcaagggtctgtagtcccagctcctcaggaggctgaggcaggagaatcgcttgaacccgtggggcggaggttgcagggagccgagactgtgccactgcactccagcctgagcaacagagtgagactccatctcaaaataaataaataaaataataagaaaataagaaagttaatcactcatgtgggaaacgcctcagtggaaaccactgttaaagcttttggtgtgtttcttaacagtttattcccaggcattgaatttttgctttgttttgcctttcacataatgaacatgtaaaatgtgaagtaggatatgatgtaaaagttatcaataggatcaatcaaaaaaatcattttttagaaattctaaagtgaccagaatctccccctctccaacacaaaatcagtcctcccaacctcccccatgtcttacacaggaaacggtgcttttaaatgtacatccagagtacaaacattgtgtatttctgcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggtacttctgcactactcgtttgaaatggcatgcttagtcatgtgttgcttaaacatgaaagaaactggaaaatctgccattaaaagatctcatttttagagcctcattattattgtgctgaggtcagaaatactgtacaatgggatgaccctcgagctccatatcatctcttctctgtcctatgctaagctattaccccaccccagctccaaaaaggcctgcacagtaagagccaccactatccccccacctcatggtgcaaaaggctgctcagaaatgtggctgtccagctgctggccctctgcctccctttggtaacgaagtacccaggtcagagatgccctgccagcccacatcttcattcctacccaatgcaaacaaagcacttgatgttccttttagacttcagggttttaatatattttgtcttatgggttatatagttatttattcagccatcttgttaggactcctgggccacaaagggcaggattatcttactgaaggttaaggttctattagggaatgctcccgtacacacacctgggaaacccagcctacccaatggccctgcacattcatactcctccacttggtcccaggaaaacaaaagatgaatagcaaaagtcagcagggtttggtgatttttttcccttaaagcatctatagtggtgtgtgtgtgtgtgtgtgtgtgtgtgtgtgtgtgtgtgtgtgtgtgtgtttatttagcaagcacttaatggcacttacatagccactattctaaataccataaaactgttaacttatttaactgtatatatgtggctgttttgtggatgtcaggctgactgtgctccggagtggttttctagtggaggccaccaggcagtaccctctgggcctccagagagggaggggccgtggtgacattcattgaggagaggcaggtccctagacaagaagctcaatttggcagtgagccttagaatggagaagtagtttttgactctccctagaccttatcctgttatgtttggactttgagccattcttgatgcctgtctaatcagagaaagacaacatctgccacataacaggcaaccaagaaccaaataggatggagacattgtcccctgccccagatgatggagctacatgttactctgtttatttccttctttgttatccatgagccttcagggaaagtcttgtggttaaaactgttcaagaataattttcaaaaagggcaaaattgggactctcatacagatacaacatgacctatgttaaaggatttatttagctcattaattaattcagggaaccaagcagatgttataaatgattcaaaggaaaagccaaagaagcacaaatgtgtgtggagtaatatgtatgtggctatacaccgtggaatactatgcagccataaaaaagaatgagttcatgtcctttgcagggacatggatgaagctggaaaccatcattctcagcaaaccaacacaagaacggaaaaccaaaactgcgtgttcttactcataagtgaagttgaacaatgagaacatatggacacagggaggggaacatcacacaccgaggcctgtcgggggtagggggcaaggggagggatagcattaggagaaatccctaatgtaaatgacaggttgatgagtgcagcaaaccaccatggcacgtgtatacctatgttaacaaaccttcacgttctgcacatgtatcccagaacttaagtataataattaaaaaatatatgaaggtgccaatagacacaaacctgcttttccacataggggaggttgtcctcccactgcacagaattcattcacatgactattgacaacaatggctttgcattgttgtcagccctttacaatttacagagtcataaaattgctccgataaattcagaatccaatagtccagtaagatgtgctctagaaaatgcagttcttagccaggcgcagtggctcatgccttaatcccagcactttgggaggccgaggtgggcagatcacctgatgtcaggagttcaagaccagcctggccaacatggtgaagccccatctctactaaaaatacaaataaataaataaataaataaataaataaataaataaaaaagctgggcatggtggcaggtgcctgtaataccagctactcaggaggctaaggcaggagaatcgcctgaacctgggaggcagaggttgcagtaagccgagatcgtgccactgcgttctggcctgggcgacagagcaagactctgtctcaaaaaaaaaaaggcaaggtctggagtcagacattatttaattaaacaccatgcagaagctgtatgattttggacccccttacctcaatctccttatctgtgaaatgggaataataaaatctacctcacagaattattaacagaattaaatgagataatccatggaaagctagtagcagcatgactaacacagaagtaagcactgaataatgtacacatgttgatgacagttgatttttatatgcgttcttatgtcatagacatttgttgttattaaaaatatcacaggggagcgtggccctgctgtaaaaaaaacattacaagatatcatggtggtggagaatgattccattgtggtgacttccatcacagctctcagctgtgaaacagccccagggccctggaaaagagcccccaaggacttagtttctaggaagaaggttcggcctttggaggggaacagtttgcccattgcctccacaagctctgctttctttccctagcctggagatttttgtgatattcatagtaaggaaaataaatttttgtcttgacttagtaatgatagttaatgggtactataataaacagtcctacaggccaggcgcggtgactcacgcctgtaatcccaacactttgggaagctgagacaggcggatcacctgaggtcaggagttcgagatcagcctgaccaacatgatgaaaccccgtctctactaaaaaaaaaaaaatacaaaattagccgggcatggtgacgcatgcctttaatcccagctattcgggaggctgaggcaggagaaacacttgaacccaggatgtggaggttgtggtgagccgagatcgcgccattgcactccagcctgggcagcaagagcgaaactccgtctcaaaaaacataataaataaataaacagtcctacaaatgtatgggtcaaaaacagtaagagttattcttcactcctgtaatagtccaagataggagtgcctggtcagcaggcagcattcctgcatttagggcttcaggaaccagactgtgtccgtcttgtggctccgctaggcccgttccaaggtacacaggcctccagcaagaaaacaaatggaggcttagactgaggttgacacacgtagcgaataaaaatacgggatgactagttacattttaactttagatgaacaatgaatactttttcagtataaatgtgtcccatgcaatatttgggacacatacttatatgtagaaaatattcactgtttatctgaaattcaagcttagctaggcatcctgtattttatctggcaaccctacacataccaagtatttaaaagttaaataattttggggccaggcacggtggctcacacctgtaatcccaacactttgggaggctgaggcgggcagatcacttgaggccaggagttcgagactagcctgaccaacatggcaaaaccctgtctcaaataaaaatacaaaaattagagccaggcatggtggcactgcctatggtctaaggtagatgtaaaaccgggtgagctggctgggcacagtggctcacgcctgtaatcccagcacttcaggaggccgaggcaggtggatcacctgaaggccaggagttcaagaccagccaggccaacaaggcaaaaccccatctctactaaaaatacaaaaattagcagggtgtgatggcacatccctgtaatctcagctactcgggaggctgaggcacgagagtcacttgaacctggggggcggaggttgtagtgagccgagatcacaccactgcactgcagcctaggtgacagaatgagactctgtctcaaaaataataaaaattaaaacggtaaagaactttagaaacaaattgttaaagaaaatgtattccatcctcttaacttgacaaacatacttgtataatgacctggaaggccaagttcccatttgaattcccagactcctcaaatttgaattcccagactctgcttcagcctgcctgcctcctatctgcagctctatctctcaccccagggaacgttatgtggctgtgggaggatgccctagttcaagctccagccataccccctgtaagcagcacctcttagctatcccgtgggctgagggatacacagccagtggcaccatcccactgtcaggagcacagcctagggaagagttccatgcaggctgtgagagggaccctttggtgacctggagagtattctagaatggagatgtgggctctggtgggaccatttcttgggcctggggactcccctgtgttgaagcctaaaggcagtgttggatttccctgccctctgagggcttattgtcttctgagtcacatcagcataaggagagagagtgtagagaggacactcccatgttttaaaagccttgcctagaaatgatgcacatcatccctgctgacagtcatgatgcacatcttctctgctgacagtccattggctgaaactcagaccccatcatggaaatataaggaattactatcgttactattttactagattgattctaggatggcaacaggcatggcgatgcggtgtttgataaaggttaaagagaaactaatcattttcggctgggcgcgatggcacacctgtaatcccagcactttgggaggccaaggtaggcagatcacttgaggtcaggagtttgagaccagcctggccaacatggcgaaaccctgtctctacaaaaaatacaaaaattagcagggagtggtggcgtgtacctatagtcccagctactcaggagacaggcaggagaatcgcttgaacccgggaggcggaggttccagtgagccaagattgcaccactgcactccagcctgggcagcagaatgagacccgtctcaaaaaaaaaaaagaacagaaaaactaatcattttcatcaccattatactccacagttaggaatagtaaacaaaaatcttcacaatggcagcacacacctcctttcaaggaaaagatttataagacagcctctctaccctgtgtcctgaacaacactcagcactgtgccaagcatatagtcagcattccataaatacttatggagaagtgtgtgattatgtcatatttattattggattgaactaaagattcaatgcacatggccttggcataatgcaatgagctaggagaaagcaggagagatgctatagtggaaagatgctgacaaaagagtgcttcgctaaagaaaacccttcccaggggtgccccaaatggaaaaccccaatgctctcccttccagatgattgccatccgccagaagacataggcaaacacaaatgttccacaggtctgcataccttttcactaagcatggtattcaaacacatttattcaataattaatgttagaaaactgcagtttagaaaatagatctgaagcctaagaatacgttgatgcacatctgggaccctgacccctaaacatgagtgtgcgagctgaaatgaagagtctgagaaggtcagggcagaacggagtggcgtgcagccatgagtctgggcacatttacttccacctgctgaactccacgctaatgggttttgtgttgatgacttcctgcagagcttcctcccagagcctcagtgctggctgcattatgccctggcaatgagctttagcaacttttaggaaaatggtgtcctggtatcccagatgccctctctacctctctcagttatcccgatgtgctcatctattaccacaatgaatattaaaacctattccaaagaggactacggctccaccgctgtctctctcgccagagcaagagtttgacctgcagaatgaaaaaataaaactttactactttatacttatacttaatattttataaggtgccttccctgtgcccttttaccattttggaaattcaaatcaatcttcagagaatgagcggccatctgtacaaataatgttctgttttttttgaaacaggatcttgctggagtgcagtggcacaatcatagttcactgcagcctcaaactcctgggctcaagcagtcctcttacctcagcctcttgagcaactgagaccacaggcgtgcaccagcattcctggctaattttcttaaaattttttatagagatggggtctcactatgttgattgcttgagccctcaaactcctgggctcaagtgatcctcccgcctcagcctcccaaaatgctgggattacaggggtgaaccaccatgcctggcctgtacaaataattgttaactgtatacagaggatagtttcaaaagaggggctctaaagacagtgagcagggaagacgtcagtcccagcatcacctcctctgtgaagccctccctgtgtgtaccctctcagttccccaagggggaaggacagtgcccttcctagtgcttccctccactgtaccctcctctcatgcctgtcatagttgttcttggttgacacagcctcactcctttagcctgcaagatgttggagaagaaaaatgtgtcttgtgcatttttgtaaacccagtgtgataactgacatctagcaagtatatatgtgcatctatagatgcgtatttatttatgtttatatatggatgcatgtttgtttatttatttattcattcatttattttttgagatggagtctcgctctgtcaccaggttggagtgcagtggcgcgatctcggctcactgcaaactccgactccctggctcaagggattctcctgcctcagcctcctgagtagctgggattacaggcatgcaccaccacactcagctaatttttgtatttgtaatagagacggggtttcaccctgtcggccaggatggtcttgatgtcctgacctcgtgatccgcctgcctcggcctcccaaagtgctgggattacaggcgtgagccaccgcgtctggccgtatgcatgtatatttataagtattgagcatcactctaagtattttaagtagattacttcatttaaccctcaaaacaaccttataaggaggtgcaattagtttccattttatggataaagaagctgaggcattaaaaggttaaataagttaccgaaggtcatagtaagtgaggagctgacatttgactgcagggttgatgtcaaactgcgtttttaaccactgtgatagaagagctaccaccaccatttatgcagcacatactgtgtgcagttgtgcaaagtatttcacattttgtatctcatttactccacaaagaatctccctttaaaaatgagaaaactgagacccagagagcttatctaacttgcacaaagttgcacagttaacatgcatcaagccaacattcaacccagcgatacctcccacaccatgaatcacttttgtcctgggaaaactggggaccgctgtgtgtaaacgttattaacgagaagaaaagatgacagtcgtgctgacctatttcttttttcaggttcagtcatttttagcatcacttgatggagagaagctggaactcttaaaaaatgacctaatttccattaaagacatctttgcagccaaagaattagagaatgaagaaaatcaagaagaacaaggtaaaggaaaataacttaaatagcaagacaaactgttggcataatccttacgaaactgctgttaatgaacacagccctttgaattacttaattcaagtgctcctcctccatgcttccaaaagacactgtgcatctgctcttgttacaggagctggtcacattgatttataagactctctttcactggtcgggaactcctattggtcctctggtgttcggcacaatccctggcacatcacaggcatgcagtaaatgtgaatgcatatagtcagataaacaaagactgcaatgtgctaagcagagccctgatgactagagtttatgctgccacttttttttttttttttttgagatggagtctcgctctgttgccaggctggagtgcagtggcgtgatatcggctcactgcaacctccacctcccgggttcaagtgattctcctgcctcagtctcctgagtagctgggatacaggcgcttgccaccacgcccagctaatttttgtatttttagtagagacggggtttcactatgttggccaggatggtctcgatctcttgacctcatgatctgcctgcctcggcctcccaaagtgctgggattacaggcatgagccgccttgcctggcctatgctgccacttataatttttatctgcatgtgaaagttatttagtgtgattaatgttgatggtgggcaaatctttccctgaatttttttgtatatttttcttattccttttaatttataggtgtaagagttcgggtatatttgcaggtgtcctacgctctacctaaaaagttcagttctgacaaagtctgtaccattttctgacagtgcaccagggcatgctacatcaggttggcaaccacacttcccaataatcttccacccagatgataacttgacctcaaggagattagaacttattttatgagaagcaaggcttccttaagaggggaaaacttattctctgggttgggcatggttaatgattcctttaggttgtccatttgggagcagaagagagtaaaacatttgctatgtacttgaagagagatttcttactgatgtcataaccaccgacccacagttgttttgtgtaggttatgctgaaaggtcagacaacctcagagacaggtctggcttctcctaggacctttggaagggtcccatttgaaacattttcaccattttcttgctatatggcgttaaacaagttatataccctttctgaaatgcagtatcttcacttgtaaaatggagacaatgatatatatatcaggttcaagagctgttgtagggggtcatgttagataatatatctaaaaacatatattacagtgcctggcacacagaactgctcgaaaatgttagctgtgcttattacttaaagtgcgaacacaatgccaggaaaaagtaaaggtgcaataaagtataactttcatgtattattatgctcgttgttattacccggcatgcaaagtaatgagaatgtgcattcttaaatcgctggcagtgttttgtgcctgatgtgttacattcttttaatcaaagctctgacacaagagctcaaatgcttgagccttgatgttcagggcgaaattattctaggcattcagaaactgtcatttagacaccctttccctctttagctccacacactgaccttacatgccttcagcttaatgagatttatgctcattgcatcaaaataaaagaatcaattatactgaagcatagaaagaggccgtatcagagacagttgggaatcatgtttttgagcattagtatgttcctcccggagtcacaaaggatgacagccttgtctttgtttttctaatgaagaaactaaaacactagctgtcaaaggtcatgtagctcgccttgtggacccaggatgaactaatagatgcccctttcccagactagcaatcaccaaaaagaatcaagctatttctcttcaagagtcatggtgtctgaggtagaccttggtcctattaagggtgtcatttagaaaggacaaaaagagaatcccagattccccccaacatcaaggagatattgttgccaatgcaactaaagaaatattgcatccccaactggtgctattccttggaggggaaacttaatttcaacttaaatagaaaatgttgctgtaagtgatgtgttctagtcttagtgtagaccttcagtaaattcagtttctttaaatacacattcacatatacacatagaaaaacctgaagtgcgaacagcatgctttagcaatggtaggtttgcctcgccttaatttgacaaaaccctgttatctcccataatatatcaattttcccaagagggcatctccagattttcaaaacactgttaatgttaattaacttaatttaataaataaatgtccttcagaaacttaatgaagaactgggagaaaagaatagacgttgtcattaaatcaatccaattatcgagtgtcacaaccccagaaaggttcagggattatgcaaaagctgtcgtaaggaatctttgcagtgggggaaatccaggagcaatccagcagaaaatctaggagcaaaattctggaagaaaactgagcattttcatccatttttttccttgtaagcattatgttcctaaaagccccctaacaactaaataatttatttggtactctcagaaaatgtaataaactatcattttttagatgaatttaatatcagtctcctctgcatttaataatgttagctaatgatttgcatgtttgtttttccagcagagtgtaattttatcacactgccatagatcccttaatgtgatttaccatggctgagaagagattttaaaaggccattttctatttttattgcttcggtgaagatcttcttggccatgtgtacagaccaagagttgtagtaataggtattgtttgttgcaatatttattatcatctgtttttatcaacctccatttttctctatgattttttttttccaaaatagtttctaaaacttgctttgtatgttttacagaattaatacacctttaaaagctggagctctacaaagtgcttgtatcttaatttagtgttgattcctcccaaatacttttaatctccctatgtttgtatcagtgtagcacataatttgtttacataaaactttgtgtttacaaaacactttcacgtttgttgcagtatttggtccttacaacagctgtaaagaggatatgagtgggttttattgtcctcaattttcagaggaggcagtggaagctgaggaagctctgtgactggccccaggccacagaactaccagatgcaggagctgggtagaatccatgccttccaagtcccagcccagaactctctgtgctctgcaacactgcctcatacagagtgaggggcaggcagtttgggaagagaccttgtcgatgctgcccaggtgtgcccagcccctctcactgtccctccctggggaagactagaccaagacctctgcccagcagagagaatctcagcttctgatggaatcaatctagctctctagctctgtctctctctctctccccttttttttttttttccagatagagtctcattctgttggccaggctggagtacagtggtgcaatctcagctcacttcaacctccgccctcccgggttcaagtgattctcctgcctcagcctcccaagtagctgggattacaggcacatgccaccacacctggcaaatttttgtacctttagtagagatggggtttcaccacgttggccaggctggtctccatctcctgacctcaagtgatccaaccacgttggcctcctaaagtgctaggattacaggcgtgagccactgtgccaggccctctctatctatctctgagactgtctctctatctctgagactgtctagccctccagctctccctttgtgtgattaatgcattctctttcttgaaggctctgttcaggcatcacctcctccaggaaccctgcttcacacccctctgagaactggattatatgctgcaaaagcccccttagagcacttacctctttgggttaaaacgatttgcttgttgtggcttcgtcatgagcaaagacagccgtctctgcctcctccctgcgcacacctgcctcactctgctgcagccacgctgacgtccttgctgctcccatggatgaaccaggcatactccctcctggactctactcttgctacactgcagctggaaggctcttcccccctgacatcttgtagctggctcattgctctcctcctctagcacattactcaattgtcaccttcttagttagcttccctcctgtcttagtcccttcaggctgctatatcaaaataccatagactatgtggcttataaacaacagaaatctatttctcacagctttggagaccgtaaagtcgaagctcaaagtgctggcagattctgtgtctaatgaggtctcctgatctctggttcacagctggtgtcttctagctgtgtccttacatggtggaagggaccagctagctccctggggcctctttttttagggcactaatccggttcatggggggctccccacttcatgatctaatcacacccccaaagcctcacctcctattgtcatcacattggtattaggtttcaaaatattaatttggagaggacaggggcattcagaccacagcacctcctgtttaaaactcctaaaccccagctagccctgtttatacttctccataaaacgtatcccttgacgttgatgttatttacttatctgttttgttttattttgttttgttttttgagacagagtcttgctctgtcacccaggctagagtgcagtggcatgatctccgctcactgcaacctctgcctcccaggttcaagtgattctcctgcctcagcctcccaagtagctgggattacaggcgcccgcctccgcgcccggttaatttttgtatttttagtagagacggggtttcaccatcttggccaggctggtctcaaactcctgacctcatgatccacccatctcggcctcccaaagtgctgggattacaggcgtgagccaccgtgcctggactacttatctgttttgattattgatctgtttccctcatgagaatagatgagttataggtaataataagcggatctaagctaaatgttttgaataaatacctacaagctatgccaggctatcttcgtgggctgcagatcaaccattttgtccataaaacagaaaatagcatctccagacaagggctggatgcagtgtttctcacatggcttagtcccctcttcaaggctctgccttcccccactggcataagccacagtattttcttcttagagagttctgagatcatgtagtcaggtgagataaatgatgcctttattctcccccaaactggtaataaatccatgtggaatccattctttggcacctttcagaactgttaaaaatggcatggccttgcagatactttaaaagagaaaaataagattgtaatctttaacaatctctttattgcccacaatgatcctaatttttttattttatgatatttgatattttaatacgtatactgtctgttatatatattaatatatcatattatatattaggcaatgtattaataaatcattctgtaaatattcattttagcacctatgatatgtgaggtattgtgttagatactctaggattcaagagtgagcagaagaaatactgtctctgtccctcagtagcttccagggtgaaaggaagacagatcattaagaaatattgtaggaccagccaggtatcctagggaaccttgggaaatttctccagagagatggttgagactaattcggtttattcagcactgtggctctgtggacataaaagggcacctgggtaccattagggttgcaatgctaagcataacaatatcgaagtcataaatatgatgttgtcccaggtctcttaggcctgagaaaggtcatgcctttgttcatcccagtccttctttcagcaaatagctgctgaccacctacagctgtgaacaagacaagcgaggtccctccctgacctcttgttgcctttgggttgtcctgggggtgtccctgctggagctgccaaacagcaagacttcagcggccctgcacccggatgcatctgctgcctcactgccatgctcacgaatggaagacattcatctttgcccagcggctggcgggcaggctgctacaacctccacttagtctaccccagctgcaggctgtaatgttgggggagctgccacatcctgaaggatgaaaaataaatcacgcttcttctgtcgtgttctatttctaggcttagaagaaaagggagaagaatttgctcgcatgcttacagagcttctctttgaattacatgtggcggccacacctgacaaactcaataaggtcagcactgtctgatttatagtttctggttaaaaaaaaacagtgcaggggagagtctctgttgtaaagttccagagatgcacctgaaatggaaaacccccaaatcttatgtggcatagtgccgggagaggagtttgaggtcagtaattaagatttgaggaggggctgggcacgtggctcacgcctataatcccagcactttgggaggccaaggcgggtggatcacctgaggtcaggagtttgagaccagcctggccaacatggtgaaattccatctctactaaaatacaaaaattagccaagtgcggtggcgcatgcctgtaatcccagctactcgggagactgaggcaagagaatcgcttgaacccaggaggccaaggttgcagggagctgagattgtgccacagcactccagcctaggtgacagagtgagactctctctcaaattttaaaaaaaggaaaaaacgaaaagatttgaggaggcaacataatggaatgtggtggtggagaacatgctagactgtgtcatgagatctgcattttagttgtaattttactagtaattaccttgtaaccttgaataagtcacttaccttttcatggcaaaatagaatgttatgtcggagcagtagttatcatcaggttagggcagggaaaaagggtgcagaatcaccaagaggcttttttcaaatttcaccccgccccccttctaaagaaacatgccagaattaggtagagagaggcacgtcagccaggtaaaccccacagttcctcccacctggagcacaggggctgcatcatgtctaagaccattccagctttaacaatctgggttcctctaataataccacagtgtgttttgcaagttagtacaaggtcttgctgtgaagtttctttagaggccatgatcattaattacttaaaactgcatgatgtttttccattctctctctctctctttctttcttctttttagcaagcagtggtttacataggtactcacttatccaggtgggtgaggaaaagggcagaatgaggaggtgagatgagtaatttctttatctctgatgggggtcactgattctggcaggtcagtgacttgaacacagtgggaagttgcctcattcatctccgtgcagcatctgccactgctcagagggggcatgtggtggctctgagattccactggcttatttgcttagggttaaatctttgtctgtaatagaggacacactgaggacagttttgctgggttttctctccccagatcttcttgctgttaacttaccattcaacactctgatatttttaactttggcgtgtaagatttaacgtgggaagtaagtttagtgtaagccccaaaacaacttttacttaagcaaacagcttaaactataatgataaaattggagtgagtctgccccttcgttctaaattcagggaataacaggcaggggaggaggtttctgattgtttaatttagccatgattttgcagggcacagagtgcgtaaactgcactcatgtgaaattaaactagacacagagcagcaccagacctttccagcagcgcttctcttctcccccttgagggtggaagacctgtcatgaatcaagaaacgcagagcccttcttcaccttcccagcatgatacattgttaggttcatgaaacatgaagagcttcctgaaatatatcagatgaggacatttgctgtagccgcggccccatggctcaatttctaacacatatttttaaaaatactattattcttttatagatggtcatgaaaagtgaaaaatataccatagatttttcaatgtgactgtcatttttattcttatctgaatatcatttttaaatgctttttgaagagtcctcaggcttgcattgttctttccataccttctgttctgtccctcttttctactttatatttaccagaaagcaacaacaaggttatctttttcgggggttgaaaaattgccccgtcatcctccaaacatacagagatccattcttgaaggcttagagacacttgattctagtcttggggttggaatgacttagtttccatatttgcgccataaaaggattgtttggttggggacctctgcaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggtaaattcattctagattgtctgcctacaaggtaataagagtgtgttcattttattagcagcttaattttaattgaggagaggccatttctttttcatttgttccgtgttatagaaatataagtttgagaccagcctggccaacatggtgaaaccctgtctctagtaaaaatacaaaataataataataataattagcagggcgtggtggcgtgtgcctgtactctcagctacttgggaggctgaggtatgagaattgcttaaacctgggcggtggaggttgcagtgattagatcactgtaaggaaaaatatccattgagctctgttcattcagccggccttccacacaccttctttagcacctgcctgttttgtacccagcattgctgtaagcactggggatgcagctgtgaacagacctgccacatccgtgggggctttacagcccttcctggcaacattacacttaaagtcttagatatgcttgtaatcatcaggttaactatttcgggttatatttggggtatttttgaaagaattatatcacttctaatgtcacagcatttttttaaaaaagcatctgctcagtaaaaaatttcttgcttgtgtctattcatttcaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaagtaagtaaatgttactttaaattcttattttcccagttttatatataggtaccattcagatacacacatacacacccacaccctctaagccactagaagattcaggtttctttttgtttgtttttgttttttgttttgttgagacgggatctcactctgtcacccagactggagtgcaatggcatgatcatgactcactgcagccccaaactcctgggctcacgtgaccctcctgcctcagtctcccctggagttgggaccacaggtgcgtgccaccacatccagctaattttttaattaattgcagagaccaggcctggccacgttgcccaggctggtctcaaactcctgagctcaagcagtcctcctgcctcagcctcctaaagtgctacgattacaggcatgagccaccatacctggccaaagattcaaatttcaagtcaaccaattccattgttctacggtcatcttaagaaataaggatttttttttttttttgagacagagtctcgctctgtcaccaggttggagtacagtgtcacgatctcaactcactgcaacctccgcctcccaggttcaagcgattctcctgcctcagcctcccgagtagctgggattacaggtgcgcaccaccacatccagctaatttttgtatttttagtagagacgggttttcaccatgttggccaggatggtctccatctcttgaccttgtgatctgcctgcctcggcctcccaaagtgctgggattacagtcgtgagccaccacgcctagccagaaataaggatttctttagcaagtgcattatgttagcaagaagaagacttaactagccattctaggaattatttatgaagagatttaagggaaaacacactaaatcattgcatgaggcgtgaaagtacttatttaatagatcaaagtcttagaagtaaaaccttttgagggtaattacattttcaacatatacatgaatagagaaaggacactttaatgtaacttctagctagattcacaaaataggcaaatacactccactgctcctggggacttataccaggtctccacgttccaaactccagtgatgacggtcactaatattaaccagttcactgtgggttgtatgtgtgcatgtatgtgttgtcctatatcatgttcttcaataaataatagctattatcattagtttattaagtaaaattaaaatatatgtgtaacatatatgaatatgcaatctagtgaatatacatgaaaatagttgatatggagcattcatgaaaatagttggtatggagctgaaaaataagcctttaacttttatgcacatgactgtatactgtgatgtggaaaattaacataggcctaagtaccctcgtattattagacagacacaggagccaaaatagagcccctgaaaatatccagggatggacacacacaggtctcagcacactcaatttgctagctaactagtctttgcttattactgctttgacattgtcggttggggagtaagtttttagtggaaagatcttccaaaaagtcagcattagtgtctttgtactggcggcatttttcctcacttgtaaagatccgtcatctagtctagatttccatatctaaggatataaaaatcaaagttattataagaaccacagaatccccaccttaatattcctagaaagaataggcacttgcctaaacatttagaaggaagaggaaaggacaaagtcagggaagttgaaaatgctgaggacaatctctaggtactggtttatctttgcagtactaattggaaagaagagggccaaagttcagaagcccctaggtatggatagtgaccttactctttgctcctttctgattcctagccctgattgtcctgaccttaccaagctgcacccagtccctgatttgcctgtacaataagtgcctccccacccacctgcccaagaacatagactgaatggctctgggatatctcctggctttactcttggccctttctgcagacaatttttggatggatgggtgggtgggtggatggatgggtggatatagctcataaaacctatatatattagataaggcctcttttatcaaagcaaaacttacctctactgactttactagatattttaacatataagattcttaacttggggttatcattcccatagcattttaatcactattcatgagtgctgtatgcactaactgatagaaaaatatcagacattacctacattactaggtaatcagattgttttcagtttttgtcatcatccatagtgttaggataaatgttgtttttgttaaatatttgtgtgtatcttgcattgttttcttgggataaagttctagaagtggaatgccagcataaacttggaattttgatatcagtattaaaaacacattctacatattctacaggatctttattttgaatcatataataaaaacataatcaaactatccagagacacctgagtttgaatccctcctctcctgcaggtcctaaacaggttacctaactttcttactttttttttttttgagatggagttttgctcttgttgcccaggctggaatgcaatggcatgatctcggctcactgcaacctccacctcctggcttcaagtgattctcctgcctcagcctcccaagtagctgagattacaggcgcctgccaccacgcccagctaattttttggtatttttggtagagacagggtttcactatgttggtcaggctggtcttgaactcctgacctccggtgatccacccacctcggcctcccacagctgagattacaggcgtgagccactgttccccggccacctaactttcttaaatgtccgattttccatctatataaaatggaaataataatataacccataaggtcaccctgaggattaaatatgattaggcacacaaaagtgcttaacatagtgcctcagtgaatgctcatgattattttgaaatgaccaaaaagctggaaaccagccgtctggccagagtgtataagctctacacatgtggagctcaagcctgatattttcctgcacatgattttgattctaaaagaggtcaagtgagttggatgattattctttaattaagcatggaaagaaaaccaggattagattaaactgtgattgcgaatcatggaagatgattaaggaaaaccgcctgactgcacatttctgtagagcatcttcaagcatgtgtggcattcttttaaatgtcatactgaattagtatcagaaatggtcgtgacagttaaattattttaccttattgaaaacatccaagcttttttttttttcttctttcagattaactactgcaatgtgcaatgaagtggcctctttatcaaagaagtttacgaattctttaaccactgttggggtaagattacagtcttgaatttttttcaccttttttaagggaagtatgtctgtgaggaaatgtggagatgcagcgccttctttagtagctccataaaactgaagctatgccatgatgtaagctgaagtcaggccaagagtaacttctctaaggacaggcagcttaggactctcctgactgggttctagccttgaatctgccatctcagtcttacaagatgttgggtgagtgagttttcaaacctctgtggcccttattttctttgtttttgtttgtttgtttgtttgatttttgttttgttttttttgttttttttttttgagacggagttttgctctggtgcccaggctggggtgcagtggcgcgatctcggctcactgcaagctctgcctcccaggctcacgccgttctcctgcctcagcctcccaagtagctgggactacaggcgcccgccaccacacccggctaattttttttatatttttagtagagacagggtttcaccgtgttagccaggatggtttcgatctcctgacctcgtgatccgcccacctcggccctgcaaagtgctgggattacaggcgtgagccaccgcgcctggcctgtttgttttttttaaagtgtcagatgaaggttccttttattacttaatatctgtgatgtatgtacttcagaatctctggtaaaattattaattttgaatattcactgttgccctcagagcctactttataagccatgcaagataagagttttcattttttttttttttttttttttgagactgagtctcgccctgtcgcccagcctggagtgcagtggcacaatatcggctcaccgcagcctccacctcctgggttgaagcgattctcctgcctcagcctccaaagtagctgggattacaggcacacgccaccacgcccagctaacttatgtatttttagtagagacggggtttcaccatgttggccaggctggtcttaaactcctgacctagtgatccaccggcctcggcctcccaaactgctggattacaggcatgagccaccgcgcctggcagagataagagttttctttgcttcattgtggcacttgactttaaccaaaagaaaaaaatgttactgattggctcaagtgtttctattaacagggtaacaagtctgaaaggctcagcatttacttggaggtatggcctctggttattttctttggaaatcagtcatgttatttagcttcaccttagtaggcgcagagaaaagtggaaaatattccctttcaccttcctgttttttctctttaaaacactggatgcaaagtctaatgatgttctccatgagaaacagcaggtttacttcttattctaattaggttgttttcttggtttcaagtatattagtttcctagggctgctctaacaaagtaccataaactgggttattttctcgtggttctggaggctagacatctgaaagcatggtggtatcagggccttgatctctccaaagcctctaggattctttcttgcttcttccagcttctggtagccccaagtgttccttgccttgtggctgcaaaactccagtctctctctgtgtcttgacatggctgctttctccctgtgtctccacatcaccttccctccatgcatgtctgtgtccagatttccctctgcttataaggacaccaggcctatttggttagcgcgtgaccaatatgacctcatcctaacttatcacaccagcaacaaccctatctccaaataaggtcacagtctgaggtgctgggggttaggacttcaatatgtctttttgcagggtacacaattcaaaccataccaggaagcaatagaaacacattctaaaaaatttagacagaaaggaggctttatgaaaggcactgggggaaatgaaccgctgtggggacccagcaccagagctcaggcacactctttttttattttttgaaaccgtgtcttgctctgtcgcccaggctggagtgcagtggcgcgatcttggctcactgcagcctctgcctcccaagttcaagtgattctcatgcctcagcctcctgagtagctgggattacaggtgcgggccaccactcccagctaatttttttgtatttttagtacagacagggtttcaccatgttggccaggctggtctcaaactcctgacctcaggtgctccacctgcctcggcctcccaaaatgctgggattacaggtgtgagccacggcgcccgacctacacatactttctctaatgtgctgctattaatgtgactcagtgacagcagttcctaaccctgtgtctttccattcaaattcctggttcctgggtaaaaaggtttgaatagctcatcagcatgggtcacatgtccaccttggcttcactcagcagcaattggggacagtgtctcattgtgcaaacctgcagacctacctggcttctggggcatgccccctcctcctcctcaggccaagagcatttctaaaaagatgagaaatgaccatggtactggctgtcacccaaaaagacacctgtcccccacacttctgtcagtgactctgtgaataaggggtgagctacgcaccgcctattcattctgctgtcaagaaatctgacctgcttctcctattttgtaaaacaacaccttttatgtttgtctaatttcaggccttcagcaatagagcttcactgtatacaagcagaatgacaagggaggtggaagctcattgatatgataggctggacaaaatgcatttgcaccctcgtgtggtccaagttacctgatatccatggactttgatataaacactaggcttgcagagaggtgcgaggtcttaatcaagatggaatagccttagtgacaccggttcctaaggctctattgcaccctcttgttacccttttcacagtttactaggtgaggaaactgaggcctagaggggtgaattgattcactcaagcctctcagtagatctcctaattcccagttggttatccaccagatacatcagatagacaccaactctttggttctctgtgtttgtttaggcttgagagtgtgaatgtctgtgtgcatgtttgtattatattttgcataatatgtgttaaatcttaatttacctactagtattcatggtattgctttccattccttctgcatattgtattccagcacagtgcttctcaaacttaaggtgcacatggatcaattggagatgttgttaaaatgaagattcttattcagtaggtctgggatgaggctgagattctgtatttctagtaagcagtcaggtgatgacaatgttcctaatccatggcccatattttatgtagcaaggctgtggcagatggctgtgcacttgaactttcatatatatttatatgtacacacatacacatacaagtgtttgcatgaacaaaatcgggaccacacaggttatcattatggggaagaaaaacctgaatctaaaatagaatttagaaaggccatctcaccacaacaatacctctgatcttgtgctgtgatgaatcatttacatcaagtcagtgtttctgttctctaaagcagccattattcataacttgaagttaatgagtgtgtattgctctctagactctatttaaattgcttgcatacctcattgattctgaaaaccaatgtcatcttattgccctcatttgattatattttagaggtttattgataatcaaataaacatgaaagcaaataccataatggattttctggttacttactaaaatgactgggtttttaaagaggtttctcccaaggctccatcatgatttccccaggaagacattacttcaccctcagtagagtaacgtcaatgaaagtgggctgctctgggaagatatatttaatttatgtatttttgtttactctgaactcttccaggtactataagagaagctgacttattaagattgcatcctctctctctccaatccctttaatggtttatggtctaagagtagattgaactcttagacagagaagactattgattgatagaccgatagcataagcaaagataatgataccaactctgcctttcactttctttcttttttttttttttttttgttagacggagtcttactctgtcacccaggttggagtgcaatggtgccatctcggctcactgcaaccactgcctcctaggtttaagcaattctcctgccttagcctcctgagtagctgggattacaggcacctaccaccatgcccagctaatttttttgtatttttagtggacacagggtttcgccatgttggccgggctggtctcaaactcctgacctcaggtgatccactcacctcggcctctgaaagtgctgggactgcaggcttgagccaccacacctggcctgcctttcattttttgagcccctgctttataccaggcactgtactctctgctttatgtatatttgcatttttcaaatgtggatctgcagacctgttttcaagttatatttaagaatgtcttaattttgctgctcttctagaagatgccctataaccaagtttctatgtttgcatttaaaagaagaaagaaagaaaaaaaaaggggtagaccagggcttagactaggttaggtgagtgagggacttaactcacctgcaaaatggaaggaggcccaaaaaagaaacagaaaaaaacctcaggaatctagatagatattttaatgaaatatattttaaaataaaagtgccaaaatattatgatcatcaaaatatcaaaattttaagtaaagacagcatccactctgcctacacaactcaacctgcctcacttcactcttatcccagacctgctacaaaatttacatagtgaaaaaggtctcggtttcaatttctagctatgtgaccttaagcaagttactcaacctttctgatccctattctctcctctttaaattggggttatcatgatacctgcctacctcctaggatttccgttgcaattaaatgagactaaaaaggtgcagcagcgggtatgaagcctggtctgtaggaagcattctgcttcccctcctcttcctctgcaagagatccctcaacaaagctagtgtattacattttacgtggcaagccttgtagtatgagcacctaatctgtcaatttcatacttctgattccacagagcaacaagaaggccgaggtccttaaccccatgatcagtagtgtattgttagaggtaagtggcctctggagagaaagtgcttctgaatcaaagtaaatgttagaactacttttttttttttttgcctttcttcccccacagcaaatgttattgcaattctgaatctcatcatcaggtcttttttgagtaaatttgtgtagctcaaccagctgtaaaccctctgatgaagcaacaatacctaattttcaagaattcctgattataaaaagaaatgctaagcttgcacgttatttctgtcactgtttcctccagcagaagcagatttctgctgccaaatttgacactagatttaacactatgattattggctgcaatgagggattattgctcatcggtgattttcataaaaatgggcatttccttctatttagaataacctttggtttagctgggtctaatgtccaagctggcaacaatgacaaggagaatgtttagcctatgcccagtcaatgacaagggacaccatcctctgtgacttctcactctgtggcctgcccactcactaggactttgcagcatcagttgtgttgatataaagctgccccaaccaacactgctgtgtctttgccagaaatggtagcctaagagagaagaggtccaggaagatttctcattcttgaatcataggcactgtgttccacctgtagaggaaaggtagaagattggtagaggaaaatcttctgttaggggctaaactataagtaacagccgcggggcacccagctgaaggcacaaggtgttaacaagctaagtttgaacatgggcaatgcatatatcataggattttgctttctgaagtggctgtccattgcaaaatttggaaattacaaaagttcaagagggctactgtattagtccaatttcacactgctgataaagacatacctgagactgggcaatttacaaaagaaagaaatttaatggactcacaattccacgtggctggggaggcctcacagtcatggtggtaggtgaaaggcacatctcacatggctgcagacaagacaagagagcttgtgcagagaaactccctgttataaaaccatcagatctcatgagacttactcactattacaagaatagcacgggaaagacctgcccccatgattcaattacttcccatcaggtccctcccacaacatgtggaaattgtgggacttaaaattcaagatgagatttgggtggtgacacagccaaaccatatcagctacctatatatttatatcattgttttggggacttgtaccttactgttaaggaaaacgacaaaggtacagaaataactaagtgatggcactgaatattattgtttaggatgcggccgcacagtgggatggcatcagccagaaggaataggagctgtaggggcaggtcttggaggaacagacatagctaagagaaaaccctggcagtcagaggcagaatgtggtacaagaaaaatctctcccctggccacccagaaggcataaaattaacttaccatgtcaggtatgagaaatatgaggtcaaatgttttttccgtttccccaatagatgttttcacatgttttagttaccctaacctttaaatggcctctccatccaatactgtgtgttagtgcaccacaaaacaggaataataatttcagctatcccaaccaaacataaagtaccatgcataggaggataacagtgttcaagtttgccatgaataactgcccaatagtatctccagttagctttatgttgaccattcttgcttatctatctgtagggtggggcaaactgagctccttcatacagtgtttttgtgttatttcagggcagtagggttgatctgggaaagagatagataagacaggacataccctgggccaagaaagtacacacactgatggatcttaaaagtccatagaagtggctcatgcctgtaatcccagcactttgggaggccgaggtgggcagatacgaagtcagaagatcaagaccatcctggccaacatggtgaaaccctgtctctactaaaatacaaacaaattagctgggcgtggtggtgcacgcccgtagtcccagctactcgagaggctgaagcaggggaattgcttgaacctgggaggcggaagttgcagtgagccaagatcgtgcctctgcactccagcctgacgtcagagcaagactctgtctcaaaaaaaaaaaaaaaaaaaaattccatgaaaatgatttgcctcattttgagtgaattattctctctgttagtatagataattgagagctggacatgccccatccaaaagcatgtgtttacacttgctttaagcaccaatattgcaagataaatataatccaatatggggggtgggttgaagagtgggaacattatccaattggaagtattgtcaaggttgaactatgaaaataacccttcaacctcatttttctcctctcacagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccaccgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagatttttccccttt

SEQ ID NO: 769 - DNA, 20778 bp, Homo sapiens
cagtcgcggggccgccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggaggtgatggaggcgaggaatgggttcgggagcggagtgtgaggaggttggaggcggggtgtccttagaatgacaatatgaagcgccttctgtgcaccaggctttgtgccgcgcgccttcatttgctctctcgagcccgccccaccacttcataggtgtaaatgggccgagagaggatataataagccagcctgcggccacgctgtaaaaaaaaaaaaaaaaaaaaaaaaaacagagccgccgctcctacctctgcgtggtcaggctcacattaggtgccccgtttacctgcagcggtgcccagggggttactggggcgtagcgtgaagctgctgaggcatggtttgcatcaggagcggaagagcctctctcagaggaagagaaatactttcttccttgcagctgaatttattagtgcgaatcgaggagagaggggtggcattacatatttaaaatatttatgcatctgtttcatcttttgtaccgttccctagcaaatacggaatggtaactgctttcaaattagggactaggtcatgtggattttgttttgtttttcttttacatctaccacggtgttgagcatagggggctcattaaaaacatcttctcgggccgagtgccgtggcttacgcctataatcccagcactttggaaagccgaggaggacggattacctgaggtcaggaattcgagaccagcctggccaacatggtgaaaccccgtttctacaaaaaatacaaaaattatctgggcatggtgggtcgcatgcctgtagtcccagctacagcctcgggaggctgaggtggtaggatcccttgaacccgggaggcggaggttgcagtgagcctttatcgagccactgcactccagtctgggcgacagagcaggaagcaagcaagattccctcaccgaaaaaaaaaacttctcattggctaaaattataatgccctgagccaaataaagtagcaaattaactttaaaatgtacatttattttgcagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagagtaagaaatctttttttaatatattttgttgttttattttgtaaaccaagaatgggttgattcctcttgcgttttgagattaaatttttagagtttattctagatgaaaagccactttttaattgtttggcaagtgattaatccttttttgttctttgacgttctgcattactgatgaaatcatttgggagtgaattggttgcatttttactaggacaaaaaaaattgagtatctagctactaggaagaggaagtcgacatgatttaggaaagggaaataattagccgggcgtggtggtacgcgcctgtaatcccagctactgaggaggctgaggcaggagaatcgcttgaacccgggaggtggaggttgcagtgagccaagatcgcgccattgcactccagtctgggcgacagagcgagacttggcctcaaaaaaaaaaaaaaagagggaaataaaagagaattacattctcttccaccatggaagttattctttttttcttttaattgtttatttttattgaggtcaaatatacatataaaacttattatctttaccacgtttaagtgtacagttcagtcataataaacatttatattctttttccttcatacccctggagttattcttgattcctctctttctcacattcccatacccattctattaggaaatccctttggctctaccataagtgtatctaaaatccagccactactaccagtgctaccaacattatcatctcatctgaattactgtaaaaacctcctaacagtttgcctttgtagaatctagagtccattgtcaatacagaagctagagtaatccttttaaaacaactcagaatctgtgattcctctgctgaaaacattctctggtggctgctcatttcactgactaaaagtccttctctccccctcattcattcctgccacactgacccttgctcaagctgtttccactgcctaaaacccatttctatacttggttcatcccctcacctccttcaaatctttgctcaaatagcaccttctcagtgaggtctactaaaacctgccactcctcccaccccctgccactggtatattctaagtaccctagaagagtgcctggcaagagacagtacactataaatatttgttgagtgaatgaacaaaccaaaattgcccttcttccccttctcaaatatatacactggtgggtggagggaatacatacatagcataatagcttttatgtggagtttttcatgttatataacttgttacttgtatcaatcctcattctttttacaaaggaggaaacaggcccagagaacttgaatagtttgcacaagctcacacacaatttctaaatgatagagctggcacttaaacccagggtttctgactctaaatcccagacccgtctctcatcatcaaagtaaggggagaagaggtaataaaaggcaggcagaaaaaaatactttggagttgttttacttcccctttataggttgagaataaaactgaaaatgaacttctaagaagggttagggtgccactctctacttccttctccttaatttctaaagggagaaaacgtctcatttttttcttgggccaagacagaagcatctatagacctttatttactttttgtgttttgttttgtgatttttgtcagttatgtatgcacatggtttacaaaatcaagtacttctattcggcttttaaaaaatctgctaccaggctgggccggtggttcacacctgtaactctagcactttgagaggctgaggcgagcagataacttgaggtcaggagttcaagaccagcctggccaacatggtaaaactctgtctctaccaaaaaatacaaaaacagccgggcacggtggcacatgcctacagtcccagctactcaggaggctgaggcaggagaattgcttgaacccggtaggtggaggttgcagtgggtcaagatcacgccactgcactccagcctgggcgacagagtgagaccctgtctaaaaaaaattctgctacccttccccctcattttttgctacccagaagcaactactttctttctttcttttgttgagacaagtctagctctcttgcccaggctggagtgcagtggctagtctcagctcactgcaatttctgcctcccggtttcaagtgattctcccacctcagcttcccgggtagctgggattataggcgcataccaccacacttgtctaatttttgtgttttttagtagagacggggttttgccatgttggccaggctggtcacgaactcctgacctcaagtgatccacccgccttggcctcccaaaatgctgggattacaagcatgagctaccacacccagacccagaagcaaccactttcttttagctaaagcttttttttttttttttgagacagagtctcgctctgtcatccaggctggagtgcagtggcatgatctcggctcactgcagcctccgcctcccgggttcaagcgattctcctgcctcaccctcccgagtagctgggattacaggtgtgtgccaccacgcctggctaattttttgtatttttagtagagacggggtttcaccatgttagccaggttggtctcgatctcctgacctcgtgatctgcccgcctcagcctcccaaagtgctgagattacagtcgtgagccactgcgcccagccctgttcagattatttagagagaaatcttctagcttcctgcctgagttggtagtggaagagtacagaagtgggtggaaagggctgggtcttaacattccacatataaatgtctaattattcccctaatatcaatttgtaatatcaatacaacacactcttcaattgtacttgttgtccaagtccagggaccttctgttttatgctctctggaaaataattcaggtgtcttctgccagggaaatgaaagagcagtcacctagctctgcaagctaagtgtacgaatctgggtagctaactgcttcttaactatgctttgaaccaatcctccttttttttttccttcagtcaagggtggccttgaaaaatcttcctgtttttcatctcagcttcactaaacacgcacttactcattccaacaatacctggtatcacctatccctgagccttttgggggttctgaggtataaattgggttgcgcctcttatctttccttactgacagcctaagatttagttttatgaatctcctcagtaatcactcccttctgacttacagttataaaaacttatggtggaattaacctctcaggttcttttttttgagacagagtctcgctctgtcacccaggctggagtgcagtggcgtgatcttgactcacagcaacttccacctcccgggttcaatgatactcctgcttcagcttcccaagtagctgggactacaggcatatgccatcacacccggctattttttgtatctttagtagggagacagtttcaccatattggccaggctggtttcaaactcctgacctcaagtgatctgcccgcctcagcctctcaaagtgctgggattacaggcatgagccactgtgcccagcttctcatagcctctttataataaagtctcaattcaaactaattggggagatctttttgaattattgaaaaatttttaaatacttctatgtatggtaacaagtaaaggttcttaaaacaccttgcaataggccattatttgtatacgttcccttgtcagaaaactaaaaacagctttattattatccttattgaccaacaaacatttatgatggatatgtattcattaaaccctgctttaagttggtgaaagttaagactctcatcaatagtgtatgtgtaagatccaaaataatgaactttcactgtcataaagttggcattatatagtctctttatttctgtttggcaactttttccatatgtgtagaaaataagcagatttagcagtgtggcagctcttatagaaactgatcaatattttgtatctgtagcccaatcaacacaatacagtgaagctgggagctttccaggctcaggaaaaagaactggtatttgacattgacatgacagactatgacgatgtgaggagatgttgtaggtgagcactgtgtgtcttgctgttagggtgggtggtatcactgacaatgagtaatgatgactctgctttagttctgcagacatatgtcctaagtgctggaccctcatgacaatggccatacgcatcattgacagagcattgaagggcaagtatcagcagtttctgaatggggtcaagtgtaagaatcggttttcctctgactactattaactattagtctctgtattttgtgatcaaatctcattaatttgtgtgtgtgtgtgtgtgtgtgtgtgtgtgtgtgtgtgtgtgtgtgtgtgacgagtctcactctgtcagccaggctggagtgcagtggtacaatgtcggctcactgcaacctctgcctcctgggttcaagtgattctcctgcctcagcctcctgagtagctgggactacaggcgcacgccaccacgcccagttaatttttgtatttttagtagaggcagcgtttcaccatgttggtcaggctggtctcgaactcctgacctcgtgatctgcccacctcggcctcccagagtgctgggattacaggcgtgagctaccacacctggcctaataaaatagttttttaaaaaagaaagaaattcccagcagagagaccaggatgggtaaagagatgaagcaagaacatggggagcacaggaaacaacaagtaatttaatatacattaattaaggagtttatagatttgttttaaaacctattatttctctcttcctcagaggactttggatttaagcatcgtctctgggtatattctggaaggagaggtgttcattgttgggtctgtgatgaatcagttagaaaactgtcttctgcagtacgttctgggatagttgagtatttgagccttgtaaaggtaagatcctcttaattctaatttgcattgctttagtttctagatgttaccaagcctgatatgtttactgtcaaagaaaatgaaactatcttttttttttttttttgagatggactctcactctgttgcccaggctggactgcaatggcatgatcttggctcactgcaagctctgcttcctgggtccaagcaattctcctgcctcagcctcccgagtagctgggactacaggctcctgccactgtgcccagctaaattttgtatttttagtaaagactgggtttcgccatgttggccaggctggcctagaactcctagcctcaggtgattcacccacctcagcctcccaaagtgctgggattacagacatgagccaccacactggcctaaaacttatctttaatggcattcacattgcagagtaaatgatcttaccaatagatcatttaaagtcatagtagctacatgttttaagatatttcattttattttgctataaatatcttgctttgtggcatatgtaaaataatagataaaatagatttattatatataaaataatagaacatgttaaagtttggttttggttttggtttgtttttttggttttttttgttttgttttgttttgttttgagacacggtctcaccctgtcacccaggctggagtacggtaacgtgaccacagctcactgcagccttgacctcctggtctcaagtgacccttctacctcagcctcctgagtagctgggactaaaggcatgcgccaccacgcccagccaattttttaatttttgcagaaacaaggtctcactatattgcccagggtgttcttgaactcctaaactcaaactatcctcccacttcaggctcccaaaatgctgagattacaggtgtgagccactacatccagcctacaaatttttttttttttttttgagacggagtcttgctctgttacccaggctggagtgcagtggcgctatcttggctcaccacaacctccgcgtcccgggttcaagcaattctcctgtctcagcctcccaagtagctgggattacaggcacttgccaccacacccggctaatttttgtatttagccaggcgtgttggcaggtggaaacagggtttcatcatattggtcaggctggtctcgaactcctgacctcaggtgatccgcccgcctcagcctctcaaagtgctgggattacaagtgtgagccactgcgtccagccctagaaatgttttaattataattatgcatcacttaacaataaggatacatcctgagaaatacatcactttgcaaaagtcatggagtatacttacacagacccagatggtatagcctactatacatctaggctatatggtataacctattgctcctaggctacaacctgtacagcatgttactgtactcaatactgtaggcaattgtaacacaatgataggtactgatgtagctaaacatacctaaacatagaaaagtcacagtaaaaatacagtattgcaatcttatgggacccaccatctttttcttttttttttgagatggagtctcgctcttgtcaccctggctagagtgcaatgatgcgatctcggctcactgcaacctctgcctcccgagttcaagcgactctcctgcctcagcctcccgagtagctaggattacaggcatgcgccaccatgcccagctaattttttgtatttttaatagagatgggattcaggctggtcttgaactcttgacctcaggtgatccacccacctcagcctcccaaaatgctgggattacaggtgtgagccaccgtgcccaccatcttatatgcagtccatcatgactaaaatgtcgttatgctgcacatgactgtatttatattgtatacctgaagttcttttttaatgatttatttttcagggtggtcaagacgttaaaaagaaagttcacctaagtgaaaaaattcacccttttatcaggtctgttggaaaagtctccaagcactttaaggtgtctgatttaccggcatgtgcctttagagttaccttgctatcaattttcactgctgggtagcattttataataataatagctatggttaattgagtgcctattttatgctgcagtattcctaaaaggtgctttacagatgttctcattgctcttcaaaaaaaccccacaagagacttgatggtatctccatttatagataaggaaaatgagttttagagagattttataatgagcttggcatcacacgacaagttagttgttaaatttaggattcatgccctggtctgcctgactgtaaagcctactccaatgctttttccactgaattcactacttctctaggatagtggaaaaagccttatattaggagtaaaaattcctattctgccacttactatgatcttgataaaatattgacaaaatattgctgcctccatttccttatctctatgatggggagaacagcatgcactctacctgtctcacagttgtatcaatgattaagtgaaagagtaaatgtgatgcatatttgtaaactgcaaacattatatgattgttgagatattaatacaagcaattcacagtggaaagtgtaggctgcatcccacattctactactgatgtattatggtgtcctgggttggttactttctacccttattgcgtatattaaccttctaagttgtgaggtttaaaaagtaaacatttcttgtatacccattctgtgccaggttctatgtcaggttcttttcccttaaaagtgtctcatttaattatcataaccctgcacagggtagtattcccattttacctagttaagttctgaaaatgtcatgaaaataagcagtagttttccccacaatggcagcaatacctatgtggcatatgtgttactgatagtgttgggactctgttgttattgttgttcttacagaaaatctataaacataataaaaaaatactttgaagaatatgccttggttaatcaagatattctcgaaaataaagaaagctgggataagattttagcccttgttcctgaaaatatcctttcccgtgatcatttctgtgtgagctagttgttttgatctgtgatattataaatgttagacatgtctgcttgtaagttctcatatacttataagtttaatcttttttacacaaaatatctcctgtatttctggattttagtatctctggtctggaacataataaaaaatggggccatgttgcaaatcagttttctcattttggaagttggtcctagaattaacagctaaagaatggtgaattacatagtcaaaatacatgcagaccagggaaaactttacatcataccttatagttattttggcattctttctgttatatcatcactgtatttttacaggggaagatttcaatgatacaactggtgttggtttggtttggggtttttttgttgttgttgttgtttttaagacggagtcttatactgtgttgcccaggctggagtgtgcagtggtgtgatcttggcttactgcaacctccgcctcccgggttcaaacaattctcctgcctcagcctcccaaatagctgggactgcaggcacacgccaccacgcccagctaatttttgtgtttttatagagacggggtctcaccatgtcagccaagctggtctcaaatgatccacccacctcagcctcccaaaatattgggaatacaggcatgagccactgtgcccggccggatacagctgttgagtttaacatttgtggggtgggttgttttgttgttgagatggagtctcactctgttgcccaggctgtagcacagtggcacaatctcagctcactgcaaccttcaccttgcagatttaagcaattttcctgcctcagcctccagagtagctaggattacagatgtgcaccaccatgccctgctgatttttctatttttagtagagatggggtttcaccatgttggccaggctggtctcgatctcctgacctcacgtgatccacccacctctgcctcccaaagtgctgggagtacaggcatgagccaccacgcccagtcaacatttatatttcaagaaatgttaataactactttctgaatatttgtaagacacccttgtggtaatacatacttaaaactaaattgttcattgatgttccctaaatgagtctgttccttaatgacccatcaccaattcatgatgaacttcaacaaagcttccaaaagtctcacaattcacttcagcgttgggagcacttgaagaaagtagccagcagatatcaggtatatgccactgaaatctgtattacagatataataatgcaattcttaattaaattgattgctttgcctagtcagttaaagatggttgaagatcgtttttttaactttctttaaagaaatcttcaacagttcctactgatcctcatgttggccttgtatctgcttttagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtactacacaaggaaactaaggaaaactaaaagaaaaatgagttgctattggctttagtaagcatggcattaggtctgaatatatataatgtctatgatttaaaggtagaagaattgctctgtcacccaatacctaagtcagttaagtagctaccagatgagtttctactatgtaactgtttttcagttgggtttctgaggttccatattagatttggagaggaccatcaaaatcttaggacaacagctctcattgtacagatgagaaaacagtggcccaagatgtaacccatccaaggtcataaaaaaaaaattgtgtgtgactgtatgtggtagcttgctcctgtaatcccagcacttgaggagggcaaggtgggcaaatcacttgagccccagagtctaacaccagcctaggccacatgtctaaacaccctttgtacaaaaaatacaaaaattagctagacgtggtggtgcatgcctgtagttccagctactcaagaggctgaggcaggaggatcacttgagcctgggaagttgaggctgcagtgagctgtgatggtgccactgcactccagcctgggcaacagagtgagaccctgtctcaaaaaaaagaaaaaaagaaagaaatgaaatgaactctactcctagcactgacaaaaacaaaaaaaaatttttttcgagaaagagtctcactctgtcacccaggctggagtgcactggtgcaatctcggctcaccgatcggctcaagcgatccttctgcctcaccctcctgagtagctggtactacaggcatgtgctaccacagccagctaatattttgtagacagggttttgccatgttgcccaggttggtcttgaactcttgagctcaagcaattcacctgccccagtctcccaaagtgctgggattacagacaagagccactgcgcccagcctcattacgtcacttttgagatgtgttaaattctatatggtatcctaggggggtattataaaagagtagaggaatttctattttatttcctaaatgctttttaaaggtgtctgacatgtgggtatctgtattgatctcaaataaaccaagccaatgtaaatattatagtttcatctattttgttctattttcaggactcactaactctgagattgttctgaacttaaatatggaatatttaaatatactttatttctaaatatagaaataaaagtagggataagagcaactgggaaatagctcaacagtcttcacatttgcttattggtttttgtttttgttttttttctttccttttttttcgagacagagtcccactctgtcacccaggctggagtacagtggcgcgatcttggctcactgcagcctctgccttccaggttcaagcaattctctgcctcaccctcccaagtagctgggattacaggtacccgccaccacacccagctaatttttgtatttttagtagagacggggtttcaccatcttggccaggctggtcttgaactcctgaccttgtgatccaccctcctcagcctcccagagtgctgggattacaggcgtgagccactgcacctggctggttttttaaagagaaataaaaggcatgctggacatggtcattcacacctgtaatcccagcaactcaggaggctgaggcaagaggattgtttgaggccaggagttctgggcaacatagtgagaccccaactcaacaaaaattgaaaaactggccaggccaggagcagtagctcacgtctataatcctagcactttgggagacaactgaggtgggaggatcacttgagcccaggacatcaagcctgcagtgagctatgaccatgctactgtatgtactctagcatgggtgacaaagtgaggcattaactctaaaaaagagtaagggcacagctaatgtgaaagtaatttatatttctaaatactcttcttaacagataagtttaaccctttgtctaagccttaaataaaaattttaaccaaaaataacctgtaggagatgactataatgatttatagtccacaatcatcagtttataacttttgtgtcttacaggtcgcatatctgtgcctattgatttgcagaaagtggaccagtttgatccatttactgttccgaccataaggtatgtttcagatcattgatcactccttgtttgtaattgttgttatgaattttaaataaattgaattagcctccttagagaagtagttgcatgggaatggtatatttggttatggaaaccaaataaggttcaaaggttagatgacgatgccctaatagaacaatacaagattttcacctgctgttatgtaagaaaaagattttaaggtcaagtaaatttaggaaattctgacttaaacagattaaaagtatcttttactacagtatttcacagtctttcatatgataatatgcatgaaaaactccaagaagagatcatggtgtttagaatatcccaaatttagctggccgcataatttttttacagtaaattttatgggattcacatgctattatacactggataatgctgatcagaaaccaacattaaacttctcttgttcgtggtgaggcgcggtggctcatgcctgtaatcccaacactttgggagggcaaagcgcgtggatcacaaggtcaagagatcgagaccatcctggccaacatggtgaaaccctgtctctactaaaaatacaaaaattagctgcgcttggtggcatatgcctgtagtcccagctacttgggaggctgaggcagaagaatcacttgaacctgggaggcggaggttgcagtgagccaagatcgcaccaccacactccggcctggcaacagagcaagactccgtctcaaaaacaaaaacaaaaacaaaattctcttgttctgttacttgcagcttcatctgccgtgaattggatgccatttccactaatgaagaggaaaaagaggagaatgaagctgaatctgatgtcaaacatagaaccagaggtaaggtaatattttgaagcttcactttaaatacagggtttttatatagatatccatctgtcactccagtaattaattctctgattcaactagaatggatcagcatttgtcctggaactgcatacaatgtttgtgtcctttcttcaacagcagcccaagtggtgttattgaatccagtctgattcaacacatatttcctaagtaacttttaatgctaggatctatactgtaagattaaactatcaataagtatgaataatcagtctctgagattcaccacctatttatttaacaactattatatatgcagtactttttttctttgtttctgatgcatataggtgggttttatggtaaacatatgtctaaactgtttaccaagttgtatattcaagaatttgaagaagctggctgggcgcagtggctcacgcctgtaatcccggctctttgggaggccgaggcaggcaaatcacttgaggtcaggagttcaagaccagcctggccaacatggtgaaaccccaactctgctaaatatacaaaaatcaaccaggcatggtggagggcacctgtaatcccagctactcgggaagctgagtcaggagaatcgcttgaacccaggaggcaggggttgcagtgagccaagattgtgccactgcactccagcctgggcggcagagggagactgtctcaaataaacaaacaaaaaaaaagaatttgaagaagctaaggaatttctaaatcttcctgctaatggaaggcaaatctaacacctaagagatactgcaggccaggcgcgatggctcacacctgtaatcccagcactttgggaggcccaggtgggttgatcacctgaggtcctgagttcgagaccggcctgaccaacatggagaaaccctgtctatcctaaaaatacagaattagccggctgtggtggcacatgcctgtaatcccagctgctcggaaggcagaggcaggagaatcgcttgaactcaggaggtggaggttgcggtgagccaagatcacgccattgcactccagcctgggcaacaagagcaaaactccgtctcaaaaaaaaaaaaaaagatgccgcatagcagcgcagcactccccaacctttttggcatcaggtaccagttttgtggaagacaatttttgcacggactgcaaagagagggggaggagttggggatggttccaggatgaaacttttttacctcagatcatcaggcattagattctgataaggagtgcgcaacctagatccctcacatgcgcagttcacaatagggttcatgctcctttgagaatttagtgcttctgctgatctaacataaggcagagctcaggcggtaatgctcgcttactgctcacctcacacctgtaatcccagcactttgggaggccgaggcaagaggagcctaggagtttgagaccaccctgggcaacacagagagaccctgtctctccaaaaaaaaaaatttagctagacatgctggcaggcacctgtggtctcagctactcaagaggctgtttgagcccaggaggttaaggctgcagtaagccttgaccacaccactgtactccagcctgggtgtcagagagagaccttgtctcaaaatgaaaattatgtggccgggcgcagtagctcacgcctgtaatcccagcactctgggaggtcaaggtgggtggatcacctgaggtcaggagtttgggaccagcctggccaacacggttaaaccccgtctctactaaaaatacaaaaattagccaggcatggtggtgcacacctgtagtcccagctattcaggaggctgaggcacaagaatcacttgagcccgggaggcagaggttgcagggagctgaagttgcgccactgcactccagcctgggaaacagagtgagacttcgtctcaaaaaaaaaaaaagtataatttctttcttactctttttaaagaactattatgaggattcttaattccatgcaaacgtaggatactactaaaatccaaattttatgtgaaactcctttcttattctcaatcatattttcccattgggtatcattataggttatataattaaatggatgaataaaattgtatattctttttttttttttttttttttttttttttagagaaagagtcttactctgtcacccaggctggtgtgcaatggtgcaatctcagctcattgcaacctccgcctcctgggttcaagcaattctcctgcctcagcctcctgagtagctggagttacaggtgcccgccacgacgtccagctaatttttgtatttttactagagacagggtttctccatgttggtcaggctggtctcgaactcacgacctcacgtaatccacctgcctcggcctcccaaagtgctgggattataggcatgagccaccgcaccctgcctatattaaattttttgttgtatacattttttaaactattttataaatcaaagaatacttaatgcaggccaggcgtagtggctgatgcctgtaggcccagcactttgggagcctgaggcgggtggatcacctgaggtcaggagttcaagaccagcctggccaacatggcgaaaccccatctttactaaaaatacaaaaattatctgggcgtcgtggcgggcgcctataatcctagctactcgggaggctgaggcagaagaatcgcttgaacccaggaggtggaggttgcaataagccgagattgccccactgcactccagcctgggagacagagcaagactccatctcaaaaaaaaaaaaacaagaatactcaatgtaaaaacttctaataatctccaaaagggcgtgaccagagcctgagcaacacaagaccttgtctctactaaaaataaaaaattagccagctgtggtggcactccctgtgatcccagctacttgggaggctgaggtgggaggatcatttaagccagggaagtcaaagctgcagtgagctgcaattgcaccactgcattctagcctgggcaaaaaagcaagacagtgtctcaaaaataagacatggggccgggcacggtggctcacgcctgtaatcccagcactttgggagactgaggcaggtggatcacgaggtcaagagatcaaaaccatcttggacagcatggtgaaaccccgtctctactaaaaatacaaaaacttagccgggcatggtggcacacacctatagtcccagctactcaggaggctgaggcaggagaatcgcttgaactcgggaggcggaggttcccgagccaagattgcaccactgcataccagcctggcaacagagcaagactcaaaaataaaggcatggaccgggcgcggtggctcacgcctgtaatcccagcactttgggaggccaaagtgggtgaatcatgaggtcaggagtttgagaccagcctggccaacatggtgaaaccctatctctactaaaaatacaaaaaattagctcattgtggtggcgggcacctataatcccagctagtcgggaggctgaggtaggagaattgcttgaacctgggaggcggaagttgcagtaagccgagatcgcaccattgcactccagcctgggcaacagagtgacactctgtctcaaaaaaaaaaaaaaagaaaatatatgtatatatattatatatatatatataaatataaaagacttgtatgaaagagagtatcatatatctcaatttttattacatgcaaaaataatattttagctgggcatggtggcatgtgtctgtaatcccagcactttcagaggccgaggctgggagatcactcgagctcaggagttcaagactagcctgagcaacagagtgagacctcgtctctacaaataccaaaaaaaaaaaaaaaattggttgggcatggtggtacatgcctgtagttatagctactcaggaagcagagatgggaagatcccttgagcccagtagatcgaggctgcagtgagccaagacggaaccactgtacttcagtctgcatgacagagtgaaatcctgtctcagtaataatttcaccttttttaatgtgactaatatagtatttaaaagtatgtatgtttctctcatatttcaattgggcagccctagagaattcttataagaaacttagttgtgttttcatgttattcttgctgccagtatgctaattataatgtacattcttcataatttagattataagaagaccagtctagcaccttatgtgaaagtttttgaacattttcttgaaaatctggataaatcccgaaaaggagaacttcttaagaagagtggtaagacgctatgcctttcccttctatctagttagatcttattattagtagaaatgagcaatttttgagttctagtctttctttgccctcctcccaaaatttacagatttatcttactatccttaatgttttggaaattgaggttccttaattcaatttaacacatagttattaaacacattctaagtatcaggtctataagggagacaaagatgaattaacatcatgcctccttgcccttaagaagtactaacttggccaggcacggtggctcacgcctgtaatcccagcactttgggagaccaaggcagttggatcacttgaggtcaggagttcgagaccagcctggccaacatggtgaaaccctgtttctactaaaaatacaaaaaattagctgggcgtggtggcaggcacctgtaatcccagctactcaggaggccgagacatgagaatcgcttgaaccggggaggcagaggttgcagtgagctgagatcacaccatcgcactccagcctgggcaacagagcaagactccatctcaaaaaaaaaaaagaagtactaacttaatacaaaaaaaaaagtacaaaatgctaagaaagagattttatctgatggactctgagatttcatatgaaaatggtggtatctgaactcctttcagtgtagctgctgtaagaattctaatccctagccgggtgcagtggctcacacctgtaatcccagcactttgggatgctgaggcaggtggatcgcctgaggtcaggagttcaaaacaagcctagccaacatagtaaaaccccatctctactaaaaatacaaaaaattagctgggtgtggtggtgggagcctgtaatcccagctactagggaggctgaggcaggagaatcacttgaacccaggaggcagaggttgcagtgagctgaaattgtgccatcgcactccagcctgggcaacaagagcaaaactccgtctcaaaaaaaaaaaaaaaccctaggccggacacggtggctcacacctgtaatcctagcactttgggaggccaaagcaggtggatcacctgaggtcaggagttcaagaccagcctggccaacacggtgaaaccccgtctctactaaaaatacaaaaattagccgggcgtggtattgtgcgcctgtaatcccagctacttgggaggctgaggcaggagaatcacttgaagctgggaggtggaggttgcagtgagccaagatcgcaccattgcactccagcctgggcaacagagcaagacactatctcaaaaaaaaaaaaaatttctaatccctaatgccaatatactataccataaggtatgagaaggatttccacaagcagaaatatgataagataaagggtatggaggtggaaaaaggccaagggttgttcattcttgaaggaacatcaagagcaaagacagacaggaaagcatccagttactctggaagccatcaagtagtacagctaatctagtatatggtgtgtccagaagtgatgggctataaatccaaagaagcaaactgaatggccttgaattccaagcttatgtgtttgggcttggttttgggcttaataggaagcttttaaaagttctgaggaagggaatgccatgatttgtagtttttatctagaaagataaatctgggcaagacagggactagaatagagcccaagaggccaactgcgctattgccactagaacagtagcactggagatctccgaaaggtgcaaatactggaaccatccttgagacttgctaatgatttagaagtgaagagatgaaagatggaagggaaaatgttatagaagccaggggaaagaaaagtgcaagattatcaagtgtcaggtacagtaggaaactaataaaatcctgctgcatataataactggaaagaaacacaaagaggatagcagtgtcaaatgaagggtactctaaatgggagacatatgagcatatgtataagccaatatgaaaaaaatcagcagattgaatattattcaagagatgaaggctactctagaaaactgtgacaatgttatagcaatacaaattatcttgccacttcattttttatttaaatatgtgatagtttaagcagtagtgcctaagataatgctctactcagtagacactcatatgtgtgattattggatgaacaacaactctgagcttggaaagcctggttgaagctgccattgcaactggccgtattaagtcctttgtatcctcactgttccatactagctcagcctatgatgtggacttcagcaaatgtgtaagcaaatctttgtgcatgatgtgtgttaaatagaagcattaggcaaaaaagaatgtaaaagtaaatgggctttgttttgtttcctttgctgttcttccatatattatctattctattttagatttacaaaaagatttctgaagacagagctcctcaaaccattgtggatatcttctgccttcaaccacagatcaaatacttcaagagccatttaataaatatggcagaactatatatgtgtcttaaacctcaaagtaaat

SEQ ID NO: 770 - DNA, 45715 bp, Homo sapiens
atgcgagcggctcgtcagcgcctgcgcgcagcctgcggggcgggacgcaaccccggggaaagcgcgagacctccctctctcccgcccggctgaggcgaggtggggcttttgggaaaattacataatccccgcccctgggccggaactgccctcgcctatcccaatcctcctacctaggattccgtcaagttgacgtcacacggaaccggtgctccggaagctaaaggtggccatgctgtgtgggaccacgtggccagaggcaagagtgtcgctctagtagtatatgcaacagtttaaactataggcatgttcatgtaaatatggtttctgtccaacccgttttctcttgggatttttggctagccccttgacgccactttttcttcattcgcagacccactttctagatgggtcatgaacactgtccacccaactgcagtttcccgtcagagtatctgaggagcctgtgaggcgttctggagctttaaggtcaggcgccttccgggagccgtagccccggccccgcccttctgcccgcgcgttcctcactgcgcatgtcgcgtttttgttcccctccccccttcagcaacgggccgtgaggcggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggtttgtgcgtggggtttctggacgcaaggccgccagtccttgggggcactggaggcaactgctgggcctagcgagggcggaggaaccgcggcctcgcttaacaaagagtcggcagagcctcggggcaccggcggccggggtgccgggaaggggtgggagtgggggctgaggcctctagggttccttcctagccgcgtcgccctcccacagctcccgcttccctcacaagtcttaccgaggcccagttggcggctttccggaggcggcgccccctcgcctaggaaaaggatttgcagggtgcccggctccagggcaggaatagcgcggggagaattctgacccaaggaggcagcgcttgggagatgcaggcctccgaatttggggtcctgagaggcaaaagctgccaaatgagaggagtgaaaagatataggcgatgatctttgtgcagcgttgagtaggtcgattattagcatcactgtagtcacacaaacttttttgcggcctacttgagagcgtatctgatgtgaataaataatttacatggaattgcaaacatatgcatcaaaaacaggagaagctgtcgagagttttggggaattacattctcatcactgagaatttccctcttgcccccactcctataggcagttatccaatttcttgtggcttccctgtgttttctttttgtcaatgatgtttctatgtctgtcctctctcgtatacacacccaggacttcctcaagcgcagggactatgtcttaaggcgctttgcagagccaagctcatttctggcacataagaggtgagcaatgagtgtttcgtacaaaaattaatgtttatattttgacagctgggaaaagaaaatatatcttcctgtacctggaagaagcattgtgtagcctaatgtgcaattcgttcattcaaggggtatttttattggtgcctattctctagcgccgttctaggtgatagggataggtgttagacccctgcctttggggaacttaactttctagtagcgggaggagaggcaaacagatacatatattatactgaatgttagaagatgatcagtatcttagggaaaagaaagctggaaagggggttggggaggtggtggtgttggaatttgcaataaagtggtcagggaagtccatacagacaagctgatatttaagcggactagaaggtggagtgagagcctacgtttatctggggaaaggaacgttccaagctagagaataacaaacataaaagccttgaggaggacaaagctggcccgttaagagtgtgaagaccaacgcgtttggagcactgtgagctgagggagtattaggagataaggtcagggaagaattgggggaagggagtgagcggaacaaccaaagccttttaggctgttacttaggaaggatctgagggtttcgatcagaggaatgataatatctgatttatattgtaacaatttaatataagagaggagtgcagttatttaaatttgttttgttacattgatagtcatataatcagctcttagttgctttaagctgacaggagaagggatgcttctaaaataaccataacctagcatttacttgtatttggtttagaagaatgtgattacgttcttgagtttttatttagattctcatcaaagaactgacctgtatatagtgtgtgaggtactctcaaagtatatgtagagtagatgctaatcactgtcactagaactcttccttccacctccaaaaatacaagtgataaagtaatgtggcttatataatcagttgtttttagtccactatatttaaagtcatttagatcatatcttattttccgccattgccgaaaacacaaactagctaaattgtcttcctttataagtgtgttccacatttattctcacttcctagcctttgctagttcagtctttctccctggaatgtcttcgtctgcacgtctctacccagctttcatctttctgtgcctagcctggcttctgactctgttatgacacttgcccttgcttgttagctcatggtgatctctgacatcttcagtgttcttgtggcgcttatgtatgaaatacctgagttgaaagaagtctgatagtctcaatttaccgatgaagaaattggttcttcagaaataatgtaataatgaaaaacacgatggtagctgacatattgaacaagtacatttttgtgtatgaacttaatttttcacgccaactcttgagataggtgatagtctcatcttttttttttttttttgagatggtgtctggctgtgttgcccaggctggtcttgaactcctgagctcaagtaatccgcctgcctcagcctcccagagtgctgggattacaggcgtgagccaccacacacagcctcttaccattttttatagatgaggaaactgaacccagagaagctaaataacttccctgaggttcatatcaagttagtagcaaagatagtttacacatagcctgtgctactttactattctgttaagatttcctaggaaaccaccgtgttttatttattttttagagactgtcttgctgtgttgcccaggttggagtgcagtggtccagtcagctcattgtaacctggaactcctgggttcaagcaatcctcttgcctcagcctcctgagcagctaggactacaggcgtgtgccaccatgcctggctaattttttaaatttttttgtaaagacagggttttattgtgttgcccaggctggtctcaaactcgtggccttaagtgatcctcccaccttggcctcccaaagggcgaggattacaggtgtgagccaccttgcccagccagccataggatttagtgcctagaaccataccaaataggacttgatgccatcttgactgtttctcttcagcctagttgtagatctcctttagtcttttacatattgaataaatgagtatctaatattgaaaacatgctataagagaaaagtgaataagcctgtttcttcagccatgaatcctataatacggagttggactggaaagggagtttgaggaaggagatgccatttctttttctttctttttttttttttttgagacggagtctcactctgtcgcccaggctggagtgcagtggcgcgatcttggctcactgcaagctccgtctcccgggttcaagtgattctcctgcctcagcctccggagtagctgggactacaggtgcccaccaccacgcctggctaatttttttgtatctttaatagagatggggtttcagcatgttagccaggattgtctcgatctcctgacttcgtgatccacccgtctcggcctcccaaagtgctgagattacaggcgtgagccaccgtgcccagccaggagatgccatttctttggggatatcatattcatgtctttaggagttggtatttgagatatgctttgaaggataggactttggtaggtactcacagtttataggaaagagatttgatgtgaaggggatccagttagagggaagaggattcactagagtgcttgttttcctggaaaactgagtacgtgtggagagaccctgggaaatatgaatggtaaagtagtttgatgccacaatggagggtctcattccagcatgattaactgtggagagctatggaattgaggagagtgacataatcagaaatgtgtgttctggaagaacctggaaagggttttcgataagcatctgaatactgacctcccttctgtgagactttttctggttccacggtattaacacacactatgctactctaccaaaggaggtaaaacttgcttttctcttttcactgtgtgtctcactattacttcatcattttatgctttactaaacagaatcacttctcatagactatggaagatttgctggttttagatgaagcatctggatgtacatccacattacttttccaataaaacagacattcttgggacagtagtcaggggaggattacctgtcaaatgtcattcatctcagagaggccttgcctgacttaagtctgcaatagcttgcctcttaccctcttgcttgcttttcatagcacttttgctacctggaattacatgatttagtttttctttctcctgggccagactgtgaactctgagtatggctgcatctgattccattactgtatccttagcaccttagagcagttactggcacaaaataggcactcagtatattttgacttagtgatcactctagtagtgctgtgagagcttgataataaagttttttttttttttaagacagcatctcgctctgttatccaggctggagtgcagtggcacgatctcggctcactgcagcctccgtgtcctgggttcaagagattctcctgcctcagcctcctaagtagctggaactatgggtgcgcgccatcacgcctggctaatttttgtatttttagtagagatggggtttcaccatgttggccaggatggtcttgatctcctgaccttgtgatccgtccacctcggcctcccaataatcagaaatttttttttaggaaataattgcaatagtggaggtggagatggaaaggcgggtatacgtgagggatgtccctcatagtactgggcacataacaaaatcatcagtggttattggtcagtataaaacaatggatgttattactaagaaccacttagggttgttcttttttaaacaaatactcattaaactttgtttatggctctattcagctaattcttttcaaattaggtatttcaaaagggttcttttttaaatttttattttttggcaccccagcaggaaatgaagaaatcttttttaagagaaaaaatacaaaaatgcagttgaatttccccaagtgtgttttttttgtttgttttggttttgtttttttgagacgcagtctcactctgtcacccaggctggagtgcattggcatgatctcggcccactgcaacctccgactcctgggttcaggccatcctcccacctcaacctcccgagtagctggggctacaggtgcacaccaccacacctgggtaatttttgtattttttgtagaaatcaggtctttcattgttgtccaggctgacctctaactcctgagctcgagccatcctcctgccttggcttcccaaagtgctgggactgcagttgtgagccactgtgcccacctcattttgttttcttcttttggtactatcaccacaatctagccacaggacacttttcatcttgtaaaactgaaattctgtacccattaaacaataacaccctattctcccctcctcgcagcccctggcaaccactcttctactctgtgtctctgagtttgactattctaggtatctcttttttttttctttttgttttctttgtagagatggggtctcgctgtgttgcccaggctggtctcaaactcctggcctcaagccatcctcctgcttcccagagtactgggaatataggcgtaagccactgcatctgcctcttttatttttttagtaaccaaatagaaatttgggtggctatcttttgcttcttctgtcagctatactcccacaaatctctgtgattgtcaaggttcagtaaccatatacactacatggtttaatagtaggaaaaactgccgggcacggtggctcacgcctgtaatcccagcactttgggaggccaaggcaggcagatcaccggcggtcgggagtttgagaccagcctgaccaacatggagaaaccccatctctcctaaaaatacaaaattagccaggcgtggtggcacatgcctgtaattccagctacttgggaggctgaggcaggagaatcacttcaacctgggaggcggaggttgtggtgagctgagattgcgccattgcactccagcctgggcaacaagagcgaaactgtctcaaaaaaacaaaaaaaaaaaaaagtaggaaaaactgttgtcaagagacttaagtaatgatccattgaggatgatctggcttagatttaatcaggaagggtggttagctagataacaaggtttgtagtaataaaatagagttttcataaatactgggatgaattttggagagcctgaatacattacatttattcatacagcaaaattttttgagtactatgcagacaccaaggatatagtgctggacaaattgagtcaagtctatgccctcatagagctaacattctactcagggtatatagaaagcacagttccttggccttcctagagtcagtaattgagggacaatgagctgtgtgttctagatgagctagggaaaggatcgcttttccaacttgctaagtcttgagagccagtaagcaaccctcacctgcccaaggtctcactgcctgcctgtttgtggcaggagttgatttgctgcttttgtaatatgaaccttttgattatttaatagggctgattcatagtcatgtttgttcttttcactccttccctctagctttgggggaagagtgagttactcctgttgttaaaagttttgattgtgtctggtcttctctggaaatcctatgacttttttctgtcattttgcatcttcagtttttcagactttactggtttttcccctttagcatataaacatgcctatgtttctttaaaaaataaaatttctgtaggtaatgcttcactttctccttcctatcattgataaacagcctacaaagtactcttgactcctcttgacctagtcttcatcttctactacttacttgccaggtactcctcaaccctgtccctactgctccattgaaactgctttcactgatgactcctggttgcctatacaacagaagaattttagttctttttgttttgtttttttgagacagagtctcgcactctcgcccaggctggagtgtagtagccggatcttggctcaccgcaagctctacctcccaggttcatgcctttctcctgcctcagcctcctgagtagccggaactacaggtgcccgccaccacgtccggctaattttttgtatttttagtagagatggggtttcaccgtgttagccaggatggtcttgatctcctgaccttgtgatccgcctgccttggcctcccaaagtgctgggattacaggcgtgagccaccgtgcctggcacattttagttcttaacttacctaacttctctttagttttctgcctatagagcttctttctcctcacccgtgttcctccttgtctccccttccttctttccccctcttctttctttcccttccccaatccctgttccatctgaagtttccatgtaagcttctctttttctgcccattcctaaatagtgatatatgttaagaattgtcttactgggccggatgtggtggctcacgcctgtaatcctagcactttgggaggccgaggcaggtggatcacgaggccaggagatcgagaccatcctggctaacatggtgaaaccccgtctctactaaaaatacaaaaaattagccgggcctggtggcaggtgcctgtagtcccagctactggggaggctgaggcaggagaatggtgtgaacccgggaggcagagcttgcagtgagccgagattgtgccactgcactccagcctgggcgacagagtgagactccgtctcaaaaaataaaaataaaaaaagaattgtcttaccagctgggcgcagtggatcacgaggtcaggagtttgagaccagcctggccaacatggtgaaacctgtctctactaaaaatacaaaaattagctgggcacggtggtgcgtgcttgtaatcccagctactcgggaggctgaggcaggagaattgcttgaactcaggaggcggaggttgcagtgagccaagatcatgccattgccctccagctctgggcgacagagcaagactccgtcttggggagaaaagaaagaattgtcttacttcttttctcactctgcatggtctctctgctagcttatttacatcagtaacctcaaatgcaaatggcttacatcaaatctatagctcactccggacccctctctgcagttactgcccctgcttggcatctctactcagctctctcatagatactgaactcaccttttgcctaattttgcaaacctggctcttttaggtttccatctccattagtggctccacagttcacccagtctttaaagccagaaacttctgaagttattctagactcttcttccttagcttccacaccaattactggtcacacaatcctaattgatctttcctcagatatctaaataaataactcagatccatcccccgtttctcctttcccacaggtgctttcttagttcagaattttgtcgctttatacctgcgttgctgcaacagccttctactttccttgcctctaccatgagtatctctcattctgtctttcaaaaacactgatctgaaaatttcccttctgtgtaaaattaacgattctttgtagctggcagaatacagttttgtatggtacgtcgttagcatagccttctaagctgttcatcttggccctacctgtctttctgaacatgtgtcctgcaaatttcccaaatgtgctactgaactctagctgcactgaactatttcttgttctctgtggtaacacttaacagatccttccatctgaaatgcccttctttaatgcctctttgatctaatgcctcttgaggtttcaaaatttaacatgtcatctctcagaacacttctatgcctttgctcccactcatggaccaccagtgaatgcactctgtatagtacgtctgttagaacgcatcatgttgttttcagctgcctcagactgcactgtctactccttgagaacagggactgtatctttcatgtatgaatgcctagcacatcatataccacctgaccttctcagcaagctttcagtaaaccattgaaagttttcctgctaggagattgtgtgattcttaaaatccacctgaacgtaaatgtctttccactatcctttctttgccttctcatccttatggcttattagctccttgttatacattgtatacactaggaaaaatgagattaaaattgagcccatcctttttgttgcttgggaacacctcttgtaaagatagcttatagattagtttaaaaacgtcagatgctgaaattttcttgcttgtaaagattcttactaaatttcatcacactggaattacgttgattccttgattgaaggaatccccttatgggattccgaaagacagcaggagatgaagttcaggtaaattagtacttactaaatacataccttagtcattctcactgttagagaaggaagtccaaaatgagtaaagacagtttctatctggagttaagggtctaagtagagattgatgtagtgtaattcaagtttaatactaagcagcctgggtgccgtggctcacacctgtaatcccagcacttcgggaggccaaggtggttggattgattgaggtcgggagtacaagaccagcctgcctaacataacgaaaccccatctctactaaaaatacaaaaaattagctgagcctggtggcacacgcctgtaatcccagctactcgggaggctgagacaggataatcacttgaaccatggaggcagaggttgcagtgagctaagattgtaccactgcactccagcctgggaggcagagtgaaactctgtctcccaaaaaaacaaacagacaaacaaaaaccttaaaactaagcaaacaactaagtgctgtgtataatagcagttgaacaaaacctatgaagtatatatagacaaggggtatagaacagtgcatgtttctgatctcttcgacaatgttactataataaacagtttttggaatttttttccaccctggcttcaaagctagtggaaattaaaattaaagtaaacattttaatttttcttactaatggtaaacaaaataaaaatcaaatagctgctgttaacattttgataaacagcctgtcagctgtctctgtatatataactcatggtttttacataaattaaatcatactacccaccttgttttatgcccttattttactcaatgtgtaatggatactttttcataaatgtaagtagtagttaaaatttttaggccaggcaaggtggtgtgagtcatgtctgttaattccagcactttgggagactgaggtgggaggactggttgaggccaggatttcgagaccagcctaggcaacatagtgagaccacaaaaaattaaaataaaaacccaggcatggtggctcatgtttgtagttccagctactcaggaggctgaggtgggaggatcacttgagcccaggagttcatggctgcagtgagctgcaatcagaccactgtaatgcagcctgggtgacagcaagaacttgtcttaaaaaaagatttttttttttaactcagaatgcattttcctttgagcagttgcattttaaaacttgttcctaaggaaataattgaaggtatgcacaaagatgtagctataatgatgtgttttgcaacattgtgttaccagtattatactgtcaagtagtgaagaaatagatatctattgacattaaacaatatcacagtatatcattaggtgaagaaatcactaagacaatatgtacagtatggtttcaatttttaatttgtgtgtatatacacatatgcatacaagtagcaaaaaatagaacaaaactacatatctgggagaggaaatttcaggtagttttaaattttgttcttttttgctttctgcttttctgtaaaacttaggtaagttgtatcattaaaaagggttttggggggccaggtgcaggggctcatgcctgtaatcccagcactttgggaggctgaggtgggtggatcacttgaggccaggagttccagaccagcccatctctactaaaaatacaaaatattagctggatgtggtggtgcacacttgtaatcccagctacccaggaggctgaggcatgagaatcacttgaacccaggcgacagaggttgcagcaagccgagattgggccactgcactccagcctgggtgacagatcaaggctctgtctcaaaaaacaaaaaacaaaaaaattttttttgggccaggtgcagtggctcatgcctgtaatcccagcacttagggaggcagatgtgagaggggggggtctcttgaggctagaagtttgagaccagcctggacaacatcacaagaccctgttccttaaaaaaaaaaaaaaaagaaagaaaaggtttttggagccaagactaatgtaaggtattgtttgtaaattgattttatgaatgcacaagaaatttctttgtaactcttaaccacaggctaactgaatacttcaggcaacatgtcagtgaatcatagtttcttcctggatagtgtttctattgggcagttgttcaataaatacatggttcatagtacctttcctgcagacatgaatacatagatactgtctacaaacaactgatcttttaagttttgattctttgattcttccagatgtcattaccagaggataacctctagttttcggagagtcttggctgatagcagctcagtctttcatataaggatgaagatatttagtcttttcatatctccagtggccttgcacatatcagattccccaaaatatttctttttatgagtatttttgtcagcttaataagatgttaattagcaggcaaatccttttggaggggatgatattaaatactgcattctggtttatactgagatcccaataaaattaaaacaatttcttcagtgttttagaaaatataatcatttgttgaggctagcatggtgtgtatctgaaatacaatgtcaacttttgtgggttttgtttttgtttttttaagagacaggatttcactatgttgcccaggctggaatacagtggctattcacaggcaggatcatagcacactgtaaccttgaactcctgggctcaagcagtttacctgcctcagcctcctgaatagctgggctggaaatgaatctcttaatgagatggattttcttttcttgtcttttcttttttaatgtaaaaagagacaatctctgtcacccaggcttgagtgcagtggcgtgatcatagctcagtgtaatctggaactcctgggttcaagtagtcttcctgcctaagcctcccaagtagttggcattactggcctgggccactctcctgactacagtgttatagttttaattgagaagctaaaatttaaaataaaattttaggtggaggttggaagagacatacaactcagtggggctatatacttcttttttgtttttgagacggagtctcgctgtgtcgcccaggctggagtgcagtggcacgatctcagctcactgcaacctccgcctctcagattcaagtgattcttatgcctcagcctcccaagtagctgggaccacaggcatgtgccaccacgcccggccaatttttgtatttttagtagagaagggttttcaccatattggccaggctggtcttgaactcctgacctcatggtccacctgccttggcctcccaaagtgctgggattacaggcgtgacccaccgcgcccggcccttggggctatacacttttttaagtttaatttatatttgtgtatcttattcctaacaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcgtaagtggtaattcctggtagtgtagcaaagtttggactttgatatattcattctatcagcagaaattgaggcaaagaaactttgtttctcaaataataatgaattcttaaattatgtgtctcgctgaattccattgttcctaataagttaaattatcaggtttactcatttgtaaggaatgtaatacctgtggtgttacttatacctttactcattcagtgttacgtcctactgggctgttgctcactgtgggattagaagccattgaaacaggctgggcgtggtagctgggcgtggtggctcacacctgtaatcccagcactctgggaggccgagacggatggatcatctgacgtcaggagtttgagaacagcctggccaatatggtgaaaccctgtctactaaaaatacaaaacattagccaggcgtggtggtgcacgcctataatcccaactactcaggaggaggctgaggcaggagaatcgcttgaacccgggaggcacaggttgcagtgagccaagatggtgccattgcactccaacctgggcgacagagcaagactcccatctcagaaaaaaaccaaaaagccattgaaacataaatatggctgaagagttttatataattcatgtggtttttttttttttttttggaggcagagttttgctcgtcacccaggctggagtataatggtgcaatctcggttcaccgcaacttcaacctctcgagttcaagtgattctccagcctcaccctcctgtgtaggtgggattacaggcatgcaccaccatgctgggctaatttttgtattattagtagagatggggtttcaccatgttggccaggctggtctcaaactcctgacctcaggtgaactgcccgccttggcctcccaaagtgctgggattacatgcatgagctactgcacctggcctggtggtctttactgcagtcttttactgacaccatataaattgtttagtaaacacaggccgttgtcagaactgatggaaatacaagtttgcttcaacatctgagtcttttttttttttttttttgagatggagtctctctcacccaggctggaatgcagtagcgcgatcttggctcactgcaacctccgcctcccaggttcaagtgattctcctgcctcagcctcccaagtaactaggactacaggcacgtgccaccatgcccagctaattttttgtatttttagtacagacggggtttcaccgtgttagccacaatggtctcaatctcctgacctcatgatccgcccgcctcagcctcccaaactgctaggattatacaggcgtgagccactgggcccgggctacatctaagtcttcaaaactagtatgttggaacgtctgatagtggtagaaaaatctactcacatttttcccatagttctcataattggtaaatgctttttaccaattaccgtttttaacttgctgatataataatgtggttagaaaaggctgggatttaaggggttgagttctaatttctatacaaaatatctctctttgctgaatctgaagaaatctcttgttgctattatttccaagctgattgtgacactgcttcactgcttgaggttttttttgttttgttttgtttttgttgttgttttgagatagggtctcactctgtcacccaggctggagtggagtggtgcgatcaaggctcactgcagtctcgacctcccaggctaaagcagttaagcagttctcccacctcagcctcctgagtagctaggaccataggcacatgccaccataccctgctaattttttattcttttttttttcttttttgagatggagtctcactgtctcacccaggctagagtgcagtggcgtgatctaggctcacagcaacctccacttcctgggttcaagtgattctcacgcctcagcctcccatgtagctgggattacaggtgcctgccaccacacccagctgatttttgtatttttagtagaaacgcggtttcaccaggttggccaggctggcctcgaactcctgacctcaggtgatccacccgcctcagcctcccaaaatgctggaattaaaggcctgagccaccatgcctggccaattttttattcttttgtagagacagggtcttgctttgttgcccgggctggtctgaaactcctgggctcaagtgatcctcccgccttggcctcccaaagtgctgggattataggcgtgagctactgcacccagcagatgttaattggaaaaaaaagcttctaaaagacttttttgtttttgtttttgtttttgtttttttttttttttttttgagacagagtttcgctcttgttgcccaggctggagtgcagtggcgtgatctaggctcacagcaacctctgcctcctgggttcaagcaattctcctgtctcagcctccttagtagctgggattacagacatgtgccaccacgcctggctaattttgtatttttagtagagacagggattctccgtgttggccaggctggtttcaaactcgtaacctcaggtgatctgcctgcctcggcctcccaaagtgctgggattacaagcatgagccactgcacctggccaaaatattttgaaagtacacagtaatattttagaaagctgacatgttatttaggagtcaaatatacaagtagtgtttaagttttagcaaagtcagagatcattattctaaacagcagttaaccagttcaggctactttttcattagttaaatagaacacactatatacaggaggcagaggtggaaagactgcttgagcccaggagtctgagctgcagatagctatgtttgcatcactgcacatcagcctgtatgtcagagtgagactctgtctctaaaaaaacaaacaaaaaactaaaaacctactatatgaatgaatatgcatgagtaaatatgtgtatatatgtatgctatatattgcatatatattgcatcgtatagtatatagcgtgagtatgctattgctacattagtatacataacagttactatataaaggagttggcataagcatatagactatatattttaggccaggcacaatcgctcacgtctgtaatcccagcactttgggaggccgaggtgggtgtatcacttgaggtcagaagtttgagaccagcctggacaacatggtgaaaccccgtctctactaaaaatacaaaaattggtctgggcatggtggctcaaacctgtaatcccagcactttggaaggccgaggcgggcggatcgcctgaagtcaggagttagagaccagcctggacaacgtggcaaaaccccatctctactaaaaatacaaaaattagctgggtgtggtggcggcgcatataatcccagctacttgggaggctgaggcaggagaatcactggaacctgggaggcagaggctgcactgagttgagatcgtgccactgcactccagcctgggcgacagagcaagactccatctcaaaaacaaaaagaccacaaaaattaactgggtgcagtggcgtgcacctgtaatgccagctatttgggagactgaggcaggagaattgcttgaacctgggtggtggaggttgcagtgagcacagagatcacgccgctgcactgcagcctgggcgacagggcgaggctgtctcaaaaacaaaaaagcatatatactatatagtttagcctatattattgttacatatagtcagtgttacattagtgtgtatatatatgtatgcatgtgtgtatatagcataacagttaaagcttttaaaataattcctaggaagacttgaaatgctttaactttttaaactgcagttatttatttaaattaatatttggttatattactatttgagtttgagattaaagtctaaacagtggtttagtttataaagagctgtattgacatccttttctgaaatgtttgttaaagagaaagtgataccttatccagcctttgaagatgtcctttctgaatacttaagtagtatcttaaattattttggattgagcatttattttcttgcttttttcctcgttttttgagagagtcttgctctgtcacccaggctggagtgcagtggcacaatctcagttcactgcaacctccacctcctgggttcaagcagttctcttgcctcagcctcccgagtagctgggattacgggcatgtgcaaccatgcctggctaattttgtatttttagtagacacagggtttcaccatgttggctgggctggtctcaaactcttgacatcaagtgatgcacctgtctcggcctcccaaagtgctgggattagaggtgtgagccaccacgcctggcctgaacatttattttcaattccggaagttttctgttggtccccagaaaatagcccagaatttctgaggtttttggtcttaaaagaatatctcaagtttttattaagggttataaagaataaactggatttctaatgtttcagtaagtttccttttggctgtgcacagtggctctcgcctgtaatctcagtactttggaggctgaggagggcagatcacgtaaggtaaggagttcgagaccagcctggccaacatggtgaaacccctgtctctactaaaaatacaaaaattagccaggcatggtggcaggtgcctgtgatcccagctactagggagggcaaggcaggagaatagcttgaacccagaaggcgggggttgcagggagcccagattgtgccactgcactccagcctgggcgatgaggaaaaccccgtctcaaaaaaaaaaaaaagttttcttttttcccatagcacagctctttaatatttgtcatatttatctaacaatggtcagtaagtttgtactgaaaactcttcccttttaacagaactgggagcatgatttgactatacactattgaaatggagaatctcttgtgattacttttttgtaatattgaaattttgcatgtattaagtagtacttaataattaggtcattagccaaagccttggaggtctctaatttgatctgcattacatctcctaataataagatataccataataaaaatgttgttaaatgaaagatttactgaccccaaagtaagcattcactttaccagtttgctttctaattctcagctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggcaagtatcaacatgtttcattaaaatatttagcagttagaaatagatcaagttaacttagtacttcaaatcttattcaaaatttgttttctagtcttattatttttttttttttgagaattttgctccagtagtctatagttgcatatatctacttccacttgccctgtagtacttttgcaatgattggtggctagaaatttgaactgtaacccatgaacatggtagctctagacgtatatgtgtgtatgtattttattttaataatcttagcatattcttaaatggaattaatattcaatctagcatttgttaagtacatatttatgtaaggtaattaaacttaaggaacttgccaaaattataaattctgtattctgtagttttaaatgttatttcttcatcaacattcatgacctccctgtagaaatttaacctcatgaccacctccttgaaactcttctcactaggcttttgtgattttgtgttattttcctttttcatctttctgttttctgtttgtttttgttttcttgctatttttattgtggaaaaatttaaacacatacaaagatagaataataaaatgaaccttcatgtacctttaaccaactttattagttaacaacttttggccactcttgttttatccaatctctcccacctctgattctttcttttcctttctctttttttttttctttctttcttttatttttttgagacaaagtcttgctctgatgtgggctggctagagtgtagtagtatgatcatggctcactgcagcctcaaactcctgggctcaaatgatcctcctgcctcagcctcctgaatagctgagattgcaggtgtgcaccaccatacccagctaatttttaaagtttttatagaggtgaggtcttgctttgttaaccaggctggttttgaacttctagcctcaagtgatcctctagcctcagcctcccaaagcgcttggaccacaggcataagccactgtgcccaatccaattctgttttggattattttaaaatctcagacatataattttatccatcagtatttctctgagaacactcttacaaattacaaccaccatgttattgtcgcacccaaaaaacaaatcattaaatatccatctgttatttgtgatccttcttgccatcttcctccaatttttcacatacagaggtccttttacagctctctatattgattattatatagcagatcattaagaatgttcattatttaatttaatcctcaaaataatggtgggaaataggcagaaaaatttatatatatatatatatatatataattttttaactgataacaaaaccgagacccaagataattcaaatcacttgccccaaatcatattggtacttaatgtggcagacctggaactcaaatctaatttcgcttgcttagtagtcctgaaggtctagctgtttcccatacatcatgctgcctttcctcttctcattggccaaaatctgtcaatctttataatagcccttgcatttgttctttcctttctgttgccattgtagccatcctactttacactctcgtaaattctctccctgctttaggctctctgctgtcttattaggtagtatacagctacaggttaattagaccaaaatatgtttcttttcatgttattctccatacttaaaaactgtcactttagatggctggacatggtggctcatacctataatcccagcatttcgggaggctgaggcaggaggatccctcgagtctaggagttcaagatcagcctaggcagcatagcgagtccctgtctctacaaaaaataaaatttagccaggcgtggtggcatgctgctgtagttccagctacttgagaggctgaggttgtagtgagccatgatcatgccactactcagcctggatgacaaagtgagaccctttctcaacaaaatgaaaccaaaaactatcactttagactatgtgccgtagctcacacctataacccccagtattttgcagggccaaggtgggagaattgcttgaggttgggcagcatagtgagaccctgtctataaaaaaaaaaaaaaatttggccgggcacagtggctcacggctcacatttgtaatcccagcactttgggaggccgaggtgggctgatcaacagtttgagaccagcctggccaacatggtgaaactccatctctactaaaaatacaaaaaaaattagccaggcatggtggtgcatgcctgtaattcctgctactcgggaggctgaggcaggagaatcgcttgaacctgggaggcagaggttatagtgaaccgagatggcgccattgcactccagcctgggcaatagagtgagactccatcttaaaaaaaaaaaaaaaaagaaaaattgtcacttaattagttatgaaataaaatcctttcggattccttagttacttgtcttcagccagaatacacctctcctccaaggaagtagggaaagaaataatccaagattaatgtgtttttgtttggcctagacattgcttttttaaaatgtgagccaacatttttagtatcaggggatcttgtctaatagttcagactgttgaaaaaaggaagatctggcaatatactaagtctgtgtttttgtgtggcagaaagaggctattgctgagcaaatggctgcctacattagacaaggcatgcttttccttgctcaccatagttacatcaatccctgttttcttcttaaccttgaggccactgtttatagcaccatttgtcatttctcttgcactgtaatttttttcttttgagacaggatctctcgcccaagccagagtgcagtggcaccattacagtcactgtaacctcaaattcctaggctcaagtgatcctcctgcctcagcctcccaagtagctggaactacaggtgcacggcaccacaccaccacacttggctaatttttagaaaatattttttcccaggccggtctcaaactcgtagcctcaggcagtctctccaccttggcctctcagagtgctggaattgcaggtgtgggtctgtgcccagcctctgtattgtaatttttcttagggtggagaattatttttctgaacttagttctctatcagatatcagaaaacaaaagactcagggtgatgtaagaaaaattagagtacatttctgtagaagaatatgcctacttatttccagtttggtctttgaatttgccatctttgatttataacaacttaagttacttactgaagaatatacacctaataggtggcagagccaaaattcacctccaaaccccatattccttatgcagtatcattctgtatctgagttcttatagtgttgtgtatttctgccacttacaaactatacaggatacttaccaaacacccagactattcagggtatacgtgtgtcttgcagcatagtaggtatttagttaatatgttaagtgatttaccctaggagtaaaggcaataaatgaattgtcatctttgagatgtcttgtatgcgttgttttcttcatcttcttgagatacgaacatttcctaatgggctatgtttcctagagaatctggtctcgttatttcttgagggatccctagtgatgaattaaaagaaaaattagctctgattttctgggtttaaatgtagatttatggtagtacaaactggcatagccctttctgagtgacagtatccgagaataggctaaattcttttgcttggccttttttctttttggagggaggaatggagcttcacccttgttgcccaggctggaatgcaatggctcagtctcagctcaccacaacctctgcctcccgggtcccgggttcaagcgattctcctgcctcagcttcccgagtagctgagattacaggcatgtgccaccatgcttggctaattttgtatttttagtagagacagggtttctccatattggtcaggctgccctcgaactcctgacctcaggtgatctgcccgccttggcctcccaaggtgctgggattacgggcgtgagccaccgcacccggcccagatgtcaaattttatagaaagtataaacttttctagtgcttgaactagatgaagatttatttttagccagtgttctgaaaaaggatttatgtaggcttaaacaatatgttctaccacttttggtgacctgtttcttatgttacattgcttatgtcatcttcagtttatagtcttaaatatatcttatagctggttcagtcctccgaaaagtaggttgtttgtatgcattgcttctctttaaaacaatttctcttcatcaggaacatttggtttgatagaacacccgatcatgccacagtatatatagtggcatttttaaaaatctgagattgccagaaaaactcacggtgctttatagtgagaaaaagttgtgcagaatgtgtataaagccttgggaaaaatcatttaactcttctgaccttgattttcaaatgtataatgcaaatgattaattttgatcagtgatcatcaatttgcagtatataaaaattgcctaggccgggcgcggtggatcacctgaggtcacgagctcgagaccagcctgaccaacatggagaaaccccgtctctactaaaaatacaaaattagctggatgtggtggctcatacctgtaatcccagcttactcaggaggctgaggcaggagaatcgcttgaacctgggaggaggaggttgtggtgagccaagatggtgccattgcactccagcctgggcaacgagagcgaaactccatctcaaaaaaaaaaaaaaaaaagaattgcctatgaaaaatgtaaaaactacacacatttaactcactccagccccaaggattctgatttagtagatgtagaacagaattttcagccttgagactactgtcatttggcgctggataattatttgttgtggggctttcctgtgtattgtagaatgtttagtagccatcctccgcctctagaaaccagtactatcagctgtaccacccccaaaattaaaaatgtctccagacattgccagatgttgcctaggggcaaaattgtcccagattgagagcaacctttccagagtcagatgtatgtggtcttaagctatactttgaggaaggcctatctgcctgaattgaaagcactttatatctgtaattttatcattaacttaaagcaacttaaggttatgtatttgtgaagcaagcatttttgttcatttttccatgtgtggcacattattacagataaaattgtgcagtccatatacagccaatttatacagcatttagttatttctctttgaaaaataattgtcaaaatgcaatttgatggcatcaaaatgcacttgtcaaatacatagctaaagctattatggcacttgttccaatctaaaaattgtttctttcagtgtttttagttgatgtcattctatacagccttttgtttcattaggatcaggcagctagagacatgaagaggcttgaagaaaaggacaaggaaagaaaaaacgtaaagtaagttgttttcttctccctcacaaaggttacgtgaaaactgctgaagtattgcaaagtctattcccccaaagtttatagagaaaaaatattgacgtacacttgtgtactttacttgaagttattcctgtatcttgaatactttaagaatagagatggcaacagtctttgcatttgcaataattaaaaagcattcagtttggtagaatagtatttggtctttgactataaatagttgtttagtaaacacaaggaatgaattatagtagagtttaggggagcataattattaaagtttaggctcattgttctgagtttgtcgcataattaatataaaataggtttatgcctatatggttgattatgagaagtaatggcaactgtatcatgaaaactatgtatagttgaacctttgaacaacacaggtttgaactgcgtgagtccactcatggggatttttttcaaccaacacaggtggaaaaataatattcacagtataaaaacctgtgtataaggagggctgtaataatacctaattttatttagctccagagtgacattgtgctgtagcagccatagtcagaacttgaagtactttattttctgggaaagagaagtctctttgccttgatgaataaactcctaaggctttttctgccagtcatgattggacttttttctccctgtgcttggcagtcagtgcttcagtcctttaccagggtttctgttccatatggagatttagctgtggttttggtattcactgtatgtcatatccccttccacctgccctgcactggtggtgttgcttgccggttgccttaggaatagcaagcgctctaggttaggcagaaagtctgattagaaacagatggttgtgggaactaagcaaccatattttctctatagctcctgagacatacagcaagtggtgatggtccccttctccatgtgaactgtttaagcgttttattcccaaactcataaaggagttaatgtagttttcactctgtccccatccctaaggtaactgcttttggctgaaaaccatttaccctagagctagaaactttggggacaataagaaggttgtgacctttctagtatatgccaaatacaagattttttttttctttttagtatgaaatacttttcacaaccgcattgtttgttgtatggattcacaaaactaggaccatttggtatctgtcttcagaaagtttttacgtctgatatccttgttggtaaccgctgtttctaggggtatcatatcatcccatttaaaagaaatgcaaactgcagattatagagtgcagctacacatatatataatggggtggatagtttatagtgtgctcattgctgctttgttattattagtgttgagagttcctgtgctgtgtggaattcaacactaatctgctgtaagtatggagctgggtatgtggaacatttgcagggaagtttgtttctccgcttgtttttccaggggtattcgagatgacattgaagaggaagatgaccaagtgagttcctatgcagtatttctatcttttatttttatccacaaagtctatactggggacaagctagagcttgccttcactcaaaatggccattcctgacattcagcagggaatgtcatttgatttgctccttttgtacctgtgtgaccaattggtaatacatagattcacatggctttcccccatattgaagatggaatttttgatcaactgtgacatccaaagcaaatacgagctttattcagcttgcttctttttaaatccaaaattaatgtttattctgataaatcaagtggtagagtagtgtgggatctattgatggcctctggtaacatctaacctctgtctcttagtaagtgtcctgtttgtggttcttgtatttcaagctggaacattaattactgtccattagtctcttttcccccattgttcagttgtggagtgatgagaatcagagtgagtggtagccgtttccaggtttgtgacctttctaattagcgttaacttccaaacttggattgttaaagccacagcatgtgttctatggctctgggcagggttgatagacaccccactccaggaaggctgtggaacagacagatttgtaagtcttctattaaacaagttgcaacatttaatagtactaactgtttaattcatttcttctgattgttcttctgaatattgctattattaaaggaatcattgctagtaaggatcttgccttacttggtaggtatgttaactgtgcaattatctggtacactatgtgcgctaattacaggagcagaaacattctcaattgtacttgggtgtgattatgttcttgtgctttcctgcaggaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagaggtatggtgtttcttgctgaattttactcttgtttcaagctgatgctttacttcagctttaacatttagattttctcagtagtggaatactcttacatcatgagcgtatgcatcttgtcatctctactaagtggttgagccacaaattccatgaggctttatagcctgttttgttcaaaagtataaccaaatcacttacatttgactttagaattaaaacatttttttcaagtaattgtacttgttttccagaaccaatatttctttcttttctttctttctctttctttcttttctttccttccttcctttctttcttttctttccttccttcctttctttctttttcttttcttctttctttctccctttctctttcctttttttcctctctttcttctttctttcttctcttctctttcttctcttttattttctttcttctttttctctctctctctgtctctctgtcacccaggctggagtgcagtggcacagtcttggctctctgcaacgctgactcctgggttcaagcaattctgcctgcctcagcctcctgggtaactgggattacaggtgcccactaccatgcctggctaattttttttaaatatttttggtagagatggggttttgccatgttggccaggctggtcttgagctcctgacctcaggtgatccccctgcctcggcctcccaaagcgctgggattacaggcgtgagccaccgcacccagccttgacatctttctttcaaactgggaacgttttggcctgtgtttactgtttttgttgttgttgctatattgcccagactggccccaaatcccctggctcaagtgatcctttcacttcagcctcctgagtagctgggactacaggtgcacaccactgtacctggcatgcctttatttttttgtttattttttttccagacgaagtcttgctctattgcccaggctggagtgcagtggcgcaatcttggcttactgcagcctctgcttcccaggttcatttttagtagagatgggattttaccacgttggccaggctggtctcgaactcctgaccccaagtgatccacccaccttggtctcccaaagtgctgggattacagatgtgagccactgcatccggtcacatttgtttttttaattgctataaatttttactgttggtcctagatctggggcagatgagaggctgtttcttcacagtggagccagtaattacaggatccttaaggaatgaggacatcggtatacccacttgaaaaaatatcagtgtttcatccaggttaaatatcagccgagatctcacatacactaatgattctagatctggagcagtggttctcagtgtggaccaagaacccctttcagggagcctacagagtccaaacacttttcattataccaagattgttttcctttgttactgcatcaacatttacattgttggtgtaaaagcagtgataagtaaaactgctgatgccttagcatgaatcaagccagtggcaccaaactgttctagtaggcgtattctctgttctcagaccattgcagttaaaaagaaaaaaaaaggccagtttcactcaagaatgccctgaacagtaaaaattattaaagtcgtgacccttgagctacatgtctttttattctgtgtgataaaatgggaagtacgcataaagcatttctgttgcataccaaaatatgatagccatttcaaggaaaagcacttatgtgtttgagttgtaaggtgaactagctactttttttcatagaacaccactttcactggacaaaatcaatgacatttcaaggaaaacaattgaaagtgtttattacccatgatagacattcaagctttcggccagacgcaatggctcacgcctgtaatttcaacactttgggaggctgaggcgggtagatcgcttgagctcaggaatttgagataagcctgggcaacttggtgaaactccatctaaattttgttttttaataacaaaattcaggctgggtatggtggctcatgcctgtaatcccagcactttgggaggccgaggcgggtggatcacctgaggtcagcagtttgagaccagcctgaccaacatggagaaaccccatctctactaaaaatacagaattagccaggcatggtggtgcatgcctgtaatcccagctactcgggagagtgaggcaggagagtcactcaaatccaggaggcggaggttgcagtgagccgagatcatgccattgcactccagcctgggcaataagaacaacactccatctcaaaaaaaaaaaaaaattcaagctttcaagcaaaaattagaatttggaaaacttacatctaccacagtaggcttgacagcttttcagtacttaaagaccattgtgacaaaattgatggtgatattagtaactgatttttaatataatgaaatgtgttaacatttggatgatctgtatataacctcagtgaaccaatattttccaaatgatcaatgtatgacattacaaagtcaagcatgaataaaagctcaactcaaaatacatgataaataaatggattataatgtaacagagtgtgaaaacttcagtaatatggtttcagattacacaatgaaaataacttttaggaaatgaccacttgtcaagttttagtgtaaaataaaaagtatctgaaaagggctgggtgcggtggctcatgcctgtaattccagcactttgggaggccaaggtgggcagatcacttgagggcaggagtttgagaccagcctggccaacatggtgaaacccccgtctttgggattggtggcaggcatcagtaatcccagttactcaggaggctgaggcaggggaatcacttaaaccttggaggaggaggttgcagtgagctgaggttgtgccactgcactccagcctgggagacagagcaagactccatctcaaaaaaaaaaaaaaaaaaaggtatctgaaaaggctactaaaatactgtcctctctttttcaactacgtatttttcctttgcttttttttctttttttgagatggagtcctgctctgtcgcccaggctggagtgcagtgacgcaaccttggctcactgcaacctcctcctcctcccgggttcaagagattctcctgcctcagcctcccgagtagctgggactacaggtgtgtgccactacgcccggctaatttttgtatttttggtagagacgggctttcaccatgttggccaggctggtcttgaactcctgacctcaagtgatccatcggcctcagcctcccaaagtgctgggattacgggtatgagccactgctccaggcctggaggcaagaatttcttataggcttaaataaaaccaacctattgcaataatttgaatatagtaggagctatttaagtcgacattaataaagagatttgtgaaaatacaatagtgtcactcttcttccaattttttttatgtatccagaactatgatttttttttttaactacctatagaatgcttatatttttcttaaaaaataagtttaagaaccaggcatggtggtgcatgcttggagtcccagctactggagaggctgaggcaggagaatcacttgagcccaggagtttgagtctagcctgggcaacatagcaagaccctgtctctgaaaaaaaaaatagtttataaaaaataatttagccaaattgataggtggtgatgtgcttatgttttgtatacctactacactaagctatgaaaagaataatagaagtgactactactttctggaattggaaattcttggccatacattttttaaaagttataaacaactccatgtttttaaacagaatagaactccctctaaaagcagagctatctccaaaataaatattaggagtgtttttaaatgcttagagctaggttaaacagctttattcaaaacatatttaaatgttatatggtgaaatatcttctctgtcctctgaggtctttggcattatagagagattccttagtctgcttcaatgttgttcaaattcgaggtttccttaagagtctctttaggaagtaggttggtgttaggctaggcacagtggctcatgcctgtaatcccagctacttgggaggctgaggtggcgtgagaattgtttgaaccggggaggtggaggctgcagtgagccaggatcgcaccactgcactacagcctgggtgacagagcgaaactgtctcaaccaataaaagaagtaggttggtgtttatattgaaaataggaacagaaaacaaactagctatactttttaggatctaagctgagaataaattaatttttttgctttctctagctggaatggctttacttgtgtaaaatttggaaaagattattttgcaataaaatcaaacttacagaattgactcttgaattctagactaactttgaataattggacctgcagattgactatccaccatttgaaaaaaacttttacaatgagcatgaagagataaccaacctcactccacagcagttaatagatctccggcataagctcaatcttcgggtaagcatcattaagctcaatattcttaatattaatgttaattagtccagatttagtattattggttatctaaactaataaccttgaatttcttttctaatggtctctgaactgtctttgccagagtaattattatatcccttctgttcatgtctcttaatttgattgttttagtcttctagatgctgttttaggataggatcattttcttgtttcatatttcagtcagttttatatgttctgtgctggatgggctagtgatgaagggtgggagtccccatctaaaggaagaggaaacaaaaggaatagatgttaacagatgatatcttagaatattttgaaatgaagataaacttgtctgtcaaattacatatagtatgctttattttaaaaattagaataaactaataccttttaaaaatatgcatgtactaatttcagaatggtttaaactgcctaccagaaagttttgggctgcacattggctacattggtttaaggtgctgatagatggtaaatgaaacacacagaaaaaatatgctatgctatctactctaatatagacaactttctcgcctgtgtgcaccttatcagttgctacacgatgtttaaactcctgttttccaggaggggtgtgtatttgtgtgtgtacacttgtctgttttccaagaggttactcatctccccagtgacccaagaaaaattttaagtaaaacccctgaaatcctgattggaaatatcaacatcaccagagaagcattgaaaggttaccactttgggggacaaaatggagattataagccccattcttcacctaggtgcagtttgaacagggcttgacagtggctggaccatcactaagtgagactttaattcatcaagcataactgaaaatggaggcagtagattatatcttggtagccagcatgtgtagacttgtcttatttggagcccacttggaattttcatttcaagagtaagatacattaatttttttctaccatctggttaatacttaatgcaaaatggcaaaagaacagttatggcttcccaattcattgaacaattttttttccgttttatttgttatgagaaaattaattttgagttaagaaatttttaatcatttaaaattgtatgacaattatcttgggaatatttatcatggagtttttaatatgaggtttatatttgttaccatttgaggtttttccttttcattgtatgattttggcttacagacttgtatttttacttcatactccagctaaaatgctagatccaggtaagtattgttgaacttcaaatgctgttaatgttgaagtacaagtcattctggggagttgtctctatctctaggtctctggtgctgcacctcctagaccaggaagtagctttgctcattttgggtttgacgaacaacttatgcaccagattcggaaatctgaatacacacagcccactccaatacagtgccaggtaagtaaaacataatgaaagaaaaataaagtagggtagtctttcatgactatattaatttaaaaacaaatcacagcagtaaaacagtgtttagtgtagaaccttgttgataaggatagaggtatttatcactcttaagaagtcactaaatggctgacaaatattcttttgtatctgatacgtatgttgaaaatatgatatgaagaaaataatttattaggcctaaacctaaccaaaaaggttcgtatatagacaaatttagcactgtcaatgactagaattccttcgttcgtcacttgaaaattctcattcattactgaaagttttagcttctttttcccatttatatatgggatttatttattcttatgcagaacattctcattttctgtatatgaatgagatagtctgtaccttcttaaggggggaaaatttttaaaattttagcaacccttcattataaattgcaatttttctgttttgtttttgtttttgttttttttggggacagagtctcactctgttgtccaagctggagtgcagtggcgcgatcttggctcactgcaatctctgcctcccaggttcaagcaattctcctgcctcggcctcccaagtaggtgggattacaggcgcacgccagcacacctggctaattttttgtattttagttgagatagggtttcaccgtgttgcccaggctggtctcgagctcctgagctcagggaacctgcccacctcggcctcccaaagtgctgggattacaggcgtgagccactgcccggccttgatttttcatttctgtattttaaacaaaatggagttgtttctgttctgtaagtggtggctgatatccacgtaatgagaatgatgtcatttcctataaatcaagaagttaatgagaatgttggatattgatatttctatttcacaaccagtatgcatagcaccaggtatgttttgttccattgcaaataaaaatgttagtagtcatttatcattccccaggatttgcttcagtacatctttagaattgaaattttagagtggttatattttactttttctccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcaggtatgtgctttctatagaatgcctccttccatatgtggactagcaagggaccagccagtcaagtgaggtagaatgaccaggaaacttttttttttaattgtgataagatacacacaaaattgattatcttaaccatttttaatgtacagttcagtggcattaagtatattcacagtgttgtgctaccaggaaacttttggaaagtattatgtgttaaatattttctatataaccaaatacatattttcccctaaaaactactgtttttatttatttttatttatttgctttttttgagacagagtctcactcttttgcccaggctggagtgcagtggtgtgatctcagctcactgcaacctccacctcccagtttcaagcaattctcctgcctcagccgagaggctgggatcacgggcacacgccaccacacctggctaatttttttatttttagtagagacggggtttcaccatgttggccaggctggtctcaaactcctgacctcaagtgatctgcttgccttggcctcccacagtgctgggattacaggtgtgagccactgtgcccggccagaactactttttttaagaggaaaagcctattgtgatatggggattgtttgtattataagctgacagtttttctgtaggatgagttcattttatcttggtagaaaagcagtgacaggatcaggaagagaagggggtaaaatgaataaaagattttagataatctgttgagatgcaataatggtattccattcatttatacctttatgaataaaatcgtggttttaaagtatgttctaggtttcgattttttatgacatcacattctgtttttcagaacttcgtttgggttgtgacaggtatttgttagtgtcacagtttgttaatatattattcacaactttgtagatccatgcagaatgtaagcggtttggaaaagcatataatcttcgatcagtggccgtatatggaggagggagtatgtgggagcaggccaaggcccttcaggagggggcagagattgttgtgtgtaccccagtaagtatgccttgtgtttaaatggcttctcagcctccctcggtatggaaaacatgattagttttgcagagaatttcccctaaagtgtggtaaaagcagggttgaaaatatactgatgaacggcaggctgtggttttaattttgattggtggctaaattagcagttcagtgagagtctctgtgacatataggctagtagctacaaattcccctctatgtcaaatagtttttcttatactctcccacaaaatgattgccaagttcatcaagaatcagaaagatacatatggtcagaatagcctagaagagtgtagtttaaacattgaaacctgtcattatgctttaaatcaggtcactttagaatgcctcaaaaactgcttctggccactttcccacagaatttaaatcacagtgtaaatgaagatgccgattgagttttcaaaatttctgttcctttgagctaagtagtgcataaggtatgtggctgttggaccagtatctattacagtctgagactagagaattagcacttttgccaggagtgcaactgcttagaaagtccctgtgaatgcctttaattatacttactgttcattttgttgatcttatagggtcgactgatagatcatgtgaaaaagaaagctaccaatcttcaaagagtctcttaccttgtgtttgatgaagcagatcgaatgtttgacatgggatttggtatgccttgaataccagtttcttctgtccccatcctcatgatactagttttttttccatgtctttctagactgttttttcagcatgagagaagctaaaaatactcctggatggggttagactatagaaatatagctaagatgaacatttttaggagttttctctggaaaagtatgttaggttttattgggttgaggaaatttcaaagtgcctttgtatataaggggaatattttctctgtcttcatttttatccatatgcctttgatcatagaggttaaggtctgtgttcttgggtagatgaatgtcagatcattcgaggccctttgctttcctatcctcgtagctgtctttactgattggaacactgctagacctagcccagttggatggagggaaaatttttcacttttatgctgaatgatatgtttaggagcttcttttttcttgagacagagttttgcttttgttgcccaggctgcagtgcagcggtgcgatctcactgcaacttcctccttccagtttcaagcgattcttctgcctcagcctcctgagtagttggggtgataggcacctaccccacagcctggctatttttttttttttttttttttggtatttttagtagagatagctgtgttgaccaggctgcgaactcctgacctcaagtgatccgcctgcttcggcctccgaaagtgctaggattacaggcatgagccactgtgcctggcctggggtttctaattttcttaattcttacaacttcttatgaagacttttactaatatggctttttccaggcttcccaaactgtatttcaggttataataattttattgttctgtttcttgcagagtaccaagttcgatccatagcaagtcatgttcgtcctgacaggcagagtatgtatgaagcacctttgttaaaccaaatttgtactaaaaagggcacttatttattttataagcactcagagttatggaagtaaaaatgatcttgtgtctgttggtgagaaccataataagggaggtaatgagtttatctgagctggacaggatcttagcactagatataacttgttcctttttatagatgataaaaccaaggatcagaaattaaataaactgccctaaattatacagttttatcagtgggtagaagcagtgtacagtacagatctgctgatttgaaatcaagagtctttttctgaaccatactgacaacttgtcttaactaaaaatgtaataaaaatagaataagagcaaatctttccctagtgaatcagtttctaaactaaatttaaagttcaggtgagcttatgtaaaaaaactgaataatcctgaatgccaaagaagcttaatgggtatgcataaagatatcatattgtttctctaacagaatttatcttaccttttagctctcttatttagtgcaacttttcggaagaagattgaaaagttggccagagacatcctgatcgaccctattcgagtggtgcagggagatattggagaggtaaccctaagcagggctggatgggaccttaatgggtttatttctcatattatggaacacagaattaatttctcactattgagataaaaaaaaaagatgttatgtttatagatgcaacatgcttgagattgggtattttgcaagttgtggggatagacgtaacaagactggcaaaatgttgggaatcattgaagctaggtgatgggtatgagttgattttgttcattttgtgttttttttgttttattgaatgtctcaaaacttacaattgttttaaaaaggcttcaaagagacaaaaagatgtgcctggaagcatcagcgtattaggttggaactgacgttttaattattgtggtaggggcctacgcaggagggaaagggtgacctggaaggcctggaaaaaatcaggtttcatttcttacctgtacatatgcgctatgtgaaaaattactctgaattgggacttggaattcagttatggctgcttagagaatccttcagttgcttgccatggttattgttaaggaaagctctacaaagtagtggggcatacaaattaggtatgtacaccaggtggagagcaaggtgattggaaaggagaggtgagttttgagctgcacttgacttgctgaaggcccaaggagaactgggattgttcaaggtcttctcgatgcaggtagaaatataatgcctagtccttgttcaggtgccctgtggctccaatgtcacaatcatctgtttcatttcttccttctcaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcaggtagagtatgaatttttcaacaacattaagttcctaggctataagggtactctgtcttactacataagacctataatatctgagcaggctgatggaaagactgttggcctggctggccatcccctcccaaacccccaaggaagcagcagttcagcacagggatcacagtctggagctctagataccacttttcacttagtatttctctctaatcaaagaatccctgcagctagaagtcactctgggaaaaaaggcagtgaatgcccttattgtatgtctgaatatagtagataccttacccttacattgatctactatacacagcttagttgggcaacttaactcaggatgagaacagtttttggaatataatttctggatttgttctgtcaagttttaataactacccttaaacactgatattttttcctagaaaggagagaacttctcagcttcatgacacattttaaatatatattcccagtgcaagagaagagggcatggcagattactgatgcaaaagataaaagtcccagtcgggcacggtggctcacacctgtaatcccagcattttgggaggtggaggcgggcggatcacctgaggtcaggagatcgagaccatcctggccaacatagtgaaaccccgtctctactaaaaatacaaaaattagctgggtgtggtggcgcgtgcctataatcccagctacttggaaagctgaggcaggagaattgcttgaaccagggagtcggaggttgcagtgagccgagatcatggcactgcactcccgtctggcaacagagcaagactccgtctctaaaaaataaaagtcccttacactagaaggcctaacatcatagaatctgtggtggtgacttaacatgcctgtatctcagctcaccaaacccatgcgctttgcctagataaaggaaatgtggcttattagcactagcatttctggttactttgatcttctgactacagatgaagaataaaagaatttggttgctttttatttcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcaggtgaggggctgggcacactttcaattgctcctggttataagaccaagacattttagcagtcctggaacagataacataaaaacttgacaagaaagttgggtggctaggaggatgtggggcttatgaggtacagataggaattgtgagatactaaaattcatctagtcttatctggtcttcttctttcaacagcatctgttttgaaaagctattcctttgtgctaaaatctgtcgctgtaatttctaccccatagcacacttaggagtaaatttaatctcaaagatggttactattctccttactgctcttcccccacaaaatttttcttctgggaggctaaaaatgtgtgatgcctttaaaacaatatgtgtatagtatagtgcccccccaccttttttttttgagacagaatctcactctatcgcccaggctgcagtgcaatggcacgatctcggctcactgcaacctctgcctcctgggttcaagcaattctcctgccttagcctcccaagcagttgtgattacaggcgcccaccaccacgcctggccaatttttgtaattttagtagagatggggttttgccatgttggtcgggctggtctcgaactcctgacctcaggtgatccgcccgcctcggcctcaacctcccaaagtgctaggattacaggcgtgagccaccgtgcccagcctgtatggtgcctcttaactgttccttgcagagatctcagacctctgaccacactgattgccctcttccaggtgtgctccaatctaaagctaagtgaggcattctaacaaatcaaacctggagtcatctgaatccatgctgtccccaaattacaaatgggttcggaacactttctgagagcagaaactgttaagagtttgtcaaatgcctaggccagctcacacaactggtacaacccagctgcaatgtggcagtgcccaagtttctggtcctaggagtaaaggacctgcactgcaggagagaagagaataatgtttcctcccctgctcctgagcacagagagctagtcctaaataaacttttaaaacaggacacattttgactttggcattttcttccatttctttttgtacctcaggctttctgtgctcaggactttgtccaagcctgctgccctacctctcaagcactttattttgctggtaatatgtgattgtcagataaaactttaaccttcccagagacatttgctttttttttttttttttttttttcttttttctgagatggagtcacactctatcacccaggctggagtgcagtggcgcagtctcagctcactgcaacctctgcgtctccggttcaaacagttctcctgcctcagcctcccaagcagctgggattagaggcatgtgccaccatgcctggctaatttttgtatttttagtagggacggggtttcaccatgttggtcaggctggtcttgactcctggcctcaagtgatccgcccacctcggcctccagagtgctgggattcataggcgtgagccaccgccctgcattcttaagagaatgtgagtaaatatgttgagtggcaatggtcaagttcaatgaaaacttttacgctctgcgggtaaataaaattttcagttgtgtggctaccatcctttctgggagtctgtccctatagtcagttctgataagcctcacttcacatagcatttttcctttgcttctgaacataccagttgtttaagttccaaatgtttacgtccaataatacatggtttgagaaataaaatataagctcattttcctcaaggaagttagaagtagccaaagttactcctctgggtttgaagcttacctgaacaacttcccttccaggagagccttgagggagggagcactgtaggaagccttagataaggatctcagccacttttcaaatttggtggattatgctaccaaagagaaaccaatctgtggttcctgtgaaaattcctcccttagcgtagtgctggctgaaaattaagcaaaagttcccccttcccacttaatttcctctttgtcctcgttctcttcttctgttcttttctccctcccttgacttaaccttgaattttgttcaatgcagaatgcctggtttcggaaatctcgattcaaaggagggaaaggaaaaaagctgaacattggtggaggaggcctaggctacagggagcggcctggcctgggctctgagaacatggtgagtctagactactacagtagtgcctttatagttggtctcatgtcctgaaagtcattaggaatattctcatctacccaggaaagcctcagtgagtttaaagccctgtctagaagggaatttgtatttaatctgatttgagtcaatgcagtgctcattcttatggtaactttctattgaagaagcatctttgtgtacttggttgactaggcttgctcaggaaattattctagattagcagtgatctcacactgtggtccctggaccagcagcacatgcaaactcatccccaaccccagaccttgtgaatcagaaactctggagttggggcccagcagtctggttttataagcccttcaacactggcctaaagcctgctgctaggtaaatgttgccaaagggtcactgtaaagtctagccatatcttgtcattaaactcaggaacggatcaggaatttccaagtcgggagctagtttttctcacaaaccaggtaacaaatgtacccttttggtggcctttcttaactgcctgttttctgtcaccttgattccaagccagggaagaaagctgccagtatacttttctggagcattaaacttggcatctttgtaattacatactctgttcccacattataataataatgatgatgatgcataataataggtaatatttattgagcactttatatgtgccaggaccattccaagcaatcagatgttttggctcagttaatcttcaaaataactgaatggaagttagtacagataacaatgctgaggcacctaaggttacagtgacaagtgttcaagccgaaattcagacccttcatggtcttgattcagggcctgagcagtcacacaatatgctattcagggccttttcatctttaacgtaatttttacttaattaattggaagtgtttatgtaaatacatgatcaactttgggcataatctgattgcatttctgtttaatagggttaatttccagaaatagaatttctgggttgagggcataagcatttttaaatgattgtcactgtgtcttttctcacaaagcagtagcagctttctaaaagtatccagttcctttgtagctcccacttcaagggttttcataatgaggcctagtctatagcagtgagctttcctgcttattttttcattctcatagatgtgtttatttttttaggatcgaggaaataacaatgtaatgagcaattatgaggcctacaagccttccacaggagctatgggagatcgactaacggcaatgaaagcagctttccaggtctgaaataagcatttcattaaaagcactttcagcagtaactcttgggcagtgacagaggggcttagttttcctggttgtagctgggcgcctaggcttgatgctagatttagggtcttcacgctgcttggattttgaatataaacctaacagtagcttagttggaaatgcaagttgatctagagaaccccttgtgctggtctactttgagtcacacttggggcctgggattgttgtcctgcagcagggtgtgtgttccctcccttcccaacagcctgaagtgttgcccacctcccaggcacccacctccaactcacttctgaagcaaaatttactgatagtcacactaaggtgaatcgatagaatgagttcaaggcaggttttgctgtcaaacttaaattgcagtatgaaaattttttttaagttttcagaactttttggttttgaatgcagataaatgtgctaaatacatagatgctttattctagccaatcaggctataaaagtacatttcagaacactgggggtccatctctccacagagatccacaagttttcctttatagcacaagaacaaaagggaccatactgtggggccatcaggacactaaactcacagtgccaggatagcacagagtttctgtaaacctcatcatttgccaagttgtatattcaagtttcttgaacttgctatcttacctactcctgatgtctctttctctttcagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccggga

SEQ ID NO: 771 - DNA, 214040 bp, Homo sapiens
agggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagaggtcagaggccctgcggggcggggatctggggcctcgcctcggggtagggagccggctggcgcggcggacgctgcgggtgcatctccccaggtcccaccgcgcgccgcctccatcccccgcgacgctcctcctttaggcgcgcggggcggaggccgcattcggcgggcctggcgggcgggcgaggggccaggcggaccggggtccgagccctcgggatgctagtctcggggagccccttcccagcggttccttcacctgcagggcgcagccgagacagaggttgctgaacgactgtttcttggctttccgtggaattgaacatgggagtaagagaacaatttatcgtttgccttgcgtgttttggggagttgaaaatgagccaaagtcagggaaagtgagttcctgcctaaccagcagcgtttcagagcaactcaaaggaggtgaaaatgggggcgccggggggcagggggagggaagaagttgggagtgatttgaatgctctcagaaattattttaaatatttttgcttgtatgtagctttcttaatatgcgttgcagttgcctttaaaatagaatgtcatgaaatactgaacgagcgtctgtatttttaccacttttacttaaaataaaaatcgattggatattcacctttctcctcgtccgtgtgcatatccagcagagagaacagatttttaaatctgtttcgtctcatatttcagtgattcttggtttcttttatacttcctttgactcatatttgggatattgaaactgcaatacacatgtgtatggaatgtgagctgtaaacttcacttgaagtgatttagactctttgttttctgagatcttcagatcatgcattcataatataccaagaaaatgaatcagctatagtcaaagaagtattttctttatagcacttgtcactatctgaacttgtcttattactttcatgtgtgttgtctttggctcattctctctgtatccccagctcctagaatgttcctttcccataataggtgctcaataaatatttgagtagtgaatgaatgaatggatttaaatggggaaagtagtgcattaaatccattgcacaaatttacattctaaggactaatatttgtattctaaaagtaaagatgtagacacagtttgaagttcaatgcaagcatattaattcacctttgacataagtgaaagtttgtgttcctttttcacttgttcttaaatgtcacttacttaaacctgcagagggatagattaattgcctcagccgactgaggctactcttttttaacatccctaaatgagaatgggttcttctcattgtgcctctaagggcactaagcagagaaagctgatgaacaactttaatgttagttgttttcaaaaggtttctgtagctatttgccagagaagcatgtcttcgttccatttcatttttgtgtttatgaggagagggctgattgcatctgagggaagtcactttatatggcctcttattggtgagaactaatactgggaaatgtgtctcacgtttctagacctaccccataactatttgaagcattttaacaggcaagagataggtttagaaaatgcagtaacttaaattaacttctcctgactttcatagtcaggcattttagaacaaactctgcccatatttgaggatctacagccttttaagcattttacacgttgattctctaatagtcatgaaacagacatagtatgtaaaagaatatgtaaaagggaggaatgcccgtgatacgaaaacaaaagttgatattggaaccctgcatgtgacgtaatgagtattctttatccgcatatccgcaaccttttcttttttttctccagtagatactgagttcttactgtgtgccagatagaaggcactgggtatggaaaccatttccttccatcaccctaaacagttaaagtacagtgtcgtgtatagtaggctgtactcgaaagataaagccggcttttcttttaatgctgtttacctggtcattaaagtacggacgttgtgcgaaccatttccttctactgggaaaatcaaagactttttagcagtgtcatactgtgagacccatttagtttcctgctcaaatcatacagatgaggaaattaatgcccagagaagttgccgagttcattgaaggttgtttagttcatggaaactcaactaattactggaagaaccgagactaagaacccaggttttgttattcattttgccatgcttgaattttaggttctctagtatgtaattggagttgaactagattatcaagttttcttctggctgtctccatgagtactacatttaattattggagaaaactatgcttttgtcctatcaccaattacatttcccttgacaaaaattctatttgaaacactatttgaaattttagtttgagaagaagtatatgtgttcaaatagtacgttttttgatatgtcttacattgagagtcagaaaatgacggcattggtcacattaaacattattatttcttaagttgttgtgtaaacgtatggggaaaaaagaacccagtcatttgaaacatgcattttagggaaaaggtgatttcttttttttttcctggccaaactttatcttggtggtttttttgctgaaaagtgatgtttggaagctggaatttggggaatttatatcacagatttttaaagcaagtgtctgctttttattttcttcagcttaagctgaaaaatgataaaatggttttctacagagttcaattttacttttttttcagttttactctttataatataaaagaaacatgaataaattagacttcctacctttattttgcatatagaactggacttgcatggccagttgggcccaggggaagcctttttcaaatttattgatttgaaaatagtttgacaaagaaggatcatgatgtccttttgggcttattttgtagacactcgtatgtgtaatgttttctgtttgtttgtttagtttttcccttttgagtatcaccccttaactccctgtatctcctagcagctttccatctccctgtttattttgtctgggtgtcctgctactacattaacttttgccactaggtgtcactgtagaatatatcccccttttagtttgaagcttggggttatgtaacagcaggttttaattattatttaatccgtctgtatatactcaaaactattgatagataagcacttaaaaactcttagctactttttaactctctcaaggtgtctcagtagattgagcagcctttttgtttaggcttaattagaatgaaatatattcctgtactgcctgtaaaacattaacagcttcatttgatgagtatttgtcatttagaaacacacttctgagtttagtttagcttcctttttctttctactttgagtgtctcttagattactaagtaactgagggattcaatacactgctgattgcattgtggagcccttgaatgaagaggccctagcaaaattttctttctttagccaaagaccatcagagccaattgcttaatcctccattactcattctaagatgaaaacataggaggaccataattcttccactgcaagaaccgtcagctattttgtgttcagttcaacagcattttgtccatcctgaccaaatcatatgaaaccaagcactaaataatgttctgagggagtttatgaacacattttccagagaccagttaacctctggtggtctgtggaagtgaaagttctatattttggactatattttagtcttgctttaaaataatctgtctcatagagattattagaaaatgaatgtatgacattttcattttcagccagttatcaacagaggaacttggataaaggctcatagggtctatccatcttgttgttagttaatatcagatacttagcccctgagctctctggttccaatagaaaaacccttttctccagaaagctagtgcagtttgggagaaggaatatgatgacctggatcatatctgtgtaagaatcagaaccaagaatcgctaaaaatctctgttcccagcctccttaaatgtaaagaattattatctactttcttttcagagttttgatatcactaatgctgatttcatatggctttgtgtttctcagttgtttccgttaaagtacgtctaatagtaggggtgagtgcaaaactttggagactataaaagtgtagatgtcatcaggccattgcatgctttgacttttttgatgatttattcttatttatttatttattttcatgttccatagcatctttgtgttaagtaaaatgtatattcttgagatagagtttatactatgctttgaggactgctcgatacatttctctcagcttctggaggtgtaagtatccatttgcacatcaactttcaagttggtgatttgcccttaatggctcagaaatctgtaacattattttatcttacccaggctcagatatatttagtcttttgaggtaactccagccactgttttaatatcatgaaaatatgcagcttagtttgtggcttggatacttccatatcacctctaaatggcttgacttcattctgtaccaaggtacaaaaatgtttttcaaatgaacttctctttaataaaccctgtatgtacatataacctatgtacaccccacctaaacctccggggaaaagcctcagccatctatcgggaaatgtggaggtgcaagggctgcttgcttcattatctgctgccagtgtctgctctgcactgcacatgtgggtgtgatgagtttctctggttcggtcctgcagctctggccatttttattagaggactaaggattcaggatgttcttttcttccctgtgtaccactgtgggagtatagtctggaggccagtgctttaacttttttttaattatactttcttctggtactgctgggagccaagatggtattttcttgttagtcattatttttaaaattttagtattttattcccctgatgtgagggatgcttcaggcttttgtcctgcatttgatctttgtttttcagggatgtgtcttggttacctttggctgatgtggttatcttttaacggcaaatcactgaatgtaattcagttcctatcaaattggccacagctgaggacaaatttggtttagataacctattagactcaaaggaaatgttgagctcccttggtgaataactctttttaaaaagaaaatcatcttttgaaggatctgggctattcggccccctgtgagattcaggtcacttgcctagtcatgtgactgtcatcatctgccgtagatactatgtgtgctccagagcggagagcattggtgaattgacttggttgaggggtggggggctggggggtgggagtggttgctgtccagttatagtcaggtttccaagggcagccactatctctgtacttggagaaatgccagcacttctctcctacatgtgtgcccacacgttgaacccagtgactcatcctgtacttaagaccccaaggatcagtcttaaatttaaagtaggagaatatcctttgataattttatttcacaaccagcattgttgtaactgccttttctcatattttacataggtttgacagccatttctaccattccatagtgcagagtcactattattttgttgttctatcctgtctgtaacttctttttcttatttattattcttctaatatacagtttttgtccctatctttcacaggctgctttcaatttcaattttcttggtatactggaaagactcttttggtcttagtttcacttgtaaattttatttaggacacttaattttttgacttacataaacctcaaaatctgtgttgtaaatatttgttgaaagaatatctagcatttaactacttttccattctttgaatcaagtcaatttgtataagatgcttgtcactgagtttttgtaagttgtttcatggatttgctttttggcagagagctagttctctaacctttataataaaaatatttctgtgtattgctctttaaaattgtatgtatttgaaatagtacatatttaagcctataaataattgtagagagtaatgcagtggatgcccatgtactgaccatataggcgaagaaatgaaacattatcagattcctagattttcctctcctgtggtattccttcctaaccattgttaaacattttatggtagtcattatcataaatacaggtatatatgcacaaaataatatataacatgtagcacatacacattatgtatccacacatgtaaactgtatctattattaaatcaatgtatttgaaaactgcccaggaagtatatctatatccctatgtgtagaaatatacctatacacacacacacatatatgtatatatactgtatagcacgtattaaaagttttgtgaacaggcttctacttggcatactattttgacagcatttgtttgaaattcctccaaactccagttctttattttcacatatgtagttctacaccatatgaatatgccttgcttttcatttagccatcctatcgcaggccactttttttctttcaaataatgctgccctgtacatgtatgtgcctatctctccccatgcatacatgtctgagtgtttttctagggcataatctggaattggaattgtgggtcatagaaagtacacacattagactttactggatattgccattttttaacccccaagtggttgtatcaacttacagttctgcccctaatgaataagagcttgttctgtgccatcatcacattgtcaacatttggtgaagtttaatatttgccagttgagtggctgtgaagtagtacttgagggtttaaacttgcatttttctaattactagtgaagttactggtaagagtagccttgtgtttcctcctttgaattgcctgttcgtatatcttgcctattcttctgtttttgttttgtatttgtagtattgataggtagattttttttttttaatatcctgaaccttttgattatttttgataaaggacttctcctagtctgtgtttactcacattttcattttttatggtatacgttgttgaacagaattttaagattttaatatattaatagaatttttccattttgtactttgtggttcacacctttatactttttgtaagacacataacacagatgttatgaattattcttgtattttcctctaaaagatctgaaacgttgcttttttacatttagatctctgaaccacctggtgtagcattttattgtatattttgttattagggatctaattcagtattgttttttaaaaagggccaatgagaatgtcctgtactgttagttgatttgtcatctttttaccgtagtctgcagcatcacctcttgtgtatgaatacgtcgggctctattttgttccaggcatgtagaagcaacaccaaactgaattgctcactatagctttgtaatgagtccacatatctgatagggcatgtccttctaccctgcctttttcactattgtgtttgctgctttgggacctttcctcatccatttctctagattttagaatctgcttatcaaatatgttcatgaaaaatatttgagaatttttactggcattgtattgaatctatagaacaatttgggacaaatacagatgtttataatactgaatcttcttatacatgcacctggccggctggcctgctttctcttctttcttctttcttttttcttctttcttctttcttcttcttcttcctcttcctccttcttcttcttcttcttcttcttcttctttttttttttttttttttttttttgagtcatgacctcgctctttcacccaggctgcagtgctgtggcagccttgacttcccaggctccggtgatcctccgacctcagcctccctggtagctgggactacaggcatgcaccaccatgcctggctaattttcttatttcttgtacagatggggttttgccgtgttggcctgtctgctctcaaactcctgggctcaagtggtctgctcatctcgacttcccaaagtgctgggattacaggtgtgagccctgcacctggcctataatttcttatgtatttaagtctgacaatttttataatcttatttgaaagtcatatacatcttttattagattaagtctgggtactttgtattttaaaaaacattttcaatagtatttttaaattaacattttttaatgaaacttaaaaaatatgtatccaaattgaaagagttctgtaatgactccaccatgtagatgctacagcggttaacattttgatagatttgctttgtcatgtctattagtcaatcttattctttcatgcctttcgaagtaagttgcaggtattagtatatttcactttcataaacatttacatgtgcctgtagctaactagagcttagcatttgtttttttttccctctgaggtaaaattttcacgtagtgaattgcacaaattttagtgtctgatctgaggagtttttatatccatttctacctttgtaaaacaataacctattaggatagagaatattttcatcaccctgtaaagttctctcaagcccctttcttgcgtccacctctgccaccagaggcagccattgtactacattttttgatcatagattagtgttttctattctagaacttcttttgcaagtacttttttttgtaaagtctcctttcactcagcataatattttttagttcgtttatgttgtgtacacggtcacttgttcctttttattgtcaaatagtattccagtgtctgactatagcacaattttttttaagcttttattttaggttcaggggtacatatacaggtttgttatatgggtaaattgcatgtcacaggggtttggtgtacagataattttgtcacacaggtaataagcttaatacctgctgagtagcttttttgatctgcaccttcctcccaccctccaccctcaagtaggccccagtgtctgttgttcccttctttgtgtccgtaggtagtcaatgttttgctcccacttataaatattaataagaacatggttctctgttcctgtgtcagtttgcttaggatagtggcctccagctccattcgtgttgtatagcacagttttttaaccccatcttttattggtggacacttgggctagttttgggttattatgaataaaattctatgaatattatagaagccttttttgacatatgtttttatttctcttgagcaagagagggattactgggctatagggtaggtgtatgtttagttttattaagaaactgttcaactcttttgcagagtagttgtacaatatattttatactcccactaaccatgtgtggaattggttgttctacatatgtaccaacatttggtggtgtcagtctttttaattttagccattctggtgggtatgccgtggcttcttactgtagtttacatttgcaattccctgatgaataatgatgtcaagcactttttcttgtgcttattggctacacccattatctttagtgaagtttcttttttgcccatttctaattttattgttttttgttgctgagcggtaattctttatgtattctggatagaagttcttttcagatatatatagcacatatttctcccagtctataacttacctttttatttttttatttttaatgctgatatttattttttcttttctgtttttgctttctgtgttctaagaaactgcacattctcacgtctcaaagctatcctcttttattttcttctagaagttttatagtttcagtttttatgtttgtctatgagcattttcacattaattttgaattagatttatatttttctatatggaatttcagttctagcaccatgtgttgaaaagactttgctttcattattggattgcttttggtgcctttgtcaaaaagcaaatgacagtgtaagtataaatctgtttctgagcccctctgtttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtccctctgtttttttgttatctgtttgtccttatgcctttactttatcacagaatcttgattactctagctatacagtaagtgttaaaactaggtagtgtaaatcctcctactttgttgttccttttaaaatagctctaaatagtgtagatactttgtgtatccatatacattttagaatcaccttgtcaacttccacagaataaagcatgctagggtttatgattaggattgcattgactccgtagaccaactttgggagcattaatcacagtgatattgcacattctaatttatgatagtggtatatttcttcatttgttaggtttttagtttctttctgcctttttttttgtagattttgctatggagctctttttacgcatttttctgttaaacatttttctaaatattttgtattttttgatgctattagaaatcgtatttttaaaatttcattttcccattatttgctgctaggatgtagacatagaactgttacatgcaccttatatcatgtagctttgctaaattcatttcttctagtagttttttttaagaaaatagattctttgggattttctatgtaaatatcatgaagcccattaatagaaacagtcttacttcttttccagtcttttcttgccttactgcactaattaggatttccagtatcatgttgaataccagtgatgagagtagacatcctggctttgtttctgattttagtggcaaagtatttagtattttaccattaagtaagtaaaatattaactcagggtgttttgtagatgcttttcattggattggggaaatttgtatttctaggttgagaattttgtcaaatactttttctcactcaaagtcccacttggttgatttgaattgtcctttttatatattgctttatttgctaatattttgtcagcaattttgcgtctgtgtttatgttagatgtgggtctgtaatttccttccttttttcctctcctcctctcctatcctctccccctgcttctccttctcctcttacttccttaagaattgtgattagtacggaatattttctctgcacctattgatattatatatttggtttttctccttccatactttagatggtaaatgataacaatagatgctctaatttaaaaccatccttacatttctgggaagaatccagcgtggtggttttatatattttcagtattattggattagttaatagatccatgagtaaaactgacccgacattttctttcctggttttgttatcaaggtcatattctagctgcataaatgaatttaggaagatttcttctttttctgttctttggcatagtttgtatagaagtagttattggggggctgggcgcggtgggtcatgcctgtaatcccagcactttgggaggccaaggccggtggatcacaaggtcaggagatccagaccatcctggctaacacggtgaaaccccgtctctactaaaaatacaaaaaaaattagccgggtgtggtggcgggcacctgtagtaccagctactcaggaggttgaggcaggagaatggcgtgaacccgggaggcggagcttgcagtgagccaagattgcaccactgcactccaggctgggcgacagagcgagactctgtcaaaaaaaaaaaaaaaaaaaaaaaagaagtagctatttggtaaaactcattggaacctttttgtcattttaccccaacactgggtgaggtgtgggtagacatgaggggaaactgcctttgctttttaaatgtttacaggactacttaaaatttctgtgtcttcttgagttaggtttgctatgttatattttctcttggtaggtacatttgagtaagttatattttctaaaacgttttctgtctttgaagtttcaaacttactggcaaaaagttgtgtatggttttagtgcttcttgtaaacagaatatagctattgtatgtctagtattaccttgtaataaaattccatttaaaatgactaaatactaagtttctttaaattgtaactatttcagctactaagaatgttttgctaagtttattaaagtaaaaattctttataaaatacatgggatattctaacatctgtgagaaggtaagccatttaatactggtaatttggtttaattgacttgatatgctgctcattttcctccttaaatggtaataactagcaataggtacattggtttgttaaaaattgaactttcttcatgactaaaatataatgcttattttcttgaatcttaagatttatttgattatttggtggtttctagctggtccatctgtttagttgtaaccagtaaatatacctggagacctagggagcctggcatggatccaaacatagcccaatgtttcaatcacatatttgctttgtaacattattaaaatgaaattaacttatatgaaggtggaaaactcttaagccccttgtatttattttatagtttttttctagaagtagtacactatttgtgttaataagtacccaagctaatttttagaattaccttgttatcagtgagacatttaagatgactgggtaggatagagtaacattgagtaagagcacagttcactagcttaagtacttttactgatttggagtaaacttgaaataaactatgtatgttcaacaccttcctgctcagctggtccttcaccagtgccttgtggtcttagtgtgcttttagcttatgcttattcgtattttcaatgccagctatttcacatcttcaccaacttcagccaatatcttactatttatctttcagttgtggcagacggcaaactacagtgagaaaaaaagcagaacagtggggccacctctgaggctggggatggggtgcaatggaaatggccatgagggaatttaagcagaaatattgatgttctagatcttgatagggatctgggttacatgttgtatacacttgttaaatctcagggaatgtatacttaaaatttatgcatttcattttgtgtaaatttcactttaaataactataaagaaatgtgtaactatagtttatgatactcatgccgaattatttaggagatgtgtgctgatgtctacagtttactttgcaatgcattatacaaacaaggtgatgatgtaaagggatgaataggtatgctacaaacaatataataccatgttaatattgtagcggaatctaagtgttatgaatcctttcagctttgttgtgttttgcaaattttcatagtaaaacattggggaaattcttacgttgtttgtttcctgtgaaatagccatttttgtgggtcagaaactgacaatttcctgtggttgagcccgacatatggaagcacattttgtagccattttattgaggcatctttatctgcctggatgctaacaggaaatagcttcatttttctccattcgttgtgcacagttgggatagattaatctgtttgctcttggtagcagaggatcttgaccatctttgggacagaacttaacatctcagtcactctttttaaaagtctgtctggattagagctgatctcattttcggtgcttatgttcctgtctcccctttgcagcagggcaggaggggaaggagtgagtgtgctttcctgtggtttgcctttggggctgtgctggggaggaaaagggggtgaggcccctctcagtctcctctctaagttgataagattgactggcatggttattcacaagtgacaggtgctcaaacactgcccatgtgagttctttgaaaggcctggtatggaccctccctgtgacacatgacttggtccaccctcaatcccctgggcctccactcctggcagaatacttcatccccccttgctcttgggagcccattgtgtgtcagtcagcccttttgagtgaggtgctggcaaaatggtacaaacgctggtacttccctgctgccctcttggatttgtgggaagctgacattttgcctggagcttgagctcccttgtagccgtcacctttctctgtagccgtcattccccagttccctctgctgttcaactaggcatagggtgggccatggagtccgttgcttgagtggacatccactggggaatgagaagtcaatctccctgcaggcacccttggtctctgacaggcattctcctgcagagaactcttgatatctctcttagaaattttttaagtttttattataaaatggaattttttttcacagtcttgcaagtaaactatgtgccttcctctataatactgctttttaaaaatttttcttaggattttctagggttgatagagtgaaactcacagttaagagaaactttttgattttttttttctcattgcaactgtctggtgatttaatttaaagagtcgagattttgtgaattagaataatgaatttttagaattagaagagacatgagataatatacttcatttattcattatttttcattttactgaggcccatgaaacaagaaacttaccttgcagtacctgcagtacccctctctcatttgtcttatggcgagggatttttggaatttataaacaaatatttgtaccttaccaagtagattgaaatatgagattcactattctacagaagtgtggttatttagcttttggcaaagttgtgaaatttttactgatctgtatgtaggaaaagtcagacttcatgctgttagggtgaaggccgctgttagggcatcacctgtttattcagttgatcatgttttctgcaagaagttaggcaaaccatacagtctgaaggaatagttctcacaagactgccctcacttcaggcaccagctataattttggggtccccagggtcctctggagatcacaactgatatggcatgtcccagcgcccacttggttaggctgtccagtggccaaagcccccaggcaaagacactgttatcaggcagaacattcctgggatctggagaccccactgaagtaaccaagggcaaagaccagacttctctttgggtaaagttaattgtttatgcaatttttagttgcagccattgttggtgtttattactgttactcacttttattattaatttatttagtaagagcttgttggccatctgtgatattgtgaaatatatatttggtcttcttcttgtttcctgacatacatctcctaaaacccttgtggtctcccagagtcttaagagtgtctttcgctaataattgactggcggctaacagcccctagatagcttcaggatgggtgccggtcacaggaaagacaaaggcatcgttagaagattggaactttcagccccacccccaacctctgggaggagagaggggctaaaagttaacttgatcactagtgaccattgatgtaatcagtcattcctaagtaatgaagtgtccataaaaaactaaaaagatggttcctggagcttccagatagctgacaaagattaatagaggagacagtgtgcccaaagagggcatgacatgtgtttaagtttagcctaaagctgcctccttgcctatttcaagttcagcctaaaggcttttccatatgtagtaaatcgtaacgtaactaaatgaataaacagactgtaacctacccttgtatcagtcacagaattttagtcagtcacaggggtacaactgttcaaactatattcaaatatggcaaacactaagctgtagccaatccagctgtttctgtgcctttttctgtccataagtattacctgaccttgtggcagccctggagtctctgaactgcttctgggtcctgcccaattcaacaattgttctttgctaaattaaactctgtaaatttaatttgtcagccaggtgtggtggctcacacctgtaatcctagcactttgggaagtggaggtgggaggactgcttgaagccaggaggagttcaagaccagcgtgggcaacaaagcaagactctgtctttacaagacattttttttttttctaattagctgcatatggcggtgcatgcctgtggtcccagctactcaggaggctgaggtgggaggattgcattcaaggctaggagttcaaggctacagtgaactctgattgcactactgcactccagcccgggaaacacagtgagactctgtctaaattaaaatcaaataaaataattttaatttggccaaagtttttctttaaacacatggaaacttggcacttcttcccacataccttgccctatgcatctcttccatctggctgttcatctgcatcctgtgtaatatcctttataatcaactagtaaatgtgtttctctgagttctgtgaacccctttagcgcattaatcaaactggaggagggggtgttgggaactccgatttatagccagttggtctgaagtataggtgacaacctactacttgtgactggcctcagaagtagagacagtcttgtgagactgagccctcaacctgtgggatctgacactatctgcaagtagatagtgtcagaactgaattgaattagaggacagccagctggtgtctactgcagaattgattggctgcagaattgattgcttacttgctggtgaggagaaatccccacatgttttagtgaccaggggctgcaggaatattctgtgttgactgtggggtgagagtacagaaggagaaaatatagagttttcccaatatccttataatatccccaagatgtattataattcataattgtatcaactgttttttgacctatggttttctactaactcaactgtaagacgtgtgttttataatttacaggattcttctgtgtatgctgtgctaatgaatttttgtaatccctcactttcctccccatttgcatctgtagggcactttattttaaatgctggattcttttgctccagaaagtgggaactggtggggaggagggccatggatcttttgctgtcaaaataggttaaagtcaaagagtcttcatggacacagctgtaaaccagtgttagttgtccatattggcagtgtgtccttgtctcattgccttgaaatttagagttaaagcaggattaagcttttttgtttcttagttttgaaaaaataaccttttttattcattgtaataacttttctttcaccacctcagagtttctcagtggacatagctcatcttcctttacaccttttgcttctctcaggccagtgagagactgtcttattttgaacaccatgctaataattatcacccacccatgtggacaattgaatagctcagaggaatgcttttttttttctatgagaccgtcttctctattgagtgctctgtagggagaaataattacgtttgcagagccgactcattaggcctggcttgaggaactagcctgtgaggttaactactatttatattgtgtttttatcttcttatcagtggtgtttgggtccatcacaaattcgtatgacaggcatgggtggacccatattttgattcacattctctgctgcagtaaatcggtattagcacagaggtgtgggctagggcagtagctccttagctgggtattctaaaggatagtaaaggttccaaaaatacctggaggctgatataaatgggtattgctgatatttcactttcgtttactaatactgatgaaaatgcaagcagctttctcaattttgttttcctaagttctaaaactcatggcgccccttgtcattcttccagccatggtgcctttctacacagggacagtcaagagagcagcatctggtgtttgccaggacaggtggaggaggctacagagcctgtcctacctggccccactcatgtacagcccatgtgacagtcatccaagatcaatcagggaggaattcacctgagatagaactgtgaaaacttggtgaagggacgaatctgagtctgaaatcagagtctagaaaccactgggctgctttctgaatttctctctcttagctatttgtaggtcttttcctctagtgaattaattttaggatcattaaattcatggagatggggaaacctgaagtgacttgacagcccaaacaactaagcaataagttgctcccttatttctaaagtgttagcagaagaagtttgattactcataccatatcaaggatttgggaaggaatgtatccacttatttcacaagtgattattttattgagttcctagtagatagatccaagggaagtgtacagtaatgaacgtggcagattcagttccttgttgcatgaaacttacattctggaggtggaaagagattaagaaatcagttgttgtatagttgtctaagtagcagtgtaataacgtggtaaagaggtgcacactgctgtgagagtaagggaagtgaggaaggcttccttgaggaggtggtttgtaagcagagtgagctggcaatagctggggtgtgggggttgtatgtgatggtgcagctttgacatgggaaaagggaaaagtctgggctgagagcccgagacaggaaagaccatggtcaggtattttgggcaggtgtctaggcagctaggggggtgacacaacactaagactggagccacgggctggggccccatcacatggagccttccttgtaggccacatggaagatgttgtattttatctcgaaagcagtattaagacattaaaggatttttaacaggtcagtgctataatcagatttaaaaaatattttgtctgctgtatggagtagaaaagtgtatgctaagttattgaaatcacctaggagatgatgataacttggattttgatgatcacagttgaaagaacgttggaacttgagacagagtttctcactttttaatgtcatggcacacgcaaatgcttttaaaaactatgctgtggtaaatggacaagggtgacccaggtgctgaggagaatccatatcttggcctcgttgtaatcacccgtttgcaacagccagatgataaactcaattttgagaggtgagtttttgggacaaaagtcaaggatgaatcctggtgtttttgtctaagcaactggcttcacagaagtgcttctgagatttaggacactgaacaggaaaggggaaagaccatggtttattgtgtatatgcggaatttgaggtttttgtaagtcattcaaatgggatattgagtagacacatggttgtggagctcaaaggagagaaaaaggtaagtcatgtagatgatagctgaagtgaactagagaggtggcataggaacaagtattacagaattttcacacttaaaaatcaactagatgagagtgagctagcaaaggagactgaaaactacgaagtttaaagaggtgttaggagtgccacaagattctgaagtcatgagagtcgagggaagagagtgtggaagaaggagggagagttctgctgagagggtcaagtcagatgaggactgaaagttttgcgttgggtttaatgacatggaaatcattgatgtgacattagagccactatgctggagccgtgtgcagaaaccagatggaagcctacaggttgtaaggagtgagtgggaggttagaaaatgaaaacagagaaacagcggctctgtggagaatttcatctgtgatgggaagagcaagatgacatgggggctagcagcgggatggagggaaacctggcaaaggcagtgaggctgggggagaaggggcgagaagagacagtgcagagtgcgaggtagctgaggagaaactcggaatggatgcaggctagggcaggtttgtgtgctgggcattgggcactcaggatagcttcctgctgagggttctgttttctctgtgaagtatgaggctatggcagtttgagtatgaggaggtaggatacattgggggcagagaagtttgacatagtcatcataaagaatggcaaggtgagtttgtagagaatatgggagggtggcaggcagcaccgaggcccagctgaggctggctctgctgtgttcagttcctgatcttgattccgtgagcccagctgcccttgcctctgtggcgggggatacttgtgttcacccagggaggcagtcacggcagtccacgcagtgaactgatagaggagcaacaaaggctcatgagtcgctggagtgatgtaaatggtcaactgtggagtctaagatggccactgatggatatgaaggcaggaggtgaagaggggatatgcaggaagcagaaataagagaactacaggatccaagaagaaaatgttgaggaaacaaagtggagatgtaggaagttgtgatcaaagagtgaatgttcccattctgtgcgtcgtgtggtgagagaacctaaacccttgcatgtggaggtggccttccccagtggtggtggccgtgggagtctgtctaagcaggtttgacttgtgtctgcagagttgcattttgttatttggtaatactggttgtttagtgttagtttgaaaatgttataattctctcctgttaactttgggtacgatgtgtagatgaaaaaaaatttgtttttgttttaaagaatcatattttcactatcttgtgacactttacagtcattatgatggagccaaaaaagcagagccttcttagcagggttacggaatctgttaggatggccgcttgtgtcatccaacaagaaacaaggtgtgaagaggaacatgaattaggttgcgtttatgatgaggtccatggtaagaatgtaagaatgagtgttggatataaaatggaggcgaacaaggtctctggggatgaagaaatgaagcaaaaagcacctgtctagctggccacagggatagacattgaaatcacatggttacggctggacttggggtgtagaagacttccctgagcatggggtgggagtgggaaagtcactggaggtggtggatgacagcaatgaggcacagtggagggttggataattagatgtcatagaccacagaggagcagggagcagggttttgttgttgatgtcatcgttttctttttttcttttttttttttccttctggtgggtaaggaaatgatggtctggaaattggtaaaagcaagaactacttcccttccttgagaccctgagaattagggaccgctggtatagtattctttgtatgtggtccctagaccagcaacatcagatcatctgggacttagcaatgccaattccagggtcccactccagacctacaaaatcagaaactctggggttaaggtcggcatcatgtcttaacaagccctgtttgactctgacgtgctcagagtttgagaaccattgctgtaatgatagctgatccggggtgaggggaaggaagtattcagtgctgactcatgagaaggctgatggattttcacctggaaggtttttggagggaggtagaaccctcgactcagtgggcatatgtcctggctcccctggttgcgagtggcattaggctgatactaatggtctcagaacacacgttggaagtttggtctttgcttagacttggagttgctattagtaccagtagctgttacaaggaatagttaacttagtgtcattttagttgcgtttgctaaagttttaaaaacatgatttactatatgcaaattaagtttatttttaaacttttcataaacattctccatcataaaaatgaattgtcattataagaggcagttgttcagaattcagaatttattgttctttaaaaagtgttatgatagattaaatgatatttcagagggttttctcctgatctccatatctaaaatatcaggtatgtcattgtcattgtgaactgaggaggaaagacatttttatcaaaataactattcaattattgcaaaagacaaaagattaactagaggacttgtgaaagtgcttgataaagatttgtcaaggagaaataattggagctgtgttgaagaagtcttggggtaaggtataatcacattttaatagctgtgattcctacagtttgacgtttagctgtagacattctgtaatttggagtggagctgaccttgcacaggccagtaaagagaggagaagaaaccctaccagctccagcagttgcaggggcagatgggattatgaaacgagctctaaattgggggtaaggttatttatgcactagtcacgattgaatcaatagaagtttgtttcactgatgactccaacaaatatttgcatgcctagtttgtgcggagacccattttataagcaaggaaattcaggcctagaagtttgatgacttcccccaaatcaaatttaatggagaagccgtgaagcaaatccaggtgtctaagtatgaaagcataccaagctgcctgctggatcagtgtaggggtttggtttctagtggtctcacccatgggggtatcgtgttgctgtcattctccctccaaaaacaacacaatgaaaggaagcttccagaatatttgtcttaataaatttgtatggtgacgaaatggtgggtcaccttaacccctgtcaacaagtgattcattatcatttaacaatttagcaagcactaagtttagtgggacagatctttgaagaaaataatgggggaaaggacgcttggccagagggcacctgagaccattttgtttagttggccatgatgtctacctacttcactctgtcctaaacctggaccatcaaatgttggtaccataggttgcagactatggtaccaacctcttaaggctttatcttaccatgcattcaatagtttcactggacagaaactgatcttccctttgagactaggcacaccatatttacaaagtgacatatcaagagtatattgtttgcttttgataaaaactgcccctaaaacaggcatctgaggaaagaatcccttctataatttagtgttttgttcctttttggaactagtaaatatcaatagtagtaaggttaataatactagagtaacacctcatttatttgatattataaaaggatagataaaatattgctaataatttaatattgtagttaacatttagctttgaatatatgtgtttcagtgtacacacacacacacactctcagacggatttaatttttatggccctttttgaaaaattgatctagtggtgtattttttaaaaatgtgcatatccttttaacaagaatttcattttttcttccagaagaaatattggcaatatattcttgccgtaagccactggaaattactagtagtattcaaagcttttaaatttttaatttgcttgtgaagctttaaatttgagtgaaaaatttagtcttataaacaacttagaaaggttgctgcctgctctagatactatttgtgctaaattaatttagtatactaatcagaactctaatgaattctgtgaactgctaatgttagatcagtgaataaatggctgattttatttcccagaagagaatgtttggagatgaggttggggagaagttgaaaaaaaaaatcagaatgtggttgtgtaatcttttcctagttccctttcaagatgatctttcccaggtcattattcttactcctgaagatttttctttccctctcctcacctcccagccttccttctatttctttccttcccaccagtcctctgtccctccttttctagtgaaacattttatgttggtgctttatttttgctgttggaggaattattcctgggatggtgtctgtgagtaagaattctagagcattgattaatttcttactatgtatggttttgtttcattcaagcaatctaatggtctttccttgtagccattttattagattctgaagggccaaatcaaactgtttctgggcttggggccatattttatagcaagacttgtttgagttttcaatgaattggtgcttaagctaaagccgttaaagcctgcttccaagaaaacaaaactggcagcacagtttgttccatttcattttttttcagcatgcttgattttttaggggttggagttagctaggaccaactgggaaaagaatcccgtaagtgggagaaaggctgtggtgttgttagggagtgcacttcagcctaagtggtgattagcagcatttagcctctaaaaataactggtgagcagagtttgtagtcaggtccaatttcagttctagaggcccttacagtgcagggattggccagtctcaagctctggtaggcaagtgcatgcagtgtgcctaaaacctgccagcagtacttttgagtttttttttttgttttgttttactttagcatttattattcatggattgaagaaatcaaaatggctgaagataaaggtatatttttgttatttaggctaaaagtggctttagatctagctgacagcttttcactttattttcagtggtgctctgttaaaatatttttggctaagtgctttgactgtactgtctacattttctattttgaactcctggagatactgacttttcatagtagctgaatatttcattgaataatctgtctttaatccgaatatgttttagtgtcttaatttagatgaccttttagtatgttgtactactggaggctgcattttacaaatttcaaaaaatgtacaagctctcttcttattcttataagttaattacaatgaatttaaagaattatctatatttagattttatataaaattataggagatataaattcagtctcatattaatgaacagacttacctggttcaagcaaggacttaccatttatggaaagtgacctacttttatgtgaagcagacaataaatgcaaagaaaaaacacaagggttttattttgattttaaattgactctttaactttgaagtattctttaactatgtattgaatttaatgttttgtatatatttgcttttgctttactttgtaaattaagatagtctttccattaattgaaagactgcattcactcattatgttgaagatttataaaagaaaagaatagatgtatgaaaactgcttctaactctcagctgtctaatcagcaactgaaaggattctttgattaggatagagaatataagcatgtactatgtgaatattatttgaataattggtgagaatgggtcacttgactcgtctgataaagtgcttcatgtagccatgaagaagaatatgagatatgtatctgacttttagttcttttggaagacatttctctcctcttgtggattaggtaatccatgtagttaggaaaaatcagctgttgcatctgatgcacttttaacagtttttgattcccaaagggtgacattttatagcatggaaaaataatcagtttgatgagttgcttgacagtttttgtgtttttcaaaaaactttaaatgtgtagagtttatgtgtaaatatgaaattcccaacataatgctaactaaaacttataaatgatctataattcagttagtagtaggccagtgaagtagctggtgactgttcaagtgctggggttcatcttcttgtctccctttcctcaaccaaataaataaaactacacattgcccttcccccggcttttgttttggagagtcttcattttggactgttgcttgccatagtaatttctgtgtttggtggtatgtgggaacattttctgatttggaggtcatgtacttttgatggaataacatgggaaaaaatgaatcgcatcgttcttgcagtattcttaaaccccagtaaaaatccgctttgactgatcccagaactacaggttgaacatgaagccagaaaatgaaatgaagacttagatttattctgatcttagaaaatagggacatctactagatgttcttcccaaatacctttggaacaagatactggtttcagatttgcttagggagttgtaaaccctcttaagggtttgtcttaccatgcgttcatcagtttcattggacagaaactgatctgccctttgggactaggcacagcatatttaccaaatgacatatcaagagtatattgtttgctgtcgataaaaactgcccctaaaaaaggtgtcttaaaaaagaatcccttccataacttagtattttgttcctttgtggaactagtaaatatcaacagtaataaggttaataatactagagtaacagctcatttatttgatattaaaaagggatatataaaatattgctgataatatattctagttaagaaacatttagcttttaaagtgataaatctctttactacaaactactttgaatgaaaatcttcctaagatttattatacatttcttctatgttttaatggcagaatcaatgtgaaaccagttactgtcttgtactgaagattatttgaaggactgtcagggattctgcctgaaagtttcatcataaatgacttcccaccactcagcttttctgacttcctgggcctgctcttgctgagagatctgtgcactcgataggcttttcctctgtcaccactctgttgctttgactcattgggttagattgtgtctgaaatgtagagttttgtgcatagagctagaaaacttaattgaagttgttagaatcacatctaaaataaaaatgtaaacaaattctaggtaaaggtgtattttttactgtgtttggctgtctccttcccatctgaatcccttgctgttttggtgcatgcattcattttttagaaaaaatattttgtctacttttcccttatatttagtgttacagtcaataacttaaatgagtatcactgagttaacttggataaatgataatttccttttcagaatctcagaaatttttctcctccatttccctttaagagagatagaaatggagaaatgattaaaatttgaattcaaactattactttgttttattagctatttcattatagactttttaattttttttttaagaaagggtcttgctttgttgcccaggctggagtataatggtgcaatcatagctcactgcagtataggcttattttaaataatatcatcttgggtatctgtttggccacatactcattataaaaacttaattattgggtaaaattatctgatattcatgtactgaataaaaatgttggatgaatgaaaagatgaactatatttgtttagccttgctgttttccagttaatgaggaaaaatacaagagactggtatcagctacagaatgttcaagaggacataagacaagaacccagttttactgaagttttagcattccttttgccaaaaaaaaattcaatttgattcttagaggcaataagtagcaaaggcaggaaattcttagtcattagctactataattccatatttagagtatgtggatattttggaaggtagtatttttgttaaacttagtgttgtacgcaaatggatttgtacgcatatgtctgtatgttatatagaaataagcgttcttttttggatacagtgttagaaaataagtctttctgtttataaaaatgtagtgaattagacatacaaaactgtttctgaatctgtggtgcttcctgacctcacagaagcttactcactttcgtaaatctttttttcttcaaattttagtagtggtttaatttgtatttttctttttatatgcttacaacacataaaaattttggaaaccaccatttccctctaccaacattgcagacattctcacccaatcttctcctgctatggctgtgtttcaggtaatgatacctatttgaagttgatttaatctgcaacaataggatctatgcccagcaagtatttttatttaatacataaattacgtttttatatagccagcttttatatagatcacattagaaacaaagttgatggccatttgtcatttggtaagcatactttatgaatttaccatattatttacaactctggttctgagggatccattaatatttaaagaatgtcagaaaaaggaattacttgacgttttaagaattacccagcactttgagaggctgaggtgggcagatcacttgaggtcaggagttcaagaccagcctggccaatatggtgaaaccctgtctctactaaaaatacaaaaattagccaggcgtggtggcaggtgcctgtaatcccagttactcaggaggctgaagcaggagaatcccttgaaccgagccgagatcatgctagtgcactacagcctgggtgacagagggagaccatgtctcaaaaaaaaaaaaaaatttatctacatgtaggcatgtagataaatatatgtatatgtttgagtgtacatatatatactcagatggatttagtttttatggccccttttgaaaaactgatctagtggtgtatttttaaaaaatgcatatatccttttaacacaaagaatttcattttttcttccagaagaatatattggcaatatattcttgacttgagccgctggaaattactaatagtattctgtaattagaactggacttagaagtcaaagggcaagttctagattagagctagtggggttttttgaaatcgtgtaatttggcccactgattagagattaaggaactcagagctgtagagatgagagtatgttcttagttctacccaacttgtactggtgactttgggagaatcatttcatgtttcacttataaaacagataattattcctgtccttcttcctgttggttctcacccaggaactgcccctgaagggaacatgtggaaatgtctggggatgttttttttgtcataagccttgacagctccttgcctttgagtccaggggaaaccagggatgccagaaatcttgcaatgtgaggaacaggtgcacaggatgaaacattgtcctgcataaacatccagaaatgccctctgtagaaatagtggcaggacaccgtgaggatcaccggcagcaaagcacatgaaagcactttgatggcgactctacctgccacacaaatgggagacaccgccctggccttccatcatctgtttgataaacttttcctcttctcagaaggcattttgggatattatttattctttttatttattaatattgatatatgtattatattcctttttatgggaaatttgaatattgtatatctttttaagggcagtgttgactattttctgttaatatcaaatcatttttgtttatttttggctgtaagaagaatatttacaaaagaatataaggtatattaagcatatcaaatgcgataaatgacactttaggtggacagcagtttacaaagctgtttcctgcagtgagaccaattgtgaatgagccttttcctgtttccttaggcctcaacggatcttgtaaaggagtaggaatggattgtgctgtttcacttttctgtccttttctctctggctaagaatatggaatggtttagggggagatattttcttctgtgtgttaacagagtttttaagattctgcagaaatgaaatgggacggagaaaaggatttggctacatttttatgtgatttcattaagttgtttatgtgctctgcctttggaaagaggtaatattcaggtcattttgatgagtaacttggatggaatatacatattatactaaatctttaaaaaaattcaggagtttatttcctgcactacttcaaagttagtgttgcatctaaacaatcttttctgttttcagaaatattttgtgtgacgtgttttgagaatttaactggaaactgtttttgaaatgatctatcattgtacataatcccaaattattggagaaataattgtgagaataagtgttcagtaaaatgttttcttcttatgatatcttacatttatttctaaacagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggtaagaattttgatatccttatgtgaatttgtaagagagtaagtgacatctcttaggagtcttgaatatttgttatcatctttctggtactggtaatttctatagcctttcagtggttctcaatagagtgaggctgaaaggggatatgaagaaggttaccttggagtattgtcttttgaactctttaaatgtgacctgtaggtttttgaaaaaaggctttatattgtatgtctgtcacacagggagaagttttatcaaacagtactcattctcactatatgcagtactttttgatttctattcaattttgttatattataaattttaaaaatacttgatcatgagccattacatttatttaaggacttgctaatggatcataaccacacaatatgcaaaactcttccttagagagggttttcaaagtacacccttctgtgtctctgttgggatgggatgagtacgtgtgcacacatataggtactggatgggtgtgctgagataggcgtttgtagatattattgtgtgtgtgtaggtgtgatctgtgtgctgttctgaggaagttgctgtggtccttctgatagtgtcctttctccacctttttccttttctgtaatcactgaagtttttcatgattttttacattaatgattctttgttatttttggagtcacattctccttcacttccccaaaaatctttttttaaactgaaataaaattcaatattatatatatttgaatgtgtacaattcagtttttttttactatattcatcattttatatacccatcagcattatctagttccagattatttttgttacccccttcccctaaatacccaaactcttcctctttccctctcctgggaaacactaatctactttctgtgtctgtgcttttgtttattctgggcatttcatgtaatggaaccatacattatatgatcttttgtatctgcctttttgcacttagcataatgtttttaaagttcagtacttcattttatggctgcataatattccatcatatgggcacaccacattttggttatctgtttatcagtgatggacatttgggttgtttccactttttggctgttgtgaataatggtcctcctctttagtaatccagtgaaagatgtggacctgtcactggaaaaaatgcacacttgtgtctatgtacaatgttgcatgggtgatatccccttgcattggacttcctgtgcttctgctttacttgtcaaattatagacatatttttggggagaaagggcaaacaaatttttggctgtaggaataacaaaatatgcttatttgtaatctgtctttcattgaagtttttcattttcattactttaaagaaagtgtctctggatagattgacagaccaactgagggagaattttagtctggagacaaatttctgagtagatctatgctttgactgacttacagtgatatgttgttagggaatgtatcttaaaagaggacactttaagtatttgtacctttaagcacaaataacagttttcatgtttttacatgcatgcagccaaagcaaaggacttccgttataacttatcagaggtgcttcaaggtaggctattggagttgcatttcaagtctacgtgtgttactctctaatggctcatcctttttctactaatttaattattatctacatcagaatataagtgataggaccaatttcccattatgggtttgtcagaaagggtagtattttctatcttttactgtttcttgaattctgtactctgcatagccttgattagtactttttgttttcttagcagttgaaataacatccttatctcttctttcatcataatcattttaaatgtgtatgtgtttgctaagtcagacttctatatagcaagttaaccattttcctaggtagagcaagggctctggggagataaagattgatcagaactaatctgagccaaaatttctgcctgttcttctgtaattttttaatgtactttgtgttaaagaaatgataacaattgccaaaatttttttttagtactaatgctgtatttgagaaagctgtttaaaaaattgctgtacattaacattattatgtttctccacagtcattgtccaataatgaattagaatcatgtagattttaggatgcttttttagggagttgaatatatttgactttttgaaatgctaaacaaaataacagtgttccttatgataaagcactaaagcctaaaaacgttttctgttcatcaggaggaaaggttttggtagtattgtcttctcagcatatctgttttaagccctttttttcttagtatagattgcctgtgctgattaagttaagtagaataatcataagttttcctttataatttccgaagcctccagttttatatactttatttccagaatgatcttttatttttaaaggttaattcatgatatttctgttataagtcatcattgtaaaatataaaattaatgattttttagtttttagtacttagattctatgttaatctatttacatttggtctttatttgaggcttggttgtttcttttggttcagatattgatagtgtgatgaaatttcatgctttagaaacattaaatttcaagtgacttaggaatgcatcaatattatttcatatatgctaaaaactttaccaagaatatttttagcagtataataaaaattattctgaactaattagatcaggatgttgttcaatctttaaagataatgctgtgtcagttttatttcatagcatttattagctgaacatttcctgactctcttaactgaattgctcgctatttttaggtaagatattcatttgacactgctttgcaggattaaaagagcaaagaattgtattaattggtaacatttatgactgagttgcatgacttcactaagttataataccttattaaatttcttttcttttttattcccatatccatcatttctgccctattataggaaaactaggaatctatgatgctgatggtgatggagattttgatgtggatgatgccaaagttttattaggcaagtacacattttatgttttttgttagtggtgataaaatgctggaaacaattatttttgctttaataatatctatctcaatagtatatatcttacaggagacttttctcccttaaatcatatatttcattactgttaaaattttaaatggcttatttttccacactctttcatgtcaatttacttttatcaatgaataagtgtatatctcttacacatatatcttttgataagtataataatttcatgtgtgtttccagatttaaagtacttcttattctgaacttagaatttgaatagataatatcctagtctgtttttagatatggtaattatagccatttttcattaacattacacattcacttccatttcaaaatgtaaatttctacaggcttacataaattaatgatgaaataaaagtgataataaacatcttaaaatgtcccatgcatattttaacggtagcattaaaatatgaactcctggtcttttgacccagtgtctttattttggaagtcttggacccttctctttcattatcagaattacttgtctttatcagagatgtttcttgtaataaataacaatgtggtattcccttatttgttttaaagtgctgtcttgctggaaagaatggtgttaatttcaatatgcaaattttatataatctggcctggtgagacttcctttgcttttgtatgtagcataatatatgttaaaactttttatataagagtctttagaaaaataatggatatggcatgatattatacactaagcttataaaataatgacccaaacaaattcttcttagttaacattgttttgtgtatatttattagatatgaaaacatggtaggatgccacatctgtaactagtgaaactgcttttagtagattaattccacctccttatgaaataaagttccaaatatgaaaatagagttttagttgtgattaaaggtaataaaccttcctaatgttgacctgtgttggtgttttttgttttttttttttttttattattgcccattgggaattagtgtttgtgcattgaaacttattatgaaatttcttttcttgtcttaactttaatgaaattttcaatgtagtcctgtcattgtgtatctatatttgagtttctctaaatatattaaatcctcagatgactataatcttaggcatgtaaaagaaacaaaattatgtagaacttatcagaatgatgttaatttgcttgcctataaatggtttattacttcattatattactttaaatgacacattctgaatagcaaagctttttattttaaagataaaataaaatgtgggccaagttccctcatttttagaaataatattactctcatctactgcattttattgatttttatttgtttgtttgtttttgcttaaaaccagctatgtggtctgtcaggaaatgccattagaaattaaaatgtggtatttctttgataaaacacactgatttctatagcaaactattaccttaacttgatttttagtgtatttgagatttcaaaaggtcatcccctttaagttttttaacctaccattaagaagctaattaattgtaactttgaatattgctgtttgcaggtatagtgtgaggaactcataaattgtgccatttataagaattatacacttggaggtggaactaaatttggtgaatatcaaggtttattttggtaactttactaataaatgcataaagacagatcagataaagctacataaatacttttttactcttcctgtactagtttgcagttggcttgtggcttcagtacagatgaaacaaaccaaaggtgaaatgttaggcttacttatcacctctaatcttatttcatagcatttgagttctctgcatgaaatgcaaccttaacttgaattgagttttatgactgaagttcttttctggtttgtgagattattgtagtttagtggtgcctctgttactggaaggttactgcaaagacagcctggtgaaattgttgggagtacagaggctttaatgggttctttgaggtcaggtagaggttatggggggagcactacagtgagcatatacccaaaatgaagccagacttccaaggtacgttctcactggagagggagcttaatggtaaagtttaaactttaagggtttaggttttagattaaggcccaggagatccaaggggaaggaggagggtaggaaatcagagataagaggagctgttgtcatcgcaggtatagtaataattaagatatgttaaactttcataggattttgcatttatttcatcagtttttttttctagattcttaaatctgcatatatctaaatcttataaatttggggaaatgtacacatttacatggtacatttcactcaattttagagtttggcttttcttgtgaaatagaattaaatatatgtgagtaaatcaagacccctaaccatcattaattttattatttggttatttctggccaaggcccttctgattctttgaaagcgtgctaagcccatttttcttcatttacataccttcttatttttgtggccaaattaactaaaatataggtatcttttgttgtagttcagattattgaaaactaccttgtttgaaaatacattctttaaaaacttattttccaaataaaatcaacaggaaaatgacccaagaactaaatgatgcgaggactaaatccttagagtgacaccacctaaggatcatgtggttgtccttttgtcctatggctagcacctagctggcatcgtatcaggtatgggtggaaagcaaaagggaagccagtcagcacttgctacatcctggaaaatcatttgtagactgatagatgcatgagtgagctgatgggaggagaagaccagatcttgccaagccaaaggcattccctttggttgagccctgttcttagaggttcagaaggaatcacatgccgagagtatatatttttctctctggactagtacttttgtcttgagaaccacaggaaggttgcttggctgggtaaacagttttgttcaaatgcttttgcatattcgttgcatatggtcatctgtcatactgaaggatggaaaagttttatatgtaatacttggaagtacttataatatattggcaaatggagaaaagtaaagatgtttatactaaatatgcagctatagtgttttaaggcaggaagaagaaactgttattcccatagggacttagttgggattatagatctttgttcacagcatttgtctgctgctaaattcagtgaaaacattctaggcttgtcaaaaagtaatttaaataccaactgcaatttgcgtttttcctaccaaaaacatgaacaatgacataatatagttcttttgagtaaagcagagaaaattcactataatctttaaaacttttaaattagttgtcgtcttatcctttatctgcctatcttgattgctggtagttatactacatggagacattgtgtgttgccaaagccttaaatgactgaattacgtggttccaaccagaaaagctcagtggtcatggatgttcacatttcttacagtcagaacaccccaccctgttattcctcctcaaaattaagggcttggtatacagcttggtagattctgatacctactagagctaagaaacctttgctacccagagccagttcttcacaggaaaaaaacaaatgatgaaaacaatatatactttgatttatttctatcctaaggcctgtttggggtccaatacttagttgtaaggggtcttagcaatagaagctaatttcacaggcccatggggagaggaatttggaatgttcctattgcaagtgaccagctaaggccttgatcacatttcatatcggtaggcaaagtgaattattattaatagctgactcttgtcattggccagaattacaggaccatgagtcagttgccagagttttatagagctaccacatttaatagtgttaaaatttaagtgttaaaattatctgagttacataatttgagtgtatttttgcccacctatggatgctataaatggtaatactgctaattatattaactccagaatttcctaagtcagctccaggtcttaagtggggtggtggtggggggaggggagaagtttgaggaaataaacctttctagtttgaatgaacaaatgaacgaatgtgtgtataatcaactctcgataaaatctggttggtaaatgagcaaatctggaggttgtcagagtatatatctttttttccctgatactgcttttactcactcttccttttactgtcaactgatttttccattactgtccattgatttttgatgataaaattttgtctttcaactcaacactctaatgagagaaaggtaaacctgggtaggggctggtaggagtggtgaggcttggtcaaattgtggctttcttttgacatttgattgagagttgattgtaaggtgtgcattttaatggacttctttattttccaaataccgtttctgtaaacctctctgaccttgatgcacctcgcttttgagatcacccttcctccacttcttttttccacctaactgctctccttattttctctctctcttcctttattcttatgtaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggtataattggtttctgtatcgttttgtttcaactcatgtattcactgaactaaatttggacacttaacagcaaattgtgttgtggttaacccttgatgcttgtctttctaacacactattaattatgatgattctaatggatttcattataaaaatatttctggcatgatttttaagttaaatgcttctctgttctttaacatgactgatgtataaaatgatggttctttactaagctgatattttttattgtaatttgtttaggtttgtcagataggttcatacaaatttctatgtaaaattctgtgttaatggtgcttttaaaataatttaaaaataactccatgtttttgccttagagtaagttaacttactgttttcagatagtagcatgacatatttctgtctgtgaaagcaaaatttattttaaattttatttccaaatatacatccagagaaagtaatttgtattttttttaaagtaggcatattacacaagagggaacatgtgaatatgtatcttaatgttgtacatattaaaattattcatcctaaataagtctttttccattttttccttcattaacttattaattggatattgattttggcttagatgtaatgtgatttttagaattataaacttattgaagtggtaattccatttagggcagtaaacttttcccattagaaagccttaaaaacatatttgaatcaattgctttaaaaatgagtttgcttcagtagtaaccaaaacaggtgtagcagctatatacaaaatgcatttcttaaaatgagatttcatcagtttcccctcaagcaaagctcttctagggataaggaagataaggaaagggatgttactttttgaaggagtgatgttccgtggttttaaatctcttccagcttctctaggattttgcttagtgttagtttgtcagagagctaaaaatttgaaaatgcttgcacttcctcacgttttatttaactataatttctacttttcaaatatttcttgtcttctatatctaatcaaattactttcaataagtgtatcattcatccatttattctgaggggactatgacaaatttaaattgttatgaattactcttgtaggctgtcataataacagcctgaaagtagcagcctcaagtcagcatgggacatccattccctctgcccaccatttacctgtgtcagcaaatactgtccaatttgctaatcttattaaaaagcaaacattctgtagctacttttggatgtggatatacacactggacaataatctcttaaagtttaaatgactattaaagtgactattaaagctcttgtttgtcttgcctgcactaatgggcaaatatgttttattctgttaatgcagaagatagtctgttaaagcttctgtttccaaatattcaaggacttcagttaagctgtcacttagtagcatgttctgcaacaaatgagtatcattcagtaatgttccttctgaaaatttattcaatctttgtatttattgtgtcttctgctttcatacttgggtactatgaaatatcaaagtttattaggtttaaattctaaaggaatcttcagccccactcaatgaaattcacccagcctaatttccgggatatactttttaaaggaatcttatttgttaacgtgttgttactactaacactagaagatattcgattaattgataagaagtaaatgattaaattttgtgttaaaaatatttgaaattactaatttttcatcaggctttatttgccctactaatgcatattttatgtacagaaattaattatgctttatttttgtaagtgaaaaacaagaatgtgggataaaaatttgctacttattttgtaccacctctcattagttcctctgaaagcctctgatgaaggtgacacccaggtagctgacgaacccctgacttctgtgacttccgtcaacttgtgcctaaggcttgtgtgtgtgtgtgtgtgagagagataaaataaaggtattttattttatctctgcactataaactgcactataaagtatctcaaagctgatcaaaattacttcaccttagtttgatttattatgtattgctaaaattcttaattttctaagcgtgtattttctgactttgtttcataatataagtcttttcctacctcatgtcttttaaacttaagaactaaattaaggcaaaatcatatcccattaatttgaatgtttatatagttatggaattttaagttatactgtatttactttaccttttcagagttgagaaactctgtggaacaggcttcgtgttgagatatagtgttgtctcctcagagtcactgttctggcttattcggatgtgctgacatttgtccgattgcaaagacgctgggttctccggagtttggcacgaaaacaagacagcagcactctggggattcttttcagccctttagcttccttcagcctgccttgctttgggacatgagtggtgggtataagtcagtaggggaagtgtcttctgggtgccaattttacccagtcctgaggcctggctgtcagcctgctgccctggggatcctgcagacgcctcggtgctgaggacatatggaatagtgggctgtcctgcattttcatcttgtccttgattctttctttattctagaaattacctccctgtcttatagagctgtatccagacatgaaagagggactattttctgtttgaattatttttatttagttagatagaacagattgtctaccttgatgtttgtgactttggataattatcaaaaaattagatctagcacagccagttattcttaatttggtcacttgacagttaactttttgggaattgatgctccatgaccctttctaaataatccgctgggctagctccttaagtctataaaacatacaagaaattttctgtgatttggctgtggaatctttgatcacaatgcatatttggaatgcttaaagaaactcagtgacccagactttattttcataagttaaatgatggaaccagtattcagaattcactgcctttgttatttgttgagatgaccctgtaatacttaggagttagatattaagtagtttgtggactccttgaaactaggaaccagatcttcggttttatttgaattctccttcaatgctaagccttgcatgtgatattcattaatatcatatgaataatgtcatatgctggtgtgggtcctgaaggatgaggagttactccttgcataataaaatactgagttttttttttttaaaaaaaactggtttaaataagtggtaaaattattggacatattttttgcaatagaaatgacattttgagtttctataacaaacctatgctaacaaaagtcttcaggtgacctttccaatctccaatttgtatttgaatctgcattttacctttttttctctgtctctggatgtaatccctttctgcttatttagtctttcagttttcttatgttctgatcctccgttccccacttactgtagagggttggtgggtttgtagctttttcttcttctttttttaatctgtactatattattacatctatttaaaaataaaaaagcaattggtgtagtgtcctgacatgcattttactaagagtagacatccattctagaggaacagtctgtctcgctaacaggatggttactcagacatttagggcctctttttgctatttgtagtcaatgttgaaatgattacgatgttccagtatgggacggaggaagatgagaaggcttacagtgactcacaggtctcactagaaatggtgagagtggctgaagtgacctgagtatgaagtgatatccagaccaattctagagctgtctgaaagtctgaagtagctacttgtgtatctgtaatgcagccagtcttctaaaatcatgtctattgcatgtggtgtaaccacagatctatccattggcttaatggttcaaacattttaatttcatagagaacatttgattttgaaaatgtagaataatggcctgaggcagttgccaaaatagcataaatttcctttaggcaactctcttacgttctaagggaagaatgtaagatcttttttctaatttctgtataagaattcccaaatagttgccagagctattaactatcatcactttaaatacttacatcaaaataagtataaaaggacgaaaagaaaataaatagcatggcagttgtttttcagcatgtattttaagcacatcctaatgctgctttgattatttcttaaattggaatatattctattaattaaaaacaacttttgtctgaatggattaagaaataccaagatgtttccatttttgctcgaattgatagaattttcttcctactacttggaaactatttttgaagagcctttgtgttgtcatgaattttattgattagtggaatgttcccttttttcttttttttccctagacattagctatggtactaaagatagaaaaggagaaaagtagtgcatgcttgtggcattttggcactgtagggagaatctacatcaaccaaagttgcaaatgataagaatttaattctgtcaagaattaggaagaatagaaaggtgggcctttcgtacctgccttgtggttttcccttaagtccacttctctaatgcccgcaaactaatattttttcccctctacgtgctgtcactaatcttggattaccactgacccctttctccattactgtatttcccattgttgctgggaaaaaaaaatctgttataaagttacctgtactgagcctctgtcgggggcatgctgctccaacagtttcccttgttagcagtcattctaaacttttccacaaccttccttcttccagggtcattttattcctctgtagagatgattttgctttctgctttcctaagataatctagtgtggcttcattccattattttcttctctcttccctttacaacattactatctcaggatttttttgagctattgtttcttgtctcattcactcacctttttttttcagacactgcatcctctggtttccaaagctagccctttcccttgagcctgtacatcctcctgacctcatcacctctctcctgttatgaacttagcttctttttcttacagacatgcctgcgtttcctcgaccttcaaaacaaaacccggataaaattcttcaaactttttccttttctgttcccctcagaatctagggaaattccatgtatgatcagttttcttctaaggaaatgaggaaggctgatgtgagcaccctagatttttggtcacctttccttccacctatgttttctcatcactgtggcatgactgccttctctactgcttgtaaaactgtattctgaagaaccttagaggatatttagtaagtaacataataaaatagtgccctcatcctaaacctttgttcatgtcttccttcctaaaactgatcatttcactttaaaaaaaaaacaaacaaacacatttccttttttaaaaaatttaatttcattttattttaagttctgggatacaaaaaaaaatttttttttctttactctctttttgtttcattgttacttagggactcttgttaactgtttttggtggtatacttttttcatgtctatatacttttcttcagaaactgaatgtaataattgtttaaattattagcttggtcctttttatgtcaaaaatattgaaaaattattggctatgtttttaagttcagaaaagcataagatgatcctttggagttttatatcatgcattgcactttgttcatgtgttcatttctatcactataaggatttatacccaaaccaaaaaagtttaaaataaagcacagcactgtttatttttatatgtttcactaatctgatgctaatctaatattttggtttattcatgacaaaagttaactctagtcttttcatccatatagctctttttacctagatcataacagtgggggtagggagagggcagtctgggtttcctcactctacgttttaataggaaaatctggttctgctgtgggagaacatgtaggagtcaggaggggaacatagcggtactagaagtatattttaatgttttatgctaatgtgttttacaccttagatactactcatatttaaaagtgggtattatgagaatagttttgatattttattctgaaataaactttagtggagagtgattggaaatagcactcattattgctgggttatacactgtttttggcagaggttaggaaagaatcaagttttgtctgggaaaaataatttttaaacacatgggaataagtactggttatggttacctatgtatttcatataagtggacaaatataaccatggtcacgtttccatttttatgttgtcagtggtaagagatactaataacatttttgaagaatattgatatttcaaccaaaataaattaccattctcgaatggatgacctcaattgatagatacaaattgctatcaatagtgaaaggggaggtttgaacaatataatagaacagacatctaatactgaaagtagaagttttgagaaacgtacaaagtgggttttacaatttacagctgcaaaaatgtcagatggctttggggactttcttgtgaccacaccttagaccttcgttctttagtgacaggctaaaggccacccttcctgaggagatgaacactacattgcacctccaaccctaatgtgcctaagaaatggattggaactttacaaagtttgccaatacatagcataaaccagcctttatgtgactgagagagagaattgggaagatcagttcattgggatgctaagtacagcctggttggaataagagttagaggtatattgttagagactcaaaaataaatctattatcagaactttcatttgccaagagaggaaatagaaagctattgcaaagtttttagagtgggtgaaaaatgtaaaatgtatgtacataatactgtcattcttacttgcttgtataattttttaaaagacagtgcgaactggtggaagagcagtgattgttcaaacagtaaagatgaactctatcaaaatatgctatccttttttggatggcaagtgtgattgagtagtgaagtaaggtccttggtccttcactctagtatttttaattgatcatctgtgacccaagcggaagtctaccactgagtagaaaatgcaatttccagtggcaattaagtatttctaatgccaacaattcttaaagatctaagccaaattgtgaagttggttaaatcataggctgattataatgcatttatatgttaaagatagtgaaaggaaagctttaaagtgacaaataagagagatattggagtattttttaatgatgaatttaactaacttaacatattttatagtggcattgattttacctatttaatagacacttatttttgaattcccttaaattttctgtttataacctattttcatcttgtaaatgtcaacagaaggacccagtggggtagccaagagaaaaactaaggctaaaggtattttcattttttcaaattagccttgagtgaatcaagtttaatgtttgaaaatgcatgacattttctgggaatgttaatattgctactaatgctaaacactattgcttttgggtcttgcttgggtgcaacttaggttataagtagttttatcaagatttcatcaaaggattttctgcttcaagcctataattttaagtcattatcttttcatgttatcaaagctttgtaatagtctttaaattaagaatgtatatattatacaaatatgttatatttgttatgatgtatatattaaatttacatgtacacatcttaccttgttccctaaaacctttcttactttgatttttttgaattacttttgggaaaaaaagatgaagtcttcagtaattgtttttatttctccaaaagctctcatgacactctgtcttagagcacagtgaaagctagtgtgattcaaatgtgtagttttcagtaaaatgaaaacttggatgtaaatgtataaccctacattacattgacatagaatttactgtgtttgatattttaattcattaaaaattattgtccgggcacggtggctcacgcctgtaatcccagccctttgggaagctgaggcgggtggatcacgaggtcaggaattcgagactagcctgagcaatatggtgaaaccctgtctcaactgaaaatacaaaaattggctggacttggtggcaggcacctgtaatcccacctactcaggaggctgaggcagaagaatcgcttgaacccgggaggcagaggttgcagtgagctgagattgtgccattgcactccagcctgggcaacagagtgagactctcaaaataataataataataataaataagttattatacctgtcagccatttgtagactaacagctcagtattacagcctgactttatatgccagtggttattcttgttcatatgttagtagtcatattctttgtgggtagaggcatgggggatgtgcatgcctctatataagcctgtttttctttataagcctgtgatattcttgtggtcatttcacgggcttggcatattgtttgtagtttgtttttttggtgaaatatgaacagatgagacttactatgtgattcacagggttttgtgatttatattttaagatcaggaacttttaatggtttaacctcctatctcttctgaataatttctggggatgaaaacaattttcaccatcttatttttatataaataatgatgaaacaaatggacaataaaatattttacttcttgatctagagaagcaaattaaacattaaagactgaattttttaaaagcagttttcagaataagacatgatagcattgcacatccattttacacttttgcaatgccagtatctatgttactgtccaaacgcattgaagtagaatgaagactcagcatgatcctgaatgaatactattctgtattcttaaaagactgtaataaggttttttaggaagaactgaagaatctcctggttgatcaccaggaaattcagttaatggagaaaccctatgtggtgtttttgtttgttaatcaagattttattagacagcctagaaagacatagtgcttttagtgagcactgcaaatctaatgctcattttgaataccatttgtgctatgtaagttttatgtgattttgatgggcaaaaacatctttcacattttattatattaaagaaatatttcattttctttgtttctgcttaaatgtggcattgcttctgcttaaatgtggcattgcaaacaccttaccttatgatttccttatgagagtacaaacagatgaaattcagagcttttgctaactgctttattaccatgtaaagcaagttgaaagcaataccttccatgagatttggaattagctgtgtgtttcatttaattgctctctcaacccaatgaactagaagacgtgtgttagcttgagttgctctacatgaattaacagggaaacatacttaaaggaatactgatttcatgatgaatataagcagaaagagaattctaatttttccttttaaatactacagataatgatttaaaaatgtcatacacatgacaattttttcctagttaactaataaaatgaaattatatttaattttatttacatatatttgtcttcaaagaagcacgtgtattttaaggacatatgtttttgagctaaacattttaaattatctttgtatatattcttacaaattatgaaaaatttgttcttacgttgccagtgttcctttaattatagttacaaagtgtgagttaatactttgtgcaaagcactgccttcgtggtgccctcaattttataatattgcatgttaatgttttaagacaagtcatactatatttcaagatggaaaatatgacaagcttctagcattttttaatagttgatatttgatagagatttgcacctatttttagccaccataaagactagtgaattaaagtaactttctgaatgtgcatttcctgtgtgtggagagataaaaagagaataccttttcactaacttcctgttctgtgattaagagatcctgtcaataaacattttttcctttaattggaaaatctgaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgtttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcccctcactcctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttcgagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgttttggctatctcattgatttttcctttgactgttagctcaagaattgaaacacctcaactaaaacatttaaagatcctttaaaagcacttgtagactagaacttgatttattttttcccatctctcttcttttccccttctcttttctttctttttgtaaatgtttcaactaacttttattgaagttgaagtcacactttatccaactgcgtaatatttaagcttcaactaaaaacaagctttcagtcatgattagagggttaaaatcatgcattgcactctcagttttacactttttattcagtaggttgttatttctgtattgtttgcttcatattgttttctaagtataattaaaaccagaaaggttacctttttaaataagccagctacaacgggacaaaaaattcacaatactaggtagttgggagtcagaagctgttttcgggaagacctgaaaagggaaaattaagtactaaaaatgtaagtttattttgccatacccctaacaacattttatttaaattatattgtgacttgattacaaatcttttaaatgacattattggcatatttttcttaaactttgtaagaaaaagataacatttcacattttagtagcaaaatcattgttaagagatagtcaattttgtgaaaatatttgagtgctaatcaatttttccaggatgatcttctatcctttaatatttagatacttccttttgaagcacttacatcatcatcaaatttttggtcatttgttgtgtcatctaatttctgtttcattttctaatggcttcgtatgtgaatgaattttagttattcctaacgtcattggtagccactcttttgaattttttttttaaacaagtctttcaattttattttataggtaatttgcattgtatatagatgatcgtctcaaaatttcacaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacacttccattgaaaaagaaaagaagtaaacaagtgtcatttgtaatttgaaatgttttaagttaactgtcatgttactgtccatgaaatggatctggtgacttaggctctatctcctgacattgatttctttctcctgtgtcctcaattatttcttctcctgttaatgcccactggtaataattctcaaaatcgattgctcagaatattccattgtaaaatgcaccttggaaatggttgttttcctcatttgtaaattgaagacaatgcctattcctcaaggtggttgtgagaaccagtcaatgttgcatatgtgtaaacagccagcacatggttgggcattcagtttccctttatcattggtagaataagaatagtaatactcaaccaaaacgtctcagtcaggggttaaaaacttggaagcactgaaactgtgcttcctattcctacttaggtcaacagattgcaaaacaaatatttcagtcctttatcctttgtaatgaatgtgtctttgtgaaatgagtatagtggagcctgatttattctattgagatcattgagggggcaaatgcaaataattataaatgttgcacatgagtgaagccgtaagaatgcttaatttttaaaagaatattgtgacaacctgaaaacacaagatatgaaggctagaaaaaaagttatgaaataaactatagccttaagtatatggtacaatcgagaagcctaataaccagcctaattgtgaaaaacttatgtttgttttgtattcagaacacatttttccatagatgagattttatggtcttcagagattttttttttactctggtccacaaaaattgatttaattctaatatccatttctgcaactctcattgtaactatgtttctatggaaaatgcatttatcattctgccttgggatattaggaatatatttagttttacttctgaatgttctccagaatttctttggttacatccatggtgttaaatccattcagataccttacatggacaaaaatcatggattggctcacataattgtaaagcccaggagtagttttggcttttttcttttgttatgctggatctaggtgcttgaacagtgttctcaacatccatctgtctatggaccctcaggaatgttggctttcttctcgggcagagtctcgtgtgctcatcttcaaccctactccttatggggtgggagataagaaagctgtgattggtgacaccctgggatatgtgagtgcccacttttaaactgttgggtaaagaaaaattggagtcctctaaggaagttagtgtgtttttaccagaaggaggaggaattgatgcactgaaagcaggcagatgatggagtttgtttcccctttttctacccatcccattcctacttctccccctgcccaaatacagagaggtgaatgggatgggccaaaataggtatttcaaaataagaagctgtggagctaaacattgggtactcatgggcataaagatggaaacaggagacactagaacttctagagaggggagagagggagggagacaagggttgaaaaactaactattggatactatgctcattacctgagtgatggaatcattcatattctaaatttcaatatcacgcaatatacccatgcagcaaacttgcacgtgctccttgaatctaaatagaagttgaagttatatttaaaaattaaaaaaaaaaaagctagggagaagagagagatctcattccaaacaattattggtcaacaatagttttagaccattgaaagaatataagagaatgttgacttgataataaatattgccatttagatgtcaggtgataaagtttattttgttgttaagctctctccattttgccccattcagtttaaaaggaaagtttttgtgtttaggaaactaaaggatgggtgatatgtagcagacccataaggttattttcatgaaaaacctagcttgggctaatctgaaagattcctcaataacagtctttggtgtcttatcctttcttctccatttgcctaagaatataattgtataagctggatgtttattccttggctatcgtttttacctaggaatcaatttctgcaagagctctgtaagccttacaaagcagaaagtcatccatttcttttttctttgttctcatttagtgcctcatttgatttcactttgtgtatctatttattgctccatgttaagtcaggtatgcatacatcatagaagtctgcctctcatttccatcttctttgccttatgtatcacttctcttgtgtcctattagagggagatgatctatgcttaaagctgttgggttatttttgataattatataacaccaacatgctgtgtctatagttcccatttattgattcaactaatatttctgagtatctacagcatgccgggactgggcaaggcatgggggatacaagagattgaggtggctgcaatccctccagtgaaatgctgcaaaataagcaaggggctgagagagaaagtaatgagactgaaacgattgtcagtacagcccactagtccctctgcctagaacgtgctcctgaatgtgctcctgctctgtgtggtgggctgcctttgtctctcccacgggacccagcccagtcatcacctctgcactcagacatctctgaccctcccaagtggctgcatcccacacactccagttatcgcactcatcaccttgcctcattcttggactttgctgccagactacgatttatctcgagcacctatcctagtaactgacactaataggcattcattgtttgtttattgaatggtgactatacaaaataaattatctaaaaatatttcaggtgtatatatactgttgaagaatattaggaagaagaaaaccgtgtgtgtgtgtttttgaagaacccaaaagattgttcagtaattgcagtgttttaactaccttggaagttacctgtgactggcagggaggggggtgtaaagattttttttagaagaaattaatgaaatggtaaatttttggaaaaatacttatttaaattatctcatttaattcttaaagcccttcttaggggtcctgttttgtcccctttttgcatttgtggaaaccaaaaagtgtagctgtggttaacactgagatagaattcaaatggaattcaaaggcatcctcttgtcccaggtgcctgaacttacacaccatgctgagttgcatgtccttgaactgtatttttcatgatgttaaagtgagtccactctcaccagtctttgttgagtcccttcattggtgctgaaaccaggctcttgggaaccttattggcagtgtttaattcttttgtaatttatgtctgtttgaaatctgtctgtccagcttgggttacttgaagatgctttgaatctggaatggctcttactgcatatcatggggcagctttgagtacctggtagtctcagaattttggtaagttccgagactgctgttggtatactgaggaagatctgtattcactgattacacaagccaggagcgacaacgaggattaacgtggttacctagtatgcatgcctttctggtgtattgattttccagaatatttctcaaatttcatatacctatgagccttattcttgggataaattgatttatactgctagactccttgcaattgaaacagtaccacttctgagcactcaccctgagcacagataaccatagctggagtaacctggattagtaaggacacgttttctttcatctgtacacctttgaattagtaaaccaaagattaaaacactaattttaaaaaactttttagctttttaatgggctaggtgtatgaaattgtatgaaacaaagtaagtttataattgtttcccaggttttgttgagggagtggcttgcttataactcttaggagaagtaaatcctttgtgttccctcaagtcacagcccttggatccagcatccagggcctttctgatatgcacacctctcttggtgcctcagtcacctttcttttccttggtgccaaatatgtgcccagttgaggaatttcgtacagtcacatgcctcatgctatcattttggttaaggatggactgcatgtatgatagtggtcccataagatcatagtgtcatatttatactgtaccttttctgtgtttagatacacaaacactttgtgttacaattgtctacagtattcggtacagtacgtgctgtacagttttgtagcctgggaacaataggatgttgcatacagtctaggtttgtggcaggctataccttctaagtttgcctgggcacactgcaatgttcccacagtggtaaaatttcctaatggcacatttcaacatgtatttccacacattcctcagaatgtatcgctgttgttaagcaacacatgactgaacttgcagttccctacccgaaacacacgtgtaacttacatagccacatccctgatttccttcagggtctgttcacatgttatcagtgagtccttttgccaaagtattatgaatagtccccacccccacttttccctaatgtgctccctgttctgtgtcttccccgtactatctgtccccatccaatatactctaaatagttcatgtttcttattttttaagtttctctctcccccggaaggtaggtgtgttgttttcatttactgtagaataatgccttgaattaataggtgctaaatatttgttgaacgattaaatacaacatacaatttagtaagtttacaactactgcatatttatggaaagaaatatattgattctttctcattatgggcagcagtgaataaagtaagctaatcctgggcttgggtatttgtgtcactcatatttgctatgagtggttgatttaaagtgctgatttcatttgcatttcatagcttcatctaattttaattaaaattggaggggcaattatatagtgattaaatgcaaatgttttataatttccaaatttatctgattaacctaaagaactaaaaccaaggtatgttttaagggaattaatgtgttttccaaatcatgttgtggccattgctgtggactggcagtatctattcaccatacataatgactggaaggcggctgtggacaccctgttcctcttggcagcacaggaatggaagtgggtcccagtcctgatgattaacactgaaaagggagactgctggtagcttctggaaaaaatttcctcaagcctaagaaagaagcagagcaagagatgctccttttgcttctggacatcgccttgtctgaaaaagaagcttgcagctggggagctctgattgccagcctgagggtgaagcttgacctgcgatgcagtcagccgcctccgcacttcttgtttagttagatgataaatttccttcctacccaaccattataagctggcagtttggtaactgcagccccaggaacatcgaaaccgacacatctcatgtcataacctaattttgaatatttatttcattgctacttcattgccacttgtacctcataataaatccatttttgaaaacctttcctatgactgaattgagcttatatgcatttacttttcttgattcattttcgcttgctttttccctcaaattttagaactaaaatgagcttgggtggcaaaaagttttttggaaacactgaaataaaatcttgtacggcaaattcttccatatgggttgttaaagcaattatagtctagaatgtgtttttgttaagtttcaaaaagtttatagaggtctagaggaggagatacagtaatatgatctcagcttctttgaagtttacaatttttttttgtactgatttcatatctggaaatagctatgaccaggtattaacaattttataatacaccttccactttggacagggtaaaataatcaatattttttgctctgtgcttttgctttctcctgtttttcctatgttttgcaatttcaattttagagacaaataagttcaagttggttagagaaagctgactctcaggggcattgtatgtcggaatgttggtatactagtagtatttgaacacgtagcattatgacttttcaaatgaaacttcaaaactcattaagaatggggttttcaggcagtttagatctttatcgtttggtgagaaaacatttcattgcttgtataacacacggaacacagtttgagagcctgctaaagtggggtcagtgaaggatgaccctgtaatttttcattcagacagatagttttgagagtgaaataatctcaggacagcagacataaactgggagtgtctcaggcaaactagacttatgacactgaaatggtggatgctggagcagaaatacggatctctggtacataggagtagagaagtactaatgtgagtccccttccctcttctactcagctactggagtgcacctaagaagccctggccctgcagggaatctccacagccatttagacttagcagagtagtcacaccactgggtgtattcagcccttcaacaagtgttcattgagcaattgctatgtgccaagtgttagctgaggtgctgagagtgcaaagataaattacttgattcttgagattcttaagctttttcccattcattcagcagaacttggcaatgaatcattccatacctgttccattaacagttgagggatgtaaaaatgattatttaaatggtaaaagggagggcagccctaaatttgaatttgaaatgtgatgtcttttactaggccttcatctctaccccctcctccctgaacttgaactacaattaggacctgtgtataatccctttgcagcctgtcttacagttagaggtaacttaggtatagaacacaactgtatgtgttggtgtcaggtgtactagtggtgagttttgtgtggaaatagtgttgcaaatggtaactagaggaaatgtaagtgatgtggcagggtcctgtgtatctgtctctgtttcttttaagatttgggaagaggaatgtgggagtatgtttttgtccataaaagaaacatgaagagacataggaaaaataataaaaaagaagagtaatacatcgaaatgaaaattttccagaccacattagtgtgcatacatgagctgcacagagctgcttaagattagaatactgcccttcacatcaccttgaccttcctgccgcaggctgtccatgcacagtgactactcttggtaggagattcttaatgaggtcaggaggagtccaggatcagcaaacggaatctttgaactcttgaatttagctgttttctaaatacttggatttaattgaggacctattttaatgttccacatacaaaatatcaaataacttcaaataactaagttaatataatagattttagactggccttgactttaaaatcagtttcatgttaacataccctgctgtcttattaggacttgtaaaagggagaagaacttttaaattttcatatgttttagctgttatagaataatatgattacttgtaggggtttcctttagatgataataaatagttatgtatgatttctttttctttttaactgtttttcaagtagaataaataattatataagtgaaaacatcgagtgtacctgaataacagaaaattcaagtgcattttagttgcctcattgctgaattcaaactgcaggacttaggaattaatcgcttatgaaaacaaaaggagcttgaactcatattgaacttttggcaggtttagacatgactgttttagagattcatgaacatttaaacaatgattttgttttaatttgaagtgaaaagctaactaagacaaagagatatattcaaggctcatgtgaagttgaagagcaaactgttttcctacctcactttttaagcatacaattttagaaactattaattagcagcactattaattaaatgtttgaaaatattatttttcctggtttaatgtgacagaaaaccccacaaaaactcaagttaactttgtgaataaaaaaatgcaggacttaaagagagatctacttcagagccagcagtcccgccagaagaggctgagccacacactgagcccgaggagcaggttcctgtggaggcaggtaagcttgtcctcatcctcgagtctcgcccaggtgtgccagagcctgacaggtatccgcatttacagaatcacgttttacctggaatttgtttcacatcatttacagaataattaactactttttttctcttctgaaattatgtagtatttttctagtagaaattggaacaggataattttaatttttaagatcagctctaaggcagacagttgttctttgtccaaaaccacacatttaggaacgtcatgaactgaatgttgtttcttgattccaattccagcactactgtactatattaccttgaaagtaaaaatacacacaattctacactactagtgttatcatttgtcacgtgatttaatagagtagatctagtggtttctcagtcttttttacatgagggtctcgtttattttaaaagacttcccaaacctccctgtgggcatctatggagcctgttttgtgtccacatgggttcataaatcaagcatctctgtagttaccccaaagcctatgactataggtaggaaagtcgtgaaatattttaataagttagtaaatctaatacagtctctaaatctctggttttcttatgccacctattgaaagtttaaggaatgacactacatatttactgaaaacttaagtactgaatccaaatggtactttggctgattttttcactgtgtgctgaggaataatatttgattttttttcctttaaggccaatatgttgctctgagttttgttatttgttgaatttttaatcctaggacaatgtattctctctcattcctgtagaattgctatgatcataccatagctccagaatagatagtaacttttaaaaagttttataatttaatgtgtgtttggatttagcacctcaaattttactttgtactaaaataaaacccctcttgacccccacatttcttttttctgccatctaatccctctcccctctacaacagccacgattttgaaagaagaatccactattacttttttaccttatttttcattcattttttttaacccattacactccagcttctgcatcttccaatcccctccagaggagagaaggagtatttgcaaaattatggaaagttgaaatggcatggagtcctcactaagttcaaagccagtgctggtagcagatgattctggagaagtgtgtgaggactcagttgtggaggtattatattctgctcctaggaactgagactttcaccagtttgggcaaagatagccattaaagagtgagcagagtgcaccaccctccacttctagtaactcagattatattctctttggatggtgatttcagcagttatgaacctgggaatccagttaggaagctatcttaggctttgtgagagaggatggcgattggcagactctataatagcacaagactacatatataaatggcttgtgaaatataaacatttattaaaaataggcatttttatgctttggaaatgattttgtagtgtgattagcatagtagatattacatttaaactcttttccttcctgaagtctaaattaactttctattttttgtcatggaagattagctctttgacaacaaccgatgtcactggcattatctcacatgacagcatttatgataccaagtgtagtgctacttctattcactgaacatagattatatttattagagaacttagtatcaatgtagttatagcttcttgttcattgtgtgatgttgcagttaagtctaataatctgataagcaccacagtgtttttggaatgtcatcatttatgttcacttttgtaattcaatttatttgaatttatggatctcagtgtcagatgtggttctccaaagctgaaaggattgtcagttacaatgtaaggttttctactgacacttcctgacaaacctgagtgagagcagtcggctacctctgagtattcagtcctctcacctgcaggagtgccctttctcctctcagggaagataggtaatggttgaccagatacttcaatctgtattgaccttgtcttccacatttctgtctttatttccaactatttccctttatgaaagctttgttcttcccactttattttatcattattgcgaattttattaattagaaacaagtcattttgcttttaataaggctcttttttaaatacaaatctgagcctgagttttctttaaaaatcttattgaaagtattttaatgcttaagtctgttgacagaataaaacaaattttacatatctaccatgtttgccaacacagaacaaaaaaatgtaagctgatagagaaggcatgcagagttgcttagtcaaatatattcattttaatgtgtatgtaccaatgtcatatttgagtgttaggggtccatgttgatgtttgagcttttctacttagctatgttttgcaattattttagaaccccagaatatcgaagatgaagcaaaagaacaaattcagtcccttctccatgaaatggtacacgcagaacatggtatgaattaaaatctgctctttgttttgagttactaaaataacgcttagttatgtaaaatgacttggacatttgttttaaaatttaaaggttaattgggtgtttgtgttttttaaaaagtttttgaattcaaagttagatagcaggtgttgtttttgaaatagcactaaacttactttattctacttcaccgtggaggaactcactgcatacatctaagagagaactggtgggaataaatgagaatgaacagattgaaaacagtgatccatcaggaacagaaggggaggatggagaggaggaaagtgggacacaggcccacggtcgggttcatccaggtgttgtgctccacctcgattttgcttcatggttggctggtcaccacaacaaaaatgatgacacttttaattacataggttgcactaagcagacaggaaaaaaaacgtgagaatgcaaaacattttcccagtacttaaatttaaaaatttttcatggggagctctgtgtagaggatactaagtaataacccaggaactaacgttttaaggttttataaggctgcttcttgaagcatcccttgataaaaacagagatcgtgatcccaaaacgtatctcatgaagggattgtggagtgggcaggatgttctggaatcctgattctcctgatgctttggtgtgatccaagggtggcctaaaggaaaataaaattacgtttcttaaaaacaaacaatgccctgtagtttaaactgttttttgccagtggatgctaggggtgtaggagcctgtatgcctttatttctagcttctttgcagctcggaaagccactcatgggcctatatgagcaagtgcaggcttccccttcctcaagccttccttccccacggcaccccaactttaacttaacagaaggaaaatccaatctaaataaataagtgatttaaatataatggggtaagtgctgtcatggtaataaaatatgggaagctcttcaggtcttactcagaaggggggtcagaagaggctggtgtagaccttcaccaggccagtgctggtggtgagtgttttaagcagaaggcatatcccagagacaggaaaggacctgaaagtagttcagaatggctggcacgtggaatatgtaggtggagagtcatgagaaaaaggatattttttacttgattctaagagtaactgaagccattggggaaggtatttaggagtgttgtgccttctgtctgtagcatgaaaaatgcatggggggatgcaagagtgcagctgggagattagatggaggttgtgcaggtaacagtgattcaggatggtagcaaacttgcctcagccaaaggaggggatggagagaaatagaaagaaccctaagatgtttaggtggtggggggtgggcaggcagccaaaagagggaagtagtcaagtctagcaccgtgttctggccacagcctccttcttggacttgttcttttctttaatcacatttagaaaatcacatttatggcccatggttataaatattctttgtatgttgataacttttaaatatatagctgcagccctcattgctcatctaaactccaggtttacctaactgcatacttggcatctccatttggatgtcttatgggtgtttcagacttaaagaactcatgattcttcccacaccccatagctcctcctcaccccagttctccccagattgcttatgctagtcttttatattttagttaatggtcctcctaccctcttacttgcttaacttgaaaactcgagagttttctttgatttttcttctcccctcacatctaatccatcagcaaatcctgtcagcattgccccagcactgattttggctctctagggcctcggtgtgaccgtggcttcttgccatgactgttgcagtagcacagtagcatccagctgggtctccctgtttccatacttgctcctctataacctgtgcttaatgtggcccagccagttgtgccttgtctgatcccagcctctttttccccttcagtgacttttctctagcccagctgacctctcttttccttgtaattgccaagcctatcactgctttagcacccctgcacctggtatatcttttgctgagatgtgtttcccaccccgcccaatcacatctttcagactgagcataacctccctgcccccatcatggtgcattcacaactggattcaggtcctgtatctgccattgattagccatgtggctttagcacagtttttcaagttcttcatctttcaaagtaggataccagtacctgcttcacagggaggatataacagctgcagagggcttggccatgcctagagtctcatgaccccttaggaaatttttcatgatgagactcaaagatagtgttcaatgttagactggtttcgctacagaaaacaggaatacttccactgaacaaccgcatacgaaagctaaatcctgctagtgtaaaaatcatcagatttcactggatagaatgaaagaagaataaggaaagaggaatatgataaaaataaaaagagaagtaaaatttgtagcagaaattcaaattggtgatttgctgaatagcagaaaatctaaaatgaggaaaaacagtattgcaagctatgaggagaagatagaaaacaaatagcatcaacataaataggcctgcctgattctctaacacctgagagcattgccttgccacgctaaagggagagtaactaaggaaggcttcttgcagtctgggctggggttgtggggtagggggattcagtagcagtacaaatgacaatgttgttattactgtaataatggtgataatgacacctaaatacttagggccaggcatttttctaagtgttttaatcttcataacaatgttacaaatagatattattcccattttatgggagggaaatctgtggcacagggtagttaagtaatttgcccacagtcacccagctggtatggaagagcctgaatctacagccatgcatccggaccccatactcgtcctaatccctgagctgcactgcaaagccaagtcctgcccattcactttctttagagtattatacacaggagatactctgctggaagccaggtcaagttacattgggatgcaatacccagtcttaaccatgttgcagtggaatcatgcaacatgtccaacctctacacaaaagaagcagagcagttcaatatatcatagaagttaatcacagaagagaaagtgggcatctttgcataacttgaagcctaataggaacatttgaatgcatagtatgattcaggtaaacctgtgacctagcatataatttatttttatttatttttaatttaatttaatttatttatttatttattttgagacagagtctcactgtgtcacccaggctggagtgcagtggcaccatcttggctaactgcaacttctgccccccaggttcaagcgattctcctgcctcagcctcccaagtagctgggactacaggcacgtgccaccatgcatgactaatttttgtatttttagtagagatggggttttaccatgttggccaggctggtcttgaactcctgacctcaagtgatctgcctgcctcagcctcccaaagtgctgggattataggcgtgagctgccatgcctggccctagcatataatttagataggtggctagtcactctttgctatagaatatttgaatagtcatttaaagttgttacctggaattctatgtcaattcccaggaaaaggccatagagtagccttttctttgacctgaggataattgaagaggcaaatatattagtaataattatgaattcatttattcattcatcaaatatttattgagtgcttcctttagctagacatggccctaggtgactgggaatatataatggataaaatatataagcttcctgtcctgatgtgtaacatcctaatgagaggaaacctgtcccccaccacatatacttaggcagattagcacttggccagaggaagaaaatagctgtggagtggacaatggtgtcttcagcggccgaaaggaggggcaggggaagccccagcagcaggagcaggtgtgtggcagcccttcacaaggggctttcatgtctcagttgtatgttgccagtgtcactttgttcattgtcatagttgagggagaagacttgcaacaagaagatggacccacaggagaaccacaacaagaggatgatgagtttcttatggcgactgatgtagatgatagatttgagaccctggaacctgaagtatctcatgaaggtagaacacttttttttcaagttttaggataaaatataatcaatgacttctaattactgaagtttttcttaaacccctttaaaactgatatttaacttttgcttagatttttaaaagttgaagcttaaagcttcaattaaagcaaattttttcttaaaatagataccttgattttggttcaaagcacttttcagggaaactcagaatatacaaatttcttataaatagtgagtcaaatacttgaggaaactagttttactatattcttctgcttagggtgctatttgttaaataaaattcaaacaactgatgaaatattggacttgataatctatcacaggctcatgttcacacatgaactctgtaattacagtgagcaaaacacaattcttagcttctgtaccaggcattggcaaacttttttttgtaaatagccagagagtaaatatttcaggttttctggatcgtacagactctgttcagctactcaactctgccatcacagcgtaaaagcagcctttgatagttcctaagtgggtcagtgtagctgtgtttttatacaacttatttgtaaaatcctacccaacatggctggtaagtgcagcggcttgaacacagctcactccagccttgacctcccatgctcaagcagtcctctcacctcagcctctcaagtagctggaaccacaggcatatgctaccatgccctgccaatttttaaattttttatagtggcaaggtctccttatgttgcccaagctggtctcaaactcctggcctcaagcaattctcctgcctcagctttccaaagtgttgggattgcaggcatgagccattgtgtgtccagttagcaaacactttttaaaagcataaaaatgaaaagtagtttatctactttgcacaatactaaatattttggaaaattactttagcagcaggtagctcctactttatgagtacatgtatttccaaaaacttatatccatgcctattgtttagaacaggaaatgcactttcccataaaaatatgggatggtttggttttcaaaagaattgtatataatgcataattttctgtgaaaaatacaagcacacaatccttttgaacatctatatgatttatttttgctgcattacacattgaaaataagcacttatagactaccttcagaactttatgcctttagtaatcatttatgtcatgatttctttgggacaaggtttccagtttctgagtagggatactgataaaatgatttccacatttcctgttgcttcttctctccagtctttggcctaaatggctcagtaagattgacagttgctcagaatttttctatctacatgctgcttatacaacaaatttcagttaagatgctgaaataaacagaagcatgaggaatttgatattcttaaagttaggagtcacagattgggagtaggaagaaacacttttaagaagttcacaaattgcagaaaccttactttctgatctcatctttaattaggacatagatgcagtttgaacttaaaagttggttgttaaaagtcttcagaaaataaaaatatttattctttatatatgcattaaataaaattagcaaggtcataagtgtggtgacggacagatagctcttctgctatctggggtgtatgggttaagtgttcaacacatttacccttcagctccctaagggtataaagcctcttcagctgtttttctctgttcccatccatagttgctgtactttcgctctagaaaatggtaggacaggtcgaggagatagcacattctagtgggttgtgaagtggattagaaatgaacggctttcctggtctggcctgtgtcactctaagttgtcctctctctttagtccagggggtggtggttgtcagccttgtggggatgagtggactgagaaggagaatgtgtgagacatcccacagtgtacttctagtgaaatataaaagtgttaagcagacttttaattgatagtcccattttttaattttttaaataaaattaatgataagcatagattcagagtacatatacgggatatatacataccattttgtaaaagcagtaaatatcaatctaatttttttttttccagaaaccgagcatagttaccacgtggaagagacaggtgagattttaatttaattctgttcttaattagagtgagtcttcctttaaaagggcatcataaaatacataatatctattattaatgatatatttaaattaatatatgcaagatatgcaattaataattttattacgtcttatatttatggtatttctttgtgaatatacttttttgtgttttgatgcctagttcctgaggataaattttcagtaggattactagttcaaaagatacaattgaattgcatgttttgtacctttcaattacagagtcaacgaaaggtctaaatcatgttttgtcacatgccagcgcccttaaagggcatggccacaggaggtgggcgcatcatctgtcagcactttactgttttgcggtttgagtgtaaaccagttgatgacaggccccccttactcatctttgcatttggcatttaacacacttaatacctatttgtttcaggagtgaacatgtttgaatatcattatgacttgattttgcatttcaatcataactagaaattgtgtctttctggtttcgaatattacatgtattccttatttgagacgtaatttcctaattattccataatttatagtttcacaagactgtaatcaggatatggaagagatgatgtctgagcaggaaaatccaggtttgtaaatgttaaaattattgatatgtgttttctgattgaggcagtggccaaggccgttttattccagggttaacaattgtgattcaacacagagatccctgtatggtatttataatcacttttgattggtcagatgtttatagaaatgtctgaatatagtttaatactacatagagggatgagagaaaaaggagacgtatttttcaaaccactgttgagactttggtctttgtaggtaaggtgctggaaagaatatttgaaaattgaaggggcagtatgatgtactataaagtcattctgggtacaaatcccatttctactctttcctatctttttgacttaggcatcaaattgtggaacgttattcagcttaaattttattaaatgataatgaaaacatctatctggcaaagttgtgaagataattaatttatgaatctcctagaatgctgtctggcaatgtgtttggttttttcctgtttggcaaaggtgtgtttttgttttttagattccagtgaaccagtagtagaagatgaaagattgcaccatgatacaggtattagatgagcattttcattagatttaaaatattaccttagatttttcaatcacatgctgtgtttacatggtgatttttcttttaaaggcatcaaagaagtaatttcgacatctaatgcatgagattttgttttataacaaagttagactgttataagaatatcaggctttcatatttcacctcatcaactaaccattccataacaaaacaggatgtcaaattttaatgctgtttttgtgtatcaaattcctctgtgccaatttgagaaattttaatgaaaataatttacctgccttttaattgcttttgggcagaggcatttattattgactgagcagacattaatatttgaaggagtagagttctgtgtttacgattaagtagtattttgttttaactgaacaattgtatagaatgactcagttaatacttattttgcttttattctcttttttttttcagatgatgtaacataccaagtctatgaggaacaaggtttgcaaatgctttcttttttttttttttctttttttttttgagatggagtttcgctcttgttgcccaggctgcagtgcagtggcacaatcttggcccactacaacctccgcctcctgggtacaagcgattctcttgcctcagcctcctgagtagctgggattacaggcatgtgccaccacgcttagctaattttgtatttttagtattttagggtttatctcaaactcccgatctcaggtgatcctcccgccttggcctcccaaagtgctaggactacaggcatgagccactgcgcccggcctgcaaatgctttctaaccttaagccaccttcttgttttaaaatatacctatagtttgactacaagatgtggaacattatgctttaaactataaactttgcaacttaaaacatccagatgaacggtagcgttcaaagaattcacttggggagactgtttacccattccacggcttctgccattgcctaaataatttcttaaactctttacaagttgccttaggaggcagttacagtcattcaagaaaaccaatctcagtactttatagttgtgtctcttttgactaaaatatgcatgaacaactactttagccggagttaaattgctctagctgcttctacaggttaatcccactctcaaagatgactgatttgtcaccttggggaaggttaagaagcactgtgttccaggcttaaaggcagtatggagaaaacagttctggcaaatttgtggcatcagcagcatctgattcagtttaggcctgtacctccctcctcttgtgtccaagcattgcatagactattgtgttgaactccatgaagtagattttattttccctgcttcccagaggacagaaataaggttctgacattataaataagctgcccaagaatgtatggctaagaagtaatagaaccaataatatatcctttttattccattatcctcaaagatgattatgtagaaagagagaagtcagttgggtataactttatgtgtaaagcaagaacgatgaagaaatacatcgtaattgagttggtggatatggaggactttctatgttctagatggttttagggcctggaattcaattatgagtaacatagggtccctcctttcaaggagtttacagtgtcatgatagatagtgaatcacaattgaagaaaattaggagtgtttataaatatgaatcatatttatatgatgatttaagatttgagaccctaccaagttcatcatctatagtggctatttctaatgggatatgaatgacaccatgggaaaaatcctaggttgtgtctttaaggtactgataatttttatgaaaagttaaagaatttggacctgatgtgttcacaggaagatttggggccgagggaaggttggggaataatttggtcttgagattgcacttagattttctttccaatcttgaatttgaaggagaaaataggaatttataaatacaagttgcatgtaatgatgggatttgagatattttcctcatttctactgatcattataatgtttttaaaaatataaagaacatgtttggaatgcaatttgaagactaaatctagaggaatttaaattcaaactcataagaagtataaaattagataccatgcgaaaagaatgttatatgttttcatagggcagagtatcataataaatgtaatttaaaatgttagcaaaaggcagtaaatataacctaagagattgacatgatttggtaagctactttggatttctttgttatatagaacataaactgtttcaaacaaatagatctaattgaacagtgtattattcactatatgctaaaacaatacctttgtgaaaattcaggaatcagagcagagaaaccaagtaactgacatgtaagtgaagctgtaagtagggtgaaaacaaaaccacatttcaatgggagaatagaatatattctgtatgaaacttgcaaaccccagaacatacacttcgatagaactatagtaggaaccagcttctacatcaaagataacctagaaatcatcatgcctacattggacaaacctgggaagtgacagtatggccttaccatgtaattgacttatttattcatacactgtttagtgtcttcggtctgaaacacaggacactggagcagttctagtgaagaacacccatggttcctgttctcatggatcttatattttagtagggtagtagaaattaaacaagcaatttcactgtagttttcatttccagttgtgataagtgctaggaagaacaagtacagtggtaacaagaatatgtaatcaagagaccttacctagtttgtggatgaggcagggccttcctgaagtttgagctgaaggtgagaacaattgacaaggcaaggagaaaggtgactggagagtcgtatgaggtctctgacgtgaacttgcaagagtaaggctgaggtggtgaaatgggctgggttcagaggatgcctgtgagcaagatcaaggacgttcatcttcacctttgagcactgccaagtcagatctgcattttgaaaagattgatcggtctggcatgcaacaaacagactggagagacaagagtcaatacagggagaacagttaagttagctgtaatcatccaaattgggtctttccgtgcatcacatctctctctgtctgaaggaaccaaaggagatgagtttcaagaaagggatgttcagtggtgccctgcgctactgagaaccatgtgagatgagtgctgaaaacctgccctgatctggcgctgcagtggcctcaacgggtgactttagctggaactgtttcagtggacggataggacagatatgatagtttaaaccaagggtggtggcaatgatggaggagggaagtgggcaaagttgagaaatgcttagaaggtaaaattggcaggtcttcatgcatgggtgtagctggggggagacaacaaggtgccaagagccacatacactcttctgcttctgcagcctggtgacagggggtgctcttttcctaacgtgggagagactggagtcaagcacggggcaggggctcatgagtccagttctttacatgatgatagtgagatttctttgaggcatctgagaggagagatcaaatgagccatttggtggtgtttgactctcagaagagaagtctacttcgtgattgtgagtgtgggaaccatcagagtagttacgtggtcatcaggaccaagctctgagatcccttaaggagagcagattgagggagacatgaggtggttctatggctggactttgaagaaagccagcatttaaggacggctaagaaaaagatgaagtgaaaaagaagattgagtgggagaaacgaaaaaccaaaggggagagtatggtcaccctgaagtccaggggcaacagtgtttggagaagaatggtgttgctaaaaatatagcgagggctggcgagtgtccatcatatcaaatgaggcactggagggggtctcagcaggagccttttcagggatggggtcagggtctgaagacaggcgggagtgagttgaggggagaggaagagatgagccatgagatgtaaatgactgaagaaattagattgttcaatggaagaaagagagggtgacgagaagcaagcttaagaaagagtggtattgcatttttaagttcttagaagcttgagcatgtttaaatgctgacactgctcagggcaacagagtgagcacacattcactgctccttcatctttcaaatgccccaaaaggacaaaacgacctattaaacattgttccctgctgtaccccaatactgagagtgtctgaaagatagtaggtgctcaataatttttctttattaaatgaataagaaagaataaacttacaaccatgctgggaaaaagaaggatgttttcttgtagtgtgccagaaaattggaggtattttggaagatcaggttgactgaggaagctttgagccactgggccctggagaggcctgtgtggagatgagacttccttgcagcagagcagagaagaagcactgagcctcatgccagcaaatgagggaggcaagggcagcacgccctaattagggtggggaacgcttcattctcaggggctggcggcagaggtgtttggccccaggttagaggtctgagaattgtttcctaaacaaagcagggaatctgcccatgaacaccaggatccagttgattcccagggtacagcttcggctaattcaaaacctccaccacagacatgaagaaaattttaaaaaggtagtaaaattttaaaaaggtagtaaaaagtggctgccctggaattagaatccaggcctgttttaccctagaccaaactcttctccaccctactctctagtcggctgtttcccagtgactgaaccttgcaggttcaaagatgcataaggcattgtctctgcccttaaagcatgttgtcagtttttgtgttacaatgaaagttacgggattttgtttctgtttttttttttttagcagtatatgaacctctagaaaatgaagggatagaaatcacaggtaagttttttctgtaagcacatattttctgcaagtcagctttccctgtattttgttaaaactcctacctgtggaacaaagagtcagtgtagaaaaaatgcaagacattttcaagtcagtaagaaaataattgagtatcaaaattaaagttaatattctaatataaatactctgcagaagacccagtttaaaaagagtcaaatttagcaatctgagtggacacgagttaatttaggaatctgaatgaaggcgagtgaatgtaagatgtgtcactggtcagcaacatgtaatggattctgattttattctttattttagaagtaactgctccccctgaggataatcctgtagaagattcacaggtaattgtagaaggtaagataaatttatggaagtggttttaccttccatatgagaattgtgtttgtttattcagttatttatcgaacatttcctacttgctgtctatacagtgcataggagctaggagtacaagagggaagaaaacacagagtcctcttttcattggggctggcattccagtggccaaacagataataaataacggaattaaggattatgagaagtacaatgatagtgataaaaacaggctactgtaacagcaaacaattgatgagggtgtggagggctaccctgagtagcagcaggttaccacccctgaggggtgatctggtgagaagggcatagctatgggcagagacgggttgaaagatgggtctttatgtcatgactcacctgggaaaacaaaacaaatttttttttttttggtggtggagaactgaagggatggtttctgaaaaacaaaaataattgcatgtattaaacagtggcgcttcaatagaacttagatttaaatacagttcttagttagcattttacagttatttcacatatattatttcagttgctcctcgtagtaggcactgagaaacagggagcgtggagatctttgtacttattttgcaaatgaagacctgaagctggagtgaggtcaggtgactggctagccctaggtttcatagctgtaagtgaccaaggggatattcgacccaagactgggacctgtgggtgactctgcgtgggggtgtgaaggtgtgagggaatggggtctctgctttaacaaccataagttgccagggggagcatgtaagagggagaattttgctcttacaattactcttaaaatttaggagcagctaattgtcacctttcagattaaatgttactgcttttgagcttggttaggcagaaaggaaaatggaatggtgcagttgactgaaatggggggagataggtataagggaatcggggaggctaaaattgctgtctgtgtccgcttagctgctgcgagagacccctgtacaggcactctgggcccttgtgtaaaggcaggatccatctctgtgtggcaaggctgaattgagttgagattttttcccaccttgtgttactcagttctctatgagggatattaatgttctgaagaatattactgagtctatatgtttatttggtgagaatcagaagatggaaacccataatctctgggcagaactttctccaacctaccctacatacggtttatagaaaagaactatgcaatttgaccctacctttcttggtttagaaatagttttttcctaagacttttcagtattttgatatgttgacagaggacatagcagaggctgctaagggagtttcctgtcctgggcagtgaggcacctggctatgcacctgccacccatcctgcagcttctgtgctgggctcctgtagtgcctgagtggacagtgaggggagcttatctctcacagcaaccaaccttgttttccctgtctcctcttctcttggccggttgtatcaatatatacttggattcccagaccagaaacatggaactcgtttttgagtcctctctccctctgtctctatagctaatcccaagacctgttaatagactccctaaacatttcttaaatccatttttttctccatagctcttgtatagccccttgtctggctcagccctttctcatcttcctagataatagcagtagtctgctagctagacatcttgattctgttcttgtcccctccaaacccatctttcacatactgttaggatgatctgtccaaaagtatagctctcattgtatcagccctgtgtttaaacccttctgttattctccatctgtgtcagtaaagttactttcagttgcagataatagaaaacgaaactcaaactggcttaagcaataaagagataggtacagatcagtcagggccttgcaaggcctactaaggctttttggattatattctaggcacagtgtgaattatgaaaattcttaagatatagcataatctgatttttgttttagatgtgaaagtgaattactttcactagattgaatggagcaagaacggaagcagagcgaaacaccctgttaggaaaatattgtgtactaatccaaggaagtgattgtggtagcctgaaataagatcatggcagtgggaatggaggggaaagtgttgaactcgagatatattttagaattaaaattaattgaccttcctgatggttgtgaagcaaagatgaggaataaagggggtcttttatttggtttcagtaactattagatgatggggccatttatagagaagaaaactattattagaatgtattaggttggtgcaaaagtaatagcaaaacccacaattacttttgcaccaaccttatagaagaaactggtttaggagagaaaataaaacgccccagatcagacattttaactctgggagttatgtgatatatccaagtgaaagtatcaagtggggggttgaatatgccaacctgagctagttgggtgagttttaagatgaatataaacatttgggagccattgtcgtagagatggtattaaatccatggaaactgatgtgatcattttggaagcaagtggagagacgataaagaggcatgcccaggactgagctctaagaatctaatattgtgaggttgggtggaaggtgaacagccattgtgtgaggaggaaagccagtggagaagtagagaagggaaaatgtgaatatgtttcatgttgttgttgagtggcccaggaatttcaggactgagaagttatcagttgcatttggccacgtagagattgtgagtgatcttaccaaaagccatttgagtaaattaggggaagagaaagccatacagaatgaagtgggttcaaaaagacctggagtaaggaaaagtaggctataaaataggtaacccagattgtgctgatagaattaattcacggtttactttttagaaatcatgttattacatcatataccagaagaaatttcatatgagtttgttgaatgtatattttttgtaataaatttagatgaaaatttaacttgcaataataataaggctttcttagtataacatcagtgttggaaataacaaaagcagcaactaatactttatgatgtacaatattttgagcgtagaataacaaaagtaaaagaaattctgagaaaaatattggcaaagttgataaagtgttaatatgtctccaaataattaagaacaaaataaacaggcaaacctattaaaagccagtcacaacatagctattcaatagtcactgtactgctgttataagaagaaaatattgccagatactaacagtggttagtgggaatgggtgtgatttttgttgctgttttcaattacttttatgtgaaatatttccaaatattctgttttgagcatgtgtcattttttataattagaagcaaattaatgcaagaagaaaaattattaaaatagctccataagtgttttctgttttagaaaatactgttaaaaaaatctttcttttggccaaagattgttaacaattcttaaggaccaaaaggaatgttgatataatcttatctctaggttaaggtaatgttaaatgggttgctaggtttgaagatattaatatgtgatgtaatttcatggagcaaatcagatcactatgtctttaaatcactgggtggggacatctaccatctctttaattgtaactgggttgaagcaaccaaggaaaaagacaggatattaaacattcacatccatatctttgactagtctcagaatatattatctggaatattagttttctaaaacaacttcatgaaggatagtgtttgatgttaaagaagaaataagatactttaagtgtctttccacagctctcttatcaaatctgatgcaaaattgtggtgaaagcataagttttagtccatagctcctttgctgggcagtggagtttgaggttagtcgggcaggtactataaaacctgctgtgctgaaccgttgagaaatacacaacattttgctaagttgtagctgatcattctttgttgtgagggtatagaagcctaatgtttttattaaaatttcaattgaattgtttaaaaaatctatgaaaagtatcatcattacttaaatctggcaacgcatattttaaacactgatcagcaatatgtaacagattataactttattatttattttagaagtaagcatttttcctgtggaagaacagcaggaagtaccaccaggtatgacattttgtatgttgtattttcctcttttgttatccttaaaaatcctgttaatattaccaatagctttataatgaatctacgaaggataaaaattttgagagagattaactgtaccttaatttagaatttttctgttttgatcagttcaaccaaagtaatggaaaatgcacatcagattcagtgcagtacatatctgctgagctagaatttgaggagcattaatgatcatatgattttgccattatagatggtggtagtagtggaagttagagtttttttgttttcctctttgattgacaggctatttgatggagaatatggaatcagaattgccttgggatgaaagttgaatagtgtataaattgtgacattactcctcttcctctccattccccatctctcctgagagcatctttagtgctttgtgacagtccaggctgcccagtgcttgtcagtgtcccagggtgtttccttttagttcactgcattacatacttttccctgttttttcctactttcctctacctgagccctcttgtcaccagttaatataaagaatggtaacagcatttccaccaaagcctatgctttcaaatgcattttagagatggcataaactatacctgcaaccagaagtgagtttataaacctcgtactctcatagtgggaaagaatgttctatcaaacaggatttggaaaatcctacctctttcccaagtgtatttcttctcatttctgcattttatttttgtgtcatatttatttgttcaacctttacttatattttctacattttaacatgaattttgtagcagtgatgtgcattcctattactgattttggtagaactaattgtgcctgccaaaatttattaaatactaaatttcaattttctttctttaatgataaaaaaggataaaataatcaaagaatatatttagttatatgtgggatgccttaggttttgatagttgtcctgccatgtacattaataataattatctgcagaaacaaatatttgattaagagaatggaattgttggtattataatatgaatgagaaaagcagtccatggagaaattgaccttttacatgatgactactaggcagtgtgtatttgtgtttaaaatacttggacagggcaagggcagctgatatttatgtccttctgctggtttccttttcatttttgaatactgcttcacagagtaccctgtttgtatcaaagaggcaggaccagttacagaattagcattttgatgactattccatgacttaacagaaaattattttatattcctaaaaataatgtttgtacaaattaatatatttctagttatagttcatattttaaaatactgatctaatttttgtgaagatatgaaagataatatttttcagaccaaaaatttctatacttttaacattttataactgaacccaatagtttatttggaatgtaaatatgaaacaccaagtttctgaggtgatggaataaggtgcttttttagatttttaagaaccaaagcacatacaaatgaagatctgattaatatgcatagttcccgacctataataagctcccagtaagttttggctatgactattgtttagtaattaattagcctgatcttagaggtagatcaagatctacctctgtgatggatgtgagggccatctggctgtgacatctgtcaccccattgatcatcagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatcaagagaagctacattctgaaagacctcatggagaagttgtaacctgtaacttggtaccataaaaatttgaatgatccactgcattgttgtagtttgaccctgccagaagaggatgtaaggctgagagtcagcaatacagtcatgtgtcacttaatgacaaggctacagactgagagtgtgtcgttaggtgactttgtccacgtatgaacatcatagagtagcctactacacatctaggctatatggtacagcatattgcttatagactacaaacctgtacagcatgttactgtactgaataccataggcagttataatgcaatggtatatatttgtgtatgaaaacatacctaaacgtagacaaagtatggtaaaaatatggtatagaaaattaaataaaaagatatacctgtatagggcacttcatgagtagagcttacagcactggaatttgctctgagtgaatcagcaagtgagtggtgagtgaatgtgaaagcctaggacattactgtaccctactgtagattttataaacactgtacacttgggctacagtaaatttattaaaatttttctttaataattaaccttggtttactgtaatttttttaaatttgtaaacctaatttttaaaaactttttgatgattttgtaataaaaattagtttaaaacacaaacatatcatatagccatacaaaaatgttcttatatccttattttataagcatttttattttcaatttttttaactttttaaacttttttgtaaaaaactaagacacagacagacatattagcttaggcctgcaggatcatcaatatcactgtcttccaccgccacatcttgtcccattgaaaggtcttcatgtgtaataacaggcatagagttgtcatctcctatgataacaatgacttctggatacctcctgaaggacctgcctgaggctgttttacagtaaacttttttttaacaagtaagaatatagtctaaaagaaccgtaaaagtataggagagtaaaaccattaacagtcctttattatcattgtcatatattatgtattgtgcataattgtatgtggtttgctttaatacagctggcagtgcagtagatttgtttacaccagcatcaccacacacatgagtaatgtgttgtgctgggacgttatgaaagctaagatgcatctagacaataggaattttcattatcaaatgggaccaccatcatatatttgatctatccaaaacattgctacatgacacatggccgtatttttaaccattgcacttggttttcttattttctataagtcttaagtcttactcttagtcctaccacatgttacaatttttttattattcacttgtgcaatcttcataaatctgtatttgtggtatttttgcacagtctaattttgcatctgattgtaggaacactaattatagggcctacctccttgccatttttcaatctttaaaattcttttattcagtggaagactcaaattgaggacttctgcaaagtgctgaatattagttcactttttcttttcccttggaacctaattgacgattgatttgccttctctgattatcctaatactaagttatacagtcttaatatagcttattaaagttcataataatgtaactatcaatgtgctaatcccaagtggcattatcaccattgcctccatctaaagtagggaacagtgaatttcatgtttattaagcattatgtaggcgctctgctaagcacgttctgtggattgacctttaatagttctaagaccccaagaggtagatatgccattacctccattttacagatgagaacactgaggcacagcaaggccaagtaaccttccccaggtcacagagctgacaagtggtagaaatcggattgatccttgcattctggctccagagtccacactgtcagctgccgtttttcaaaggattttaaataaatgaagacgtgacagctgagagatttgagagcagttttggtgtggtaaaatcagatgtgttatatattcttcagcatctttctcttaatctgcattagttcatcacataggcctcaggaatgtcaaaggttgagttatgatgtatagtagaaaagtaagttgtccagtagtttgcattctgccttctttcttgcatatttataaatttgtaagtgctgtgcacgtggattcttggcaagcatgtggaagcttaagcttaagatttgatttttctgatattataggccaatcactttggatattagatttttaagattgattttggaatttctcatccattagcaggttttcacctttctccttaaactcatagttttccttgaaatcatacagcatatttgtagcaatctgacagcataaatatacacaacacaaatggaacgacttatgaaggaattacttgtgaaagctcattggagtaaaatttcctctcaaacaatactttaggtcatatgactgagtctattaactatttttctgttataccctgccagaaaagaattttaaaagttagtttatgttttgtgtaaccatgttcttcagaatgcaggtatgtgagcatcatggtttctgggtaattctgctgctcctgtctttgaaaatggagataccacttgcagcttatcccactgctgagtattccagcattggtagtggtttcactccattgcatccatccagaactttcacacaggcctccccattacccagcattttttaacattgatcaataaggcctataaccagatttaggctagcaacaccagaggtctgggggcaagggtggaaattgactttacattcttagtagctaatattccataagtgctttatatatatattgttgttattgatcatctattcaaaaaatatatattgagcagctgctgtggtataggctctgtgctggccagtgaagatacatgattgacaatgttgtgcttgcttggttcacagtcctgtgggtacatggtggagtaaaataagtacaattaatttctcagagctgtgcacagcaacacacagaaggagagataactcacccagcttcagaggggtgggacagagaatgaggttagcctcccagatgtccttgtgctagttttagctgttttcaggtgttgataaaagctccaggagctggcaggaggagagcagaggaagctagagcttacaaagcacaaaggccatgacagcatgccagacgggtgaaagaggacaggggaaatgtaggcaagtgtctcttctcagaggatgttatatactatgtttaaaagtgttgatctgctgggcacagtggttcacgcatgtagtgtcagcactttggggtgccaaggtgggaggattgcttgagctcaggagtttgagaccagcctgggcaacatagtgagaccccatctcttaaaaaaaaaaaaaaaaaaaaaaaaaaagccgggcttggtgtcacgtgcctgtagtcctagctactcagaaggctgaggtggaagaattccttgagtccaggaggtcaaagctgcagtaggctatgatcgcaccactgcactctagcctgtgtgacagattgagaccctgtctcaaaaaataaaagtttggatctttgcctaaaaatgacaagaagtcactgaaaaaatccaagcagaggagtcatatgatctaatctcaatttgagaagttagtccagcaaggaggtagagactagtaagaagcagctaccgtaggctaagccaaaaatggtgggagcttggctgcagtagaatgaatggaaaggtgcctgatttcatggaaactggagctggaaataatttgatgggggagggagaggagtccacgttcctacatttctggcttgagtccttgtgaatgaatggcagaatgttaatggagatagagaaggcaggaagaaatggagagtagcagaagagatgacggtcctggttttggagatgtgggatttgcaccataaccacttctgaatggggtcttcagacatttattggaattgttcaaaattgtagtagaacttttagtttatttgcctttttataaatactcattgttatactttgaacaactttccattttcccagggtacttctgaaatgtatcttcctctcaaatcaaagtccagaaaattgttgaatgccaagagaatctaaaactcatttaaataaactttttctattggggtataatttatacatgtggaaatgctcaaatgttgaatttttccatgcatatatactcgtacccgttactcagatcaagataaaacgacgtaaagcttttaacaccccagaaatgtctccctcttcctacctctgagtcataccccaaccagaggtaaccactcttgtgaactggatcatcgtagattagttttgtctgctcttgaatttaagatccataaacacacacatttgtttttgcaacttgtttctgttctacatcttgtctgtggtttcatccaccttgttaagtgtagtcatttgctcttattcataactatttcctacagtttttaatcactgttaatggacacaatgagtttttttccctcaattgttgactatgaagaaagctgctatgaatatttttgtaatgtctttttggggaaatagaagcattcatttatgttgggtatgtaaaggtatatatagaatgtctagttgttcccaaacaattccacttacataaaaagttttggttgcacatgtgtagatagatagatagaaattcttaggaaagtaggaaggaagaaaggaaatattgggatccagctttaaaaattatatcaagattttgcagggcctttctgtgcaccacctccttttctagtttaattgtaacacaaatccaattctgtgatagtaaaacaaatcagatactaaagttaagaatgaaaaaaaaaattgtaaaaagttggataggaatgaattttacttcttttaaaatacttatatacttttattgtcaaccatttatgttattttaattttcaaagcaatatattttaatttttaattttttaaaatttattttaatttaaaatttattttaatttttaaagcaatatattttaaatgcagcttatagtgtccagttgatccttgaaactgcttcttgtatttatttttcaaataccatactagatttctgtttctttttaatagagtgaaaatattgaagaaagaaatttaatgctgtgtttcttaaaagattgagattattcagttcagttttaattctcaagtgctcgaaagaacctgagattttcatcagcagctttgcaagccatccccaggggcttctttcggtagttgattattctgttaccaagttgtccttaaaaacaaacaccaaaaaaaaaaaattactttgttggtgggttttttaaaaagtagaatgaaaatgaagcagtttcacagtctgtgtctggttggtcctttaatttagatttccccttatttttgcagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctctatattgtcattatttttgaagtataaggtatttttaatttgttacataataaaatcagttcattttatccttactagtattttagaagattatagcatttttgataactaaaatcacaaaggaataccttcagccagttaacgtatttctaacagataatgcttattttgcatttactatcatgctacattgccaggaagcaagattaaaattaaatagcccctgcagccatcctttgtagattttgtcctgcacctagaagttttgattattccctggacagcctgctccaccttttttccccaaatttttaatttttgtgagtatataatagatgtataaatttgactatatgagatatttcgatacagatatagaaaatgtacaataaattattgttggctatagtaactctgttttgctatcaaatactagatcttattcattgtatataactatatttttgtacccattaaccatcttcacctcctgctcccctctcccctcactacccttcccaacctctggtaaccatccttctaccctctacctctgtgagttcaattgttttaatttttagcacccacaaattagtgagaacatgtgatgtttatctttctgtgcctggcttatttcacctaacataatgacctccagttccatccatgttgtttcaaatggcaggatcttattcttttttatggctgagtagtactccattatatatgtaccacattttcttcattcgtctgttgacagacccttaagttgattccaaagcttagctattgtaaatagtgcaataaacatgagagtgcgtaaatttcttcaatatactaatttcttttcttttggatatatacctagcagtgggattgctaagagaaaacaatggggaaattgtccaggactttggtctaggcaatgatttcttgagtaataccccaaaagcacaggcaaccaaagcaaaaatggaaaaatgggatcacattaagttacaaagcttctgtacagcaaaggaaacaacaaagtaaagtgataacccacagaatacatcaaaatatttgcaaactacccatctgtcaagggattaataatgagaatatataaggagctcagacaacttcatagggaaaaatctaataacctgatttttaaaatgggcaagagatctgaattctcaaaagaagacataaaaatggcaaaacaggtatacgaaaaggtgctcaacatccttgatcatcagaaatgcaaatcaaaactaccttgagatatctcacctgagttaaaatgacttttatcaaaagacagcagtaatgaatgctggtgagcatgtggagaaagaggaaccctcatgcactgttagtgggagtgtaaattagtacaaccactaggaggttcctcaaaagactgaaaatagaactactgccccaccttatatatcactttttaatgggaggatattaatttcatcgtgagtggatggaagggcagaaatggatatggaaagttctcttttccatttccagtcttcattctctggacagaaaaggagaactaaataaggaagaagcccctggggttctagaacaggttgtttttagccccagcatgtccagaagaaacaaaaataaacactaatggtaagcagacccacttttattgaatgcacccactctgcggagtactgtgtgcacatgtcagggagctgagttttctcagcagataagtattacttctgcctgcaagtgagcaaagccaaggtcagagaggtggggtgcctgctggcccgaggtgacacaccagtatccagagcaactctccggcagctggtgcaaggtggaagccattggagggaggccaaagagcaggcaggaagatggttaggcaactaactagtaataggtgatggtgatacagcatgagctaaggaagtgctagtagagaaggagactggaaagctgtgacgtgaggactggtcagtctgggtgcttagggagagagcagtctcatgtcctggtgcagggaaagaacagatgccagtgtggtaatgcactcagagggatgaacaggcctgggtggaaattcactttgaatgtaccttgagtccagcaagaactgctcagctggcagattagcgcagtggctggaacacgagtacagtatatctgttttttgtttgtttatttttgagacggagtctcagagtctcgccctgtcaccagactggagtgcagtggtgcaatctcggctcactataagctctgcctcccggattcaagcgattctcctgcctcagcctaccgagtagctgggactacaggcacgtgccaccacgcccagctaatttttgtatttttagtagagacagggtttcaccatgttggccaggatggtctcgatctcttgaccttgtgatctgcccgcctcggcctcccaaactgctgggattacaggcatgagccactgtgcctggctgagtacagtatatctgaatccaccaaagcgatttgctttagtggttgcatgacaatatttaaagatcaatatcccattctttttagtaaggtgtttattgttctgacaaaatatttaaaggagaaaaaacgttaagacaggtaaagagtagtgtaacatcttttttttctgaatacgaatatttaaagactaaatatgagttacatgtgagcttgtacttttgtaattttcagggatgggctgagcatatagctccctttagttaatgaattccccattactgggatatagagtgtgattaaagtagtattttatggaatatagtctctgaaattggttttgtttgttttgtaatcctacacaagattctttagcctctctatgcctcagttgccttatttgtaaaattataactacctcctatgaatgatgagaagtttaaatgggatagtctgtgttaagtgcttagaacaatgcctgtatataatacgtgctcaagtcattttcctctttggcacagtgaggttcatatgaggtctcccagagaagcataggtacagagaataaagcaaagtatcacttcattattatctttgcagagtgctagtggggtaagctgaatctcacagaaagctcctttacctaagctaaatttaagcaataaaacttgtagagcctaaaacgtattctctgtgtattttcttttcttttcttttcttttctttttttttttttgctcaagttgcagtaatttatgtataacaatataaaactaatgcaaagtattactattatctctgtgtattttctccatatccgaaatgagtctcagaactcagcttcttgatgtgaggtgaaggacagaagaggacaagaatgagaataagagagcttttggcctggggcctggaatgatctggtccaggctttaggtcagactgccaacccccttttagatacagcatgggaagttgaagaaagatggtggcccttgtttctgggcatatgtccaaccacactcaccctccacgttcctgggaggacgtgagtctaaaggacatgaggagacccggccagggccctcccacatcgggatcagcaccttccacttctatatggaatgtgaccagttcaaaccactcctccttccttatttccctcccaagagtgggaagatctgtggagagccctaaactccccttcatgaccagcacccacctgttctatctagtccagttagaaacttgcattttacgcttgatttttctaatcacattagccttatgcaatgactgggggatgtggagggttgcagtgttcctgcaggtactgctgatcccactaggaagagctccttcaggactggaattttttatgcttttcttcattgctgtatctccgatgactacaaatgtgccagacattagtaggtgctcagttaatatttgctgaatgaatggtattgaatagtctagttcagctacctaactttataataaggaggctatagttaaagagatcggaaattctagaacattctaccaagacctacatgtccttaaaaaaaaaaaaaagtcctgcattattcttgcagcactgcgcaggaggtatgtgctgtaaaccctataaaatcaatcaactctttgcaaaagtcaagactggcacttctctttgaagaaaggtacacagtggttcagtggaaaaaaagtatgctttggaattatgtaaactgctggccttgatagctttggggactctaatttctcagccatctattttctcctatgcacaaagagggaggtaagaccttctccacagggtgtgagaagacaagagaattcataaatgatgtgcttagcacttagcctggcacgctagatttcaaagttagttttcctttcttcctcttatgtagagtctcaaaggagcaagaacacttgacttataaaaatcccttccctgcattaaaaccagcctcagatttacttttcatctccccaaattgaaatgttttatatgaatgaatgtgggaaactccagaccaacaaattgagtgatctgtgtcaatgttcacttgaccgcatccctgatctcaccgacatcctcttgcagcttctgtgggagaggacagagtctggttttttatcaatctcccagactctgccttgttccctctccaacctatgtgcatacgaccgtattcctagaaatacacaaagaacagataagttcctactagggctgtaatcaagtgattgccgtgaaaattaactagatcctaatttaccttacacagtagtcctgatgtggagttacaggtgcagaaatgaggttaaaaacacatggtcagctcatatgctgttgttttccatgtgaggggtggatgttctctggctagtctaggctgttggtgggtgtcactgtcctaggtaattctatttgtgggagagacactgactgtgatttacttagtgcatctgacacaggtggggtcttgggttcatctctggcttctcatctgggcttcagcacaagctcccccaatggatcatctgtgtatatgtgaagtccttagagtagcagactaatattccaagcagtgtgacatgctgcattcctttaaagcacatgatgtcaattgttcaagtagttttctggttttaagagacaataacaatattgaacaagctttaatgatggcttctccccatccacatgtctttgtaccttagagacacttggagttgatgtacatcacccactccaactctcttatcttatagacaaggagtacttagcctggtgcctagtcagtgcttggtgacttttagtataagtaattgaaatatgcccaaatcttgatcttttctaatgaacttcatgtgtaatgaattcaggatttaggaaaattgaattgtatgctcagatatatttttctttgattatacttattgaattcatttaaatattgtcctatattttgagatactgaatggtgacttgcatagtacttactatgttttgtctttaattttcagaaacaaatagaaaaacagatgatccagaacaaaaagcaaaaggtgagattgtcaaataaacagcctttaaaatatacatggggaaaagaataacatgattttatgttccatccaagaataacatgattttatgtcactaattaaaagaatttgctcctgggtttgttatttcaatgatttatcaaagaacacttattaatattttacataaacattaagagccaaagcacagaaagaggttgcccagcttctaattctagttttgacatttgcactcttgcgtccttgggaaaaatacttaacttttgtgcctcagttttctcttctgtaacgtaggaataataagagtaccaacttctgaaggctgtgtttccatgatagtaataaaatgaaaatatacgtaaagtgcttaaagcaatagctaacatagaaagcacttaggatatattaaatatcatttattgttgatatgtcaacaactgtactaggtataggaatccaaagattcctagaacatgatatctttttcaaggaactctgaattgttggaaagatatacaaacaaagttacagctatgcagaaagaattatttctgcctgccaaaagtttattacaaagtttattacaaagagttaaaaaattatatggatgatcatagaatagtggctatttttagtatcagttgaatgatatgatctttaataattgaatattattacaatttcaggaatgcttttaatttaatttgtagtgatgaaagcagtatctacatatgtatcttgtacataacgtgcataagatcttacttagtgtgcaaatgatacttggtgagcatgtggaattgctggcctctggctgtaatttcacagcccacaagttgagaagtaggcctttaattcatgaaaacttttctaactagttgtttttaatttttgtcaaagtagtacaaggatatagtttaaaaagttgaggtttataatgaatagcagcagtcctcttccctactacttcatatccccaagtctcactcctaactttcttttagctgtttctttctttctttctttcttttttttttttttttttgagatggcgtctcactatgtcacccaggctggagtgcagtggcatgatctcggctcactgcaacctcctcctccctggttcaagcaattctcctgcctcagcctcccgagtagctgggattacagacacatgccaccacgccaactaatttttgtattttttaagtagagacagggtttcaccatgttggccaggctggtctcaaactcctggccttgttgtaatcctcccacctcggcctcccaaagtgctgaggttacaggcatgaaccaccgtgcctggccttagctgtttctttctagtacttagttatgcatttctaaataatttgtataatgctgcagttttctccttaatatcagaaaccgttggctgactctgttttatagatcggtgagattagctcgatcatcatactctcacaagctctccgctgccttacttcctggatcttccgatatatttaggacataactataaataagatagcgatacctgctaatgagaaaacacaaggcaagaaggggcaaatcagcagcttttgatagagttgatcacttcctgtccttcaaacactcccttcacatggcttgctggatacattctcttggtctttctcctgctctctactgtttgcttttctcaggctctttggatggatgtttctcatctccttgaccattaatcaccggagtgccccagacttagtcctcggagcatttccccatatacacgcactctcttaatgatctcatctaatctcatggctttaaatgcctctgtatgccacagattgccaaatttactcacagcctgggtcttttgcctgcactctagactggtgtgtccagctgtctacatgttgtctgcctgataacttcaatgtgttggatgtgtaataatcacttcaaacttaacaagtctaaaaccgactcctgatctttccccctcaaaacacacttcatccccttaaaattagtgtgccaactacatgccaggaattgttctagacaagtggttgcaggtgagagcaagacagaccaggttcctgtttcagggaactcacatcccagtagggagaccagcagtacacacacagactgaaattgtggtaagagttctgaggaaacaaagcaggagagcatgccgtaggcagaaggggtggtgaattagggaagaaggtgtcccaggaggttagggaaacctaagcactctgagcagaggaacagtttgtacaaaagtcctgagacaagagagaagggcccaagaagctggagcacctgaacaagcctagagtgtgtaagatacagttagagaaagtcaaagactagaccacagtgggagtctggacttttcttcatgctgtggacaccgtacccagcccatgcacatctgtgtaccaaacagagccctttctcatttacacattgactggtttgcttctgggaggttcactataatgcattcttacaaagagagggacagggagtccgaatggtgggcatggcttgttgcagataaacagaaacacttgcaaacctgccccaaatctgctgctcacagggcagttgcaattgtgagctcctcatatctctgcctctcatgctccagacctcccattctagtcttagcagcccgtaccttcccctgcactgtcgggtatcctcggtgcacaggtctgacctccagggatgctgatcctaaagggggtttgccagggaagtgtagaggctggaacctctggaacctgcaaagaaaatcattgcaacggcttctgttgactggtttgtcactctccccccatttaaaattagcactttagatcagtaccaaccaaaatatgtttgtaactaaagtattttattaagggggaaatgcaggaatagacagaattaaaagaaataatgaatcaatgtcatcacagatttattaaaaatctattggagcaaattgtgagctgtggaaattccatgtattttttattcaaatcgattcatatgatactgttatctggtaaggaaaagggaaagggaaacattatgtaaacattacatatccagaatatgtagtaaaaaaatggaatggccttcactcatcagactttagtttcataataacagaaactgaaatttttttaaggcaaaataggccctcatttgcagacatctgttacttgagtcaaatcagattatttttatgttttagataaaattgcgatatcagtttctccccactggatgtcatcttttcccacatattccatagcccatggtcacaaaatgtgtgaactacaaaataatccaatacaaaaatggcttgttaaatgtcaaattcaaacagtcattcgtgttcatccatttattgagtacatagtgagtacttatgatgtccaggctctgttttaggcactgggcccaaaacagtcaataaaacagttgcagctctcattgtacttgctttttagtgtgtataggggagagagtggggctggatatgtagttttaaaaaattaaaatataagaggcagtgtgaagtgtgaaaaggaatataagacaggaaaggaaaacagaatgagcaggaggtgttgctgtgtaataggcctcttggatggtgacatttaagcagagatttgaagaggcaagggcaggagttgcaccggcgtctgggagaagagttccgagacttggggagcattctcatggtcctcagggcatgtgtgcttagcatgtttgaggcctaacaaggaggcgattgctggtaaagaaggtatgaggggagagtgcaggagtgcatgagaccagagtggtcaagggttcaaatcacataggctttcgaagacaaaagtaagaacttgtgtattacctccagtgagatggccattgggagattctgggcagaagatggatatgattgcattatattttcaaaggctcattctggccataggggtgcaagactggaagcagggaaaccaattaggagactattgcagtggtccaggcaagacatgatgatgaccaggattacgatgtagagtagaagtggtgagtgctggttagattctacatatatttggatataaagttagtagggtttgataatgggtggaataatggagtgagagaggtcaaatatggatctatggccaggcacagtggctaatgcctataatctcagcactttggaaggccaaggggaggatcacttgaggccaagagtttgaggccagcctgggccacatagtgagatgctgtctcaacaaacaacaacaacaacaacaacaacaaaaacccaacacgtagccaggcatggtagcatgcgcctgtagtcccagctactcgggagtctgaggtaggaggatcgatgctgcagtgaactatgatcatgccactgcactccagtctgggcaacagagcaagatcctgactcaagggaaaagaattcactctaacctttaaaagctgtactttgacaaattcactgaacacaaaaatgtgcaatatgttcttgatttagtatattatcaaaggtcagttatcagttgggatttgtgagcctttaaagaaatttgaagagcaaaggaaatgtgttttttcttgtgtgtatctatgtgtgcacgtgggtgggtgggtgttagataaaactgtatttgtattgtggacttttcctaaaattttttatttagacttatacttaatatcttattaaattattcattacaattaagaatatgtttaaacagtatttacatgtctttaaaacacttaaagatttcctgggtactatttgtatttttttttaaagtcataatcagggccctaacaaaacaccagatggcgctagaaaacaaatcacatttacactaacagaaatcacatctgcaaagcaacttaaagaaaggtggagatggctgtattacagccagtaaatcagcttggtgcaactagtacttcatatggatagttcttagttttctgtgatcataaagaaaatagaacagacgtagctaataatcaagtgtcattcagttttcttatttaaaaaatcttcagtgaagttttccttgtgattcttataactgtatataacatatttgaacaaagttctctattgctttgatgataaaaaaataaacttcttagtgcagcacatgacgcatctcaggatatagcccctgcttatggcctccctgtgttcaaaatgctcttcctaatcgctccacttcccttttatcactcccatttcttaaaactgagcttagatgttctgtctttcaggaagccttctctgactgcactcccatctcctaccccagaccagaaagtgtgtttctctttttgttcccaagatgccttgtgcttacagattttttattagcacatattttgaattttccttttaatttctagacaaaaagcttattaagagtaggaaccatgaccaacccttatccccttatattaatcagagtttacagagttctccagagaaacaaaaccaacaggatggtgtatgtgtatagatatagaaatagatagagatttattttaaggaattggcttacgtgattgtagaggctggccagtccaaaatccgcagagcagagttaatgttgcagcttgagtctggaggcagaattacttttccttggaaggagataagactttttcttaaggccttcatctgattggatcaggactactcatattatggagagtaatctgctttactcaaagtctactgatttaaatgttaatctcaccaaaaataccttctcagcaacatccagacatgttcaaccaaatatctgggtaccatggcttagccaagtagacaaatataattaaccatcacactattctagtggtgcttaaccatagatagtgggtgctgaataaatagttgtagtatgaaaaaaatgtgactaacccccttccctttcattcttgccccttcatctgatagtgatattataagatgcatatagcctgaatggtgggcaggaagaattataaacagaaaagtcaaactatgaattaactttaagtgtctacaaatatacttgctacatttcaagttattttcagatgggttcttgtttaagccttacccatcaatcttatgagttaagcatttttcagctaccatttcttcattttttaaatcttctttctcactcccctacttctgtgcctataattaaatgtatattggattgcttgaaaatgtcccacaggtctatgaaactttgtttatttttagtctgggcatgatggctcatgcctgttattccagcaatttgggaggccgaggtgggtggattacctgaggtcacgagttcaagaccagcctggccaacatggtgaaaccccttctctactaaaaatacaaaaattagccaggtggtggtgtgtgcctgtaatcccagctacttgggaggctgaggtgggaggatcacttgagctccaaaggcagaggttgccatgagctgaaatcacaccactgccctcaagcctgggtgacagagcaagactttggctcaaaaaaaaaaaaaaaaactttgttcatttcttaatcattttttcccattggattgcatgctttatattattatatcttcaagtccagtgattctttcttctgccatttcaaatctgtgttgagctcatctagtaaagttttcattttagctactgttctttccaactctagatctcgaactgcttcttttttgtagtttccatttcactattaagattccatgtctgtttactcattaatactatgtttttctttaattctttgtacttatttatgatcaacaatttgaagtatttttctaataaacccaatatttgggcacaatggcaggcagctgcagttggctcctttttttttttttcctgagactgggtcaggtgattcctattttttttgcatatctagtagtttttggttgaaaactggattgtgtatgtaatttgttatatcaactttggaatttgttttggtctttctgaggactgttggtgtgtggtagacagttaacttggctggactcaaattgaaaaatctgactctccaacagtgtaaagcagctaatatctctgctcaggatttttggcttttaattgctgtgtttaaagtctggtcagaaagggtggcggtgtcttgtgccttcagagtttacttgtttgccaaagatttgagtagaattcatactcagattttgagacttgcttctggaatttccccttgcttctgggattcactatctaaatttcagttgcctggccaaccccaagttctgccctcttacacctcaagccagtagaacttttatctcctctattgggaaatgcactcaagcaaaacataacgacttgtactttcatcagaagctgctctttccggaggtagatttttatagtagtcagcctcgaaggcagcctccagtgattcttgcctcctggcattcatgcctctgtgtagttctctgtctattgaataaagctgacctgtgtggccgaaagaatattgcagaaatgacagagtgtgacttccaaggctaactcataaaaaatgttgcagtttttaccataatcccttttaatcgctcactctggaggaaacgagctcctgcattatgagagtatacaagaagctgtgtccatatagcaaaaaacttgggaaatacaataaatgtttatggctgttgcaaggtgctgaagttggggatgatttgtttttgaagtcattatagctaatccatcgccctcaaatttctgctagctttttcaccaggctccctggggctacccatgaaggtggcaactaagtcagccagggatgctttggcttgtgagcttgggaagtatgaagtgtggtcctttcctttaaaaatttattcattcatcttattgagatgagaactgtagtgcctggctgcaaagacaccatgaagttgcaatcattcagtctctgagggtccattccattgatgcacatgggcttgatcaagccatcaccgccttgaacttaattactgcatggttagcctagttagatctgtctttgtctttttgctgcccactggagatgctttagccttgtctttagcagtcctgaaacactaggtattcctcattgacaacagcctgcctagatgttgcagcacaggctggtggttcagttccagctaaccactatgcctagtaatttttccatgttgttgaagagcaatgtagcaatagcataataaaccaactcaaggaaaagctttgaaaaaacagtctcccgtccacccttgcagctgtgaaaagagattatgagataactgctcttaaagatttattgtagtcattacattcaacagctacagtagttttagtggttcctaaaatacaccagcagttattgtctgattacttccacagataagttaattatacaagatttctgactctcatacaagtctgatttagagagaagtttaattatggcaattttagtgattgaaataagctcagcatatatcatcagtcttagcaagtatagtagaggtttttagctgtgttaaaatacacattctctttgtttttatttttcatttcatgatttctaaccatagtgtagtacatgtgataatttaggacacctgttttcaccagagtgcatcttcagtcaaacacaccacaggacaacaatagcaaattcttcattatcattaaaatcccattctaatgctgcccatggagcactccacattttacaaagctaatttgtataatgattgtgacaatgtgagcaggaaagtaaaatacttttcttaaggaaaaaaaaatcaggtattggtatgttttaaaatgactgttaagattgtaatttttttaatgatggaagatgtgacactccttcaaatcaggcaatgcacttcattgtttatgaacacattgtctatttctatactgaggcaaattaaagattaactttaaccacatatgcttaaattaacttaaaattaagctttcaaaaaatgtgccataaaaagacagtgctgtgagtagttgaatatattcatttatttaaacaagacttcaaattggtgagtacattagtttgaaaaatgctttactgaaaattaccttagtctgagccctgcagacctcttccccatagcacttttcattcttctaatataatggtaggtccagtggcatttggagcagtagttcctgcgatatttttatatttttcacttaaaaatcaaatatatattgacaataggaaaatattaataatggtgaaaataaatcaaattctgttttaatttgagtgattttattacatcctgcctgggaagccagtctaccgcctttccttaacactatgaatgtcagtcatgcctttcctctttgctgcaatgttctttcttcttcctcttcatccattgggatccaccccacagtcctttgctgctaccatgcccggtcagcagtgacagagatgtgggtgagcatggaatgaagattaggcatctcacaggcagtgtctggagaccacgcgggaggcagcaggcaaatctgtctcagaaatacggagaaacctagcctcatagggattctggaacagaccacaagtaaagctgccagcagaggatgtttgctaacagaaagcaggatttccacgtggaggggtagcattggatcctcaaagtactggaatagcacagaaagccccgtcgctagccctgccacgtcgttaggagctggtccaggatgaaggtagcagggcatgagctcagtgccaggagagcagccgcactcgtggtgtatcacctgccataatgcttttatctaacttcccctttcctcctcgccctccatctagagcacctgaagctaatgtacggataattaactgctattgaaaccagtgatgcacccaaacaaaactaggttctccttaggcaccactgtatactgtagcatttcccacccctacctgcctgctcgtctaacccagctctgtgtcactgctggccaggcacagtgagagcaaaggactgcaggatggatcccagtggatgaagaggaagaagaaagtgcggtagaatcacatgggggagagttcagacagtgccctgggtcccaccctcaactattctgatttcatcactctaggtgcaataattctcatgtgtagtcatggttgagaagtgttagttaagatacgctgctgacctagtcagtctggtctgtgtatcaggcccatcttaactaaaaatttttattggtatcacctgattcagaaatcattttttgacaatatttgaatccgatttgaaggggttttttaataaaatataaagccaacaaaaggatcgtttgagaaaagctgaacctgtagtatgaaaaaaaattttaagtttattaaacagctattttaaagataaccatatgagccacaaatggtaagcaaacctagctgtactgaggagctgaggaaaccttgcagtgcttccttctcatggcgtggacagaatactgagcttggtagttgaggcagctgttactgcctgaatcttggcggagacccttttcatctcatgacccatgttctatctcatcggcagactctcacctcactcagctccattcctttagcaaaccgtgcaaattttaatcaggactaaaagactacttttaacaaattctcagttgccctctatacatgctcaaacttcagatatgaaagaacaagatttttatcaatgatattttcaaaggtctagctttttctgatgccgtcagttactactgcattgatgccagcaagtgctagaagaaaggtgagcctttcccagtgctgcaaatatgttgcctgggaaagacagcaactgcctctggcctaggactggagagacccacttgaccactgtctcaagtcccccatcctccttcctgctcctgctgtcctcattctccaccctgatttcagcagctgagagtagacactatcctctttgagatttttgctgcttaactatttgaggcaactaattaaatcctcatcatgtatgtggggacatgtcatttactgaacaaatattgctgtataggatgacgatgtttgagggaaaacataaccctaataataaatggcagatgcattccacttcgtttgttcactttctgcaaagggacttagctgtgctttgtactcagaaggtactcagcatttcctgggtcattgccatagaccgattcatgggtctctcatgccagaaagaatgttgtttttttttttcctttaactcttattattaaagtaataagaaaacattactgagggcataacagtacttctttcatggttcccctcctaaattatttactactagatatgttaaccacttaaggtgaatatatagcactttatgttgcgaattctaaactcatttcaaattataaatacatttgttgagttggtcatggtagaataagagaacactgatttttgcctttgagttcatttttaaaagtcagcgtgtatggatgaacggagtaggagaaagaattatatatattccgacacactttcatttacagaggactcatttgcgtctggtgaaagccaggcggcttgcaccatgtcctgggacttcagccatcctttcatgtgttgacccttcttaaagaatggaagggggaactgaataaagaagataacagcttctagctaagaaggatgatgcattagtttgccaaatatataggctccttttgtgtgctatgctctgtggagcgctctgaaagcaaagcaagtaactacaatgtaaagaggtagagactatgaacaaaatgctgtgggaacaccaaggaggaaatgacacactgctggcaggagatggaaagcaactggagtcttcatggagcgatgacatttgagctggtcctcaagtagtgggtgaggattacatccatgcaagagccctgtgaacccagatactgaagtatgtctaatgacaaggatgataagttgatatggaaaaaaaatcacaggtgtttctgctcacagcaagcccagcagtactccaagagcagtacttaacttgggtgtcatgggctatgctctctatacagaagattacattagagtcttgtcttaaaaaccctttttgggaaaattatcataattcatttttttctaatatccaatgacttttacgcttttgctactttgattcatcagtacgttgatgataccttctcctctttgtcccattcctgcttcatgataatttaatgaaattaaagtaatggatttaattagcacctacatctatgattatatgtatatattatttatctgaaacctttggggtgggccagctaccacaattaaaatatcaacttgattcaagttgtgtgaagcacactttaaacttgaaataaaagtgaataaaatctatttatacagtgtgatgcctttaattgataccctttatataaaagccaaggtttgataaagttgtgtttcaggtaataaccttgatttttatgcttcattgaaatttggctcctctcccccaaggatcactgacttccttgtgcatttatatcatcatagtagtgatgttattactaatgtcattcagctagtcatagggtggaagtagcattaattgcaaattatagcttcaacataaaaccaatgaacttgggtgagcatttaatttctgggccttgtcactttgattcatactgcgtctttgccttttaactgctgctgtgagcatacatgtgcattctctgcagtatattttttcatggcacttccagacagtcctaagagtcaagcagtataggacccagcagggtatgtgttgttgcgccattaattgcatacctctgcgccttctgaggaaggaggccagaggcagattgtctttcaccccctgagaagtatgataatagcttgacagtgctcttactggagtatttctctgtgattattaaatacaagtgaagagacttgttagaaagagagaaaaatgaggaatattttaaaattgccttttagattaatagtatcaaacacacttagtgcattggtactagcgtcatggaaatacacaagaggtttccattcttggtcagtctgagtttggggtttgatctggtgtgtttttagattaaagtgtgtggctaaatgtgatgctggaggtcaaggctcttatgagccctgttcttttgtctgcttcagcttttgagtagctattattatcattttatcagtgagcattttccttataggcatatgaattcctcttactagtgtgaaatcacttatttaattctagaaaattcttgcagtacagtagaaagggttcttgactaggagtgttaatcagctttaccaattcttatttgctatttcatcttgaacaagtctcctggcctctctgagctttttctcccatgtataaaacatggagataattctacctgcactcctgcatttttcgtgcaggtcagatggccatttggctttgtcgctggtgtcatgctatacagatatgagcaactattatcattactttccctccagtgattactttgtataaaatgcatgttatccctaagtccaaatgcaatagaagagtaatctgatattgcttgtgtatgttccttttctaagaggctcttaatgactgtgataaactttatccacatgacattccaatgtctttaagtgcaagagaaaggtggttattcttcagggatatttttctaggaagtgtttatatgtgaaaacaaacatctacaagttgaataagttatgagaatattggaaagctatttgaggaatgcttgtagtggcaactcattaaagcgttaagttatgctttccttctaccttgggtgttacagctttattaacactgagtttgaaaacagctaacaaaaaaagctaaatgcttaagggatttattataaaattcaatagtgccattaatttccatgtatgctttaaattgctgggaaaaagtaatgtattcagcaaagaagcaagttcctgcttcctcccctgagtctgcctgattgtgcaattggtctctcattctttaattaaacttgtccaaagataggatccgctaaaatgtttactgtataaatagttttcattcccagtgtgcaagtttaaaaccatggtaaaaagtttgtcatctgttaacaaccaaaacatgtggtgtgctgttgcataaaaataaactgcacattattcataaaagggatcacaacatgtatcacatctttggggctgacaataatctgtgatgttttggaatgtcacctccttctaagtgacagtatgctcagtagtgcattatgttaaaaaacatgatcgtctataattgtaataaaaataattcatgtattgttattcaagtgaaattgatttatctgaatgtcagtgttactgataagaaattataatttttaattttttctttgatattttcaaatctaaattttcctgagttttattttcaagtctttttttcctccctaaaatttaaccatttaatttagccaggaatttaaccatttctctctctttctgtactaccattgcctcggccctgtgacatctcaggcttgtatatcacatccagggagtcttcttgcctctagtttttgcctttctgcatatatgtacctaccacaagagaaagttcttgaaagacaggattcatatgctcactcattgaagccatcagaaataccacattgtctgtggagcaaagtcaaaattcctcagaattttgttcaaggcaccccataatctggctgtaagccacctgtttagccttggccctaactatccatgtccctgtactttatagaattccacaagatttttcacaaatccctgaacatacctttttcacatttatatgtacatactttcccatttctttgaaatatttttcgctgtctacctcattccaaattagatctgtgcctcaagagtcagttctaatgttctgtcattccttaattctttccttgtttttccaattagtggtaatcctttgcttctttctgttcccagagcattttgtaattcttactttgcatgatcattttcagtcttttattctagtcattaatttacttcccccctaccactttctaatgtgtgaagtacttggggatagggattgtcttgtttatctttgtgtccccacactagttagcataatacctgtgaggcactcaataaatacgtgtcaaaatggtttgaaaatggtcacacattgtgttctggagaatccaataagcaaactaatgcaatggaaaaatttagacaaacaggtcagagcagattgtcatattccacataggatttttttttctatgtagcagtagttatggatgtcctaaaatgattttggccctttcctattcagtatttcttaatggacaagagtggacattaatagacattaatatctcacaagattctgcaggaagttctgatttgtttcacacaaaacgaattgctgtctttggaccttgtttaggtcccatttcaaattaacaaactctataaatttttaagacaatcagggaaatgtaaacactgattattcagtgaaagtatccaactatgatattcagaaattattgtgaatttcttttctctttttttttttttttttttttttttttgagacaagtctcactctgtcacccaggctggagtgcagtggtgcgatctcggctcactgcaatctccacctcccaggctcaagcgattctcctgcctcagcctcccaagcagctgggattataggcactgaccaccatacctggctaatttttgcatttttagtagaaatggggtttcaccatgttggccagactggtctcgaactcctgaccccaagtgatctgcccgcctttgcctcccaaagtgctgggattacaggcatgagccaccacgcccagctgtgaatttctttttagatatggtaacagtattgtggttatatttttatatgtttattataacaacttcactgaggtatagttaatatacaatagacttcacctaaagcatacagtttgataagttttgccatgtatgaaactgtaaaaccctcaccaaaatcaagataatgaccatatccagtgatcccaagtttcctggtgctgctctgtgacttctcctggatgttcttcctctgtgcccctccccaaccccaggcagccactgatccacttaaggtccctacgcattagtttacatttcccagattcagtggctggaacctccagtaaaatgccaagaagttatgcatggacatctttgtctttttcttgatcttgggggcaggagagggtagaattcagtctgttaccgtttagtattgttagctttagatttttcatagatgctcattctcagattgagaaagtttcctatgtctacactgcttaaagttttttttcaggaattggttttagatttagtcaaaggctgttctattgtctaatgaaatgatcatatttttttcatttttgtgtataatataaattgcactgattaattctagatgttaaaacaactatacattaatacatttctgagataaaactcatgatgcattattccttatatatcttgttggatttgatttgctaacattttgataagaagttttttacatctgtgttcatgagggataccagttagtagttttcttttcatgtagtatctttttctgattttggtttcataataatgcagaccccacagaaggagttgggaaacaaccccttctctttaagaatttatgtatgatttctttattacatatttgatagaattcactagtgaaggtgactgggcctagtattttgtgtttggaaagtttttaaccataagctttatttatttgactgatacaagatattcaggttatttgtttattcttaagtaaccttgggtagtttgtgtctttcaagaattgtgttcatttcatctaatttgttgagttaattgacataacattgtttataatatttattgtttaataattatagaatctgtaatgatatcacctgactcattcatgatgttggctatttatgtttatttgtgtcttctctctttttcttgatcggtctggtggagtatcaattttagttaacttctctcaaaatcagctttatttttattatcttcctctggtattttcttgctttctaaattatcaatatgtaccttgatctttattatttcctttcttccacttattttaggtttaatttgctgttcctttttgaggttttttttttttctctctctctctttttttgagatggagtctcactctgtcacccaggctggagtgcactggcgcaatcttggctcactgcaacctccgcctcctgggttcaagcaattctctgcttcagcctcctgagtagctgggattacaggcacccgccaccacgcctggctaatttttgtatttttagtagagacgaggtttcacgatgttggccaggctggtcttgagctcctgacctcgtgatccacctgcctcagcctcccacttacaaaggtgtgtattttactattgttgcagggagtctagaaaagtcatttaggtcaagttgcttcataccactgttcaaatcttctatatccttgctgatgttctctctgcttgtcctattaattactgatggagggctaccaaagcctctgatggaattgtggatttttctattctctttaaagttctgtcaggttttgtttcatggattttaaagttctgtaactaggggaatgaacatttagattattatgttctcttaatgaattgatttatttatcgttatgaaataatcccctttatcattgagaatattctttggtctgaaatctgctttgatattcacacaggcaggcacttcagctcttttttattgtcctttttattagaatgatatgccattttctactcatttgcttttaacgtatttgtctttatatttgaagtgtatttattgagttaccacatagctggctcttacttttttatccaagctgaaattgtttggcatttaattgggagtatttatatttaatgtgattattgctatgattagatttagatctattatcttgctgtatgttttctatttttcatatttcttctttgttccaattttcctcttttaccttcttggctaaatttattcttaggttttttttgtagctattataaacaggattactttcttgatttcttttcagcttgtttgctatggtgtatagaaatgctactgatttttgcatattgattttgtatcctgtaactttactgaatttgtttatcaagtctaaaagttttctggtagagtctttagatttttttctatataagatcatgttttctgcaaacaggacaatttgacttcctcttttccaatttgggtgacttttatttctttttcttgcccttttgctctggcttggacctccaatactatgttaaacaagagcagtgaaagtaaacacctttttcttatttcagttcttagaggaaaggctttctgcttttctccactcactgtgatgttagctgtgggtttgtcatacatggcctttattatgttgaggtatattccttctatgcctaatttgttcagaagtgtgttgtattttatcaaatgcgttttctgcaactattgagatgatcatatggtttttgtcctatcgatgtatttttttttattttcatatgttgaaccatccttgcattcatgggataaatcacacttgatcatggtctgttattttttagatgggttgttggattcactttgctaatattttattagggattttcgtatcaggaatatcagtgtgtatttttttgttgttcttgttgtcgttgttgtgtcctgtttggctttagtatcagggcaatgctgtcctggtagaatgagctaggaagaattcccttctcttcaattttttggaatagtttgagaattggtgttagttctttaaaagtttggtgaaattcaacagtaatgctatgtggtcctaggcttttctttgttgggagatttctgattcagtctcattacttgttattgatctgttcagggtttctgtttcttcctagttcaatcttggtggttgtatgtgtttaggaatttatccatttcctctagggttttcaatttgttagtgtatgattgttcataatagtctctgatgatccttcgtagttctgtggcatcagttaaaatgtctcatttttatttctgattttatttatttgggtcttctctccttttttttcttagtcattctagctagtattttatcaattttgtttttcttttctttttttttttttgacttttttaatatactttaagttctagggtacatgtgcacaacgtgcaggtttgttacatatgtatacatgtgccgtgttgctgtgctgcacccattaactcgtcatttacactaggtatatctcctaatgctatccctcctcactcccccgaccccacaacaggccccggtgtgtgatgttccccttcctgtgtccaagtgttctcattgttcaattcccatctatgaatgagaacatgtgttgtttggttttttgtccttgaaaaaccaacttttcatttcattgaacttttgtaatttttttttagtccctattttgtttagtttttctctgatctttattgtttgtttctttctactagttttaggtttggctttttcttgatcttctagttctttgaggcatgtcattaggttgtttatttgaaatctttctacatttttgttgtaggtgtttagtgcttataaacttccttcttagcactactgtatctcatgggttttggtatgttgtgtttctattttgattgcttcaagtagttttttaaaaatttccttcttaattttttcattgactcagtggccattcaggagcatgttgtttaattttcatgtatttgtaaaatttccgaagtttctctccttactgcatttttagttttatttcattgtgttctggaagatacctgatatgatttcaattttttaaaatttgtcaagacatgttctgtggcctaacatatggtctacctggagaatgttccaagtgctgacaagaagaagagtgtgtactccgtagctgttggatatgatgctctgtaaatgtctgttaagtccatttggtctaaaagtgcagtttaaatccagtgtttattttgttggttttctgtctagctgatctgtccaatactcagagtggggtgttgaacttgccaactattattgtattagagtctgtctcttcctttagagataataatatttgctttatatatctggatgcatatatatgtggaattatgtcctcttgaagaattgatccctttatcattatataatgaccttctttgtttcttttttatagtttttcatgtgaagtttgttttatctgataataaaatagctactcctgctcacttttggtttgtatttgcctgcatatctttttctgtctttctatttgcctgcatatctttttctgtctttttgcttttagtttatatgtgtttcaggtgaaatgagtttcttgtaggcagaatatagttgtggtatgtgtttttatcagtttatccagattatatcttttaagtaagaatttaatttgtttatattcaaggttactattgataggtgaggacttattcctgtcattttgttaattgttttcttgttttccttttgttgttgttgtatattttttgctcctttatcgtctgttgtttatcatgcagtttggtagttttctgtactggtaacatttgactcttgttttctcatttgtctgtctgctctactagtgagttttatactttgtttatactttggtgtgttttcatggtggcagatattgtccttttccttccagatataggaccctcttaggcatttcttgtagggctggcttagtggtgataaattctgtcagtttttgcttaagaaagactttattcctccttcatttttgaaggatagctttgctggatctggtatcttagctggcaattttttttctttcagctctttgaaaatgtcattttattctcttctggcctgaaagatttctgctgagaaatatgctgttattctaatgggaattccattttaaataacttgattcttttgctgtttttataattttctctttgtctttcacttttgacagttttactgtaatgtaacttggagaagaccattttgtttcaatttatttggggatctttgagcttctcatatttggatgtctatatttcttgcaagctttgagaagtttgaaagctattatttcattaaataagttttctttgcctctgttcatatccataaattaggacatttggttatttggttgatttatggtgtcacatatattatgtaataatcttttcttttctttcctttcttttcttgagacagggtcttgccatgttgcccacactgatcttgaactcctgagctcaagcgatgcatatgcctcagcctcccaaagtgctgggattacagacatgagccaccatgcctgaccatgccaggccccttcattgtttttttttttttttttttcctgactggattatttcaagtgatctatcttctggttctgaaatttttccttctattcaatctagtctattgttgatggtgatggtcttgattttatttttgatttcactcattgaattctttagttcccggttgagttcttttaaatggtatctatctctctattgaatttttctttcagatcataaattattttcttaatttttttgtgtcatttatctctgttctcatatatctcactgagtttctttagtattattattctgattctttttctgatatttcataatttccttttcatcagaagctgttgctggaaaattattgcgttcccttggaagtgtcatgtcttcttcctttttttgtcttcatttgtccttacctttgatatctgcacatttggtataacagtcacttcttccaattttgtgaattggctttcataggaaagacttttttgctgtagaagtatctataatgctggttgtgtagagcactttgtctttgattctgggctggcgcagtagtgtagtctcagtatgatttccttggctgtgttcagcatcagtggtgtctgtgatttcctcagtggtttagctgtgaattttagtggaggctgtggtgaggctctgctggggactgggatgccaggtgggctggtccttgggcatgcccgtctgtgggcccctaggcagtgtacatgggcactgatggtagtgggtccaggagagcagacctttgggccttcagaaggcttacttggttaccagcagtggctgcagtgggcaggcaggtcctcaggcacctaggcagcatgtgtggtattggccatggcagtagcagtagcaggccaaccctcaggctctcaagtgtcatgtgcaggtacctaggtccccaggtagggtgtacaagtggttgcttgcagtagaggtggcaggctggctgggcccatcctcaggcccctggaaggcatgcacaggtgccagtggtggcagatggggtgggtcaatccctaggcccctggaacatgtgtgtaagcattggtggtggcgggccaggtgaaccaatctccaggttcccagacaacatgcacagggagtagcaggagtggtaccaggtaggacacacttgttctcacactgcctgacagtgcacatgagtgcaggctgcattgaggggtggggcacggggcaatccttacacatccagatggcacactggggcatcagtgacagtgggggtgggtggggtggatctatcttcagatccccagacagcatgcatgggtgcctgcagtgacaggctgagtgggccgattcccaggcttccagatgatatgcttaggtgccaacagctatggcagtaaaccaggtggccctgtttttaggcccctgaatggcaggtgccagtggcagcaggtggggcaggcttattattgggcttcctgatggtgcatccaggccattcttatttttatttccctgtgtgtgacatgtctattctctctgtctgcttttatgatccttattttatcactggtttgaggaatgtgatccctatctctcagagatcactgacctttattacctgatatacagtttctcacaagccattgtttcatagataatatggaaatatttagaaattttaccaagtttactctcaaccttagtatttgaagataatgtcctcctctttattgttatttttcactacctctgtttcagaaaggcaatggctttgtttttcaatatatcaaataatagatttacatccctgttactgatctataatctcatttgtctgtaatgagaaacctcccattgaaacatgtattttctctattgggtaatacatcagaaatagtttgtcacttcatcatcctgctattgctcaagtaaacttaactatttcttactccccagagaccaggatcttcacagttgggtatttgttgaaagtttgtggtcatcctgtcatgcctaccacctctactataaagcaagattaatcaattttgtaatgtcaggttttcattcttatagcatatggagaaactctaaagacactcttggggtttctctcattgtgattttcaagttgtgtttaaagatatccactctgttttggtgaaatctcagatgatatctaaaaaatatgaattccatgtaatttatttcttaaaagttataatagtgaaaaccagtcaatatcagttctgaacaaacatcggtcaaacatagatcctgctgacatctaaacaatcaaatgaaaaataagatagttcagacataggattaaaaatactgaaattattcattcatataatatatacaatagtccttccttgtccatatgggatactttccaagaacccttggtggatacctaaaactatgaatagtaccaaacctatatatactatattttttcctatacatacacactatgacaaaacttaatctataaattagtcacagtaagagattaacaacaatcactgataataaaatagaaacattataacaatatactgtaataaaagttatatgaatgtggtctccctctcaaaataccttattgtattgtattcagctattttgggactattgtagaccatctgtaactgacactgtgaaaagcaaaaccgtggataaaaggggattcctgtactaatctttacatgtagctgagatgttgcagagcaaaatcacctgtagcaatttttttggtattggggtttgggaacatctgttttgtttcaggtccttcaggagacactgatgcaagctgggcttagaaattattatttcatttgacatcactgggaaatcagtatttcatagaaacaattatttaaagatgatgttagataactttaagcatcatttaagcaaaattaataaattcgggtgatattttctaaagcattttaaaatcatttccccatttaaaaaatgtgttgtgcaaataatttaacattccctggtgactggagactataattctgattttaatgaacatcagttactgtatcatgcagtgatgcttttggggactgttaaagtgtttggcaccatttatgtctacacagtttaacccatgttgcagtgctattggagctgggtttatttcaggtttatttctggtttctgactttcttactttcagtctgtcagcttgtatccgctgctgagtatatacctgcttcaaacaaccctcactccatcttgttagtttgttacctataataacttaagggctagagaaacagaacaccaagattattagaattttatctaaaataacatttgaggaaggtggctattctctcatggaacgtgtgcgtggggataaaattcagtgtctggcactgctgttggtgaggctgcggactgctttggcactgaagggttttctgttatgtctagaaaacacatcacttagcatctctaaaatttctaatttaacatatggggtcacatctgttaaaggattattactctagaaggggagtgatgtataatttataaaaataaccctatgggaaggcagccaactacatgtaataaactggaatacttgctgtctccattgaatgctcccagcagaatctcacattagtttagtagagggagcagatgaaaacaattgccctttatatactatttactgggttgtataagttagcatctctcagtgaaaaatatttgttaactgtttggtttaagctttgaatattgacctcctgctggtatatagttgataattaattctgaaaaaacagaagtccattattcttagctgtaggaggcaagaaagagtgtgccatccttggtaagagagtctttcaagagttgcccaaatttacttcttcttctggtaatacctatagagtagatcgtgttagagaaaaaaagcctcagaaggggctatttttggatcaaacacattagcttttctttctcacatggtgataatacaaacaaaggctcctgccagaagcacctccatggctgtctgcatattgggtttctcaacagcaaatagcatgtctctcaatatgagagcagatttatttcagaccccagtgtgaggcatcacagtagggaataccttgcacaattcccacttttaaatgaaagagaaaataactgagggcgcctacccacatcccccgcctgtaggaacactcgtagattcaggtttgcttttcctgtgattagcagataacgtttcatcaaaaatcctaacatgggattcttgaattcttgaatgttttcttcttttttaccctttgccttaatttatagatttacctcactgtcaagacaaatgtagagtgatgtttcttttattgaaatctatcagtgattttaaaaagaaaagcagaattagcttccaatcctaataaaggaagattaaaataagcaggggtcctatcttgggttaactgttaattgctatgaataatattgcagtaaggttgctttatgtgatgactttgaaacttcacaccacatctcagtcagatacagagcacctttttctttaatatcttattttggtcttacttttccttcccttaaattgttttgctttttagattatttttcatcaaattccacctttgaataaccatagccaaaagcagtatttaatattttatgtgattctgcttaaaaacacatactagagtttgggaagcaggggaagtttagcatggcctcaaagctctttaatcctttgttgacttgaaatccaaactgaatgcaggtatagtgtgataaagttattagttgcccaaaatctctgccagggaaatgtctgatcatagagaaaatctgatctttttaaaaaattaactgcttaaacatttattaataagagtcaggcacatttcccacttaattaagcatagaattttaaagtaactaaaaataagatactgtagatgaaagtcataattaacatttatatgaggttttatgctccatgactttcctttactgtagtaggaaggaggtcagatattatccccatttcgtggatgaaaaaacaaaggctcaacaaaattaagcaagctgcctcagaagtagcggaactgaagctcacagactggccttcaggcttgtactctgtggtccttctaccaagccaggatgtgtctgtgtaatgtctaaatgctacgtcttgagacacaaaatgaaggaaaattactatggttatttaactgcctttatccttacagacaagtaatacaaagttcagctacttcctttacacaaataatacttatactaatacttaattccactgtgtcatcacccttaaaactcttaggaacaccctaatttcttgacttctgagccagatgccaaagatatagcaaaatggttaagagtacagacattggagtctactggagagaacccgaagcttcagtctcggtgcctactgtttacagtttgtgcagcttgggtgagtcacacatgtctagaaggcttaagtgctccataaatgtcagctgttattatcagcacagaattggctaaggcattaagcagtgactcagaacataatagcaagctgctttgggaagtttttgttattctaaaattagcgagaccttgcaatccaagaatttactgttagttgtgccttgtattctgccatgtgtgtccccatttgctcaatatactgaaaaacctacatggaataagatgtagaataaatgttagtgttccctacaagatcttcagtggggattatggtacaagtatcttgcttttttttttttttaatcttcctcttcgggcccctccattattgaccattgaaactttttggatttgaactctataaagcaagcaactctcaggtaattttctatattggttgtttataattttctcattttttaaaagacagctgatatgcccaattacaaattcacattgccatatccccttctacagtgtcttgcttcattcatgcctgcatgcattcatgcctttagaaacatgaaaaattgttgaggatttcctataggacaggccatatgccaaatgctgttttgtaaattataagtaacacagttcagaaattaacaatccagcaagggaggaaggtgggagtgaggggggagagtttgagcgagcactgtgtatataccgccagcatgaacacagcctgaagagtttactatttctagaaatagtaatgagtatagtagtaatagtaatagaatgttatatgaccataggagagattattttctgcctaaagatgccttaaacttgatagaagaaatgacatttaaacgaggtctcaaaagttaaaatatagaatattctttggtagaaataaaggaaagggttttccaggaagataaaacaccatgagaaaaaccacagaagtgtcaatgttcatgccatattcgagagtctatataaaggaaattaatagaagaggaaaatggagattaggggccaatttgtgaaaggcaaaagctggttcaaggaaatgcaactgtgcaagagctcaagatgcacattattttccttgaataagtatagcatttcagatgggctagtgggagaaattcatacacacacacacacacacacacacacacacacacacagagttaaattaaggtccgtatttaatcagccatacaaaattgtatcagaagcaaaatggcagcccagggcaggggcagatgctatgtccctttgcatggcttccctggccatctagagtccttcactggtgcagatgggagccacagttttccactctctgtcttgcatgttttcaaaaacccagttcttgctatgccactgcccttttgtagtcagtgtgtataccctctctcgaaaaaccttatactcccagagcaagcactctggactctactggcttttgaagcaggctcagcatcaataaagttccttcttcagacacggggagaaagcaagtcagtgtctgggatccctgagcaatatctacaccttcagcttcccaaaattctagaaagctgaaattcttattgtaagaaaatttatgtgttatggcaccaaaccctagtatccaagcaggagaggaattttagcctttcacattaaaaacaaaacaaaaaaaccaaaaaacaaacaaaaaaacctaacaataaaggttcaaattcctgattgtgattgagttacaaaataaatactctctcctctggccagaatgctacctctccctgggtatacagaagtttttagtttccccaagaaggctcccctcccaaatagattagtaccactcctcattcatcctataattgcacatattcctctaactattagttattcatgtatgtcttccccaaaagactataacctccttaagaaagatcccgttgaattctgagaacctcacacaatttttggaaaacgggcactttaacaaattcttgagtgaataaacaagccggtgaacaagatgggccctaatccacagtcctaggtctccctccactgtgggcagagtgacatgctgaggaacggccagtgttttgatgtagttcaagagtagggtgcttggaaggctggtggctggtaaggaagagggcagtctggagtagaagaggtagctgggatgttaaatacaaaaatattccaatgtcattgagggcctagctaggtctagattcgcatgttgggttttttcctttttgtgtgcaggtaagtgtgtcttaaacatgggtgagtgaattacctcccaaaagatttttggagagtttcaaactaaatttaatttcatttttgaaaaggatgctgtttttattcccaagtgtttctcatactattacacctacacagtaagagtcttcactgagaatcatggagcttatctctgccttgtaactttttttgttaaaagtcaggttcattaagaaggaatttacatacagtaaaatttaccttttatagtgtgtattctatgatgcatatacatctagatacagcttttatccaccacaactaacttacagaactttgcaaccccctaaattattttgtgcccttgtagtcatccccttttcccaccacagcctctgaagccacttacctgttttctgtagctgcagttttcagttttccagaatgctatctaaatggaattagtcagtagccttttggactaggccactttcacttaacataatgcatttaaaattcatccatattgttgcaggtactggtgttattgctgagtagtatttcattttttggatataccacagattgttttcattcaccagttgatggacatcgggttttctctacgttggggctgttgtgaacaaccctgtggtgaatatttgcatgcaagtctttgtgtacgtcttcatgatttatgttttcatttttcttgggtccgtaattaggagcaggattgctaggagggcatcccagtgaatttaatttctattttttatgttctggggatctatgggtgtattttcagcaatgtaatgacatgaataaatagtgtttcaaaaataacctgagaacaaggtagaacatgggaacagactcgagtcagggagactagttaggaaattgttgcttttcaaaatataccttgtaggagaaattgctgttttcttcactgtcttcagtggaatgggtataggacatagagtaatgtgaagattctgtgtctgtttttattgatgatcaacttctccccatggactgtagtataaaaacatcttccatgaactaagtggaaatgaaaaggagtcaacgtaatttttataatctacaaatgcatcactagtgttttcctcctgccttcagctatccttttattttccttcttttccattttgtttgctcttaatatttcaaccacagcctggcaagggaagtaaggatttgaaatgtaagtgttcctttttcttttcttctttgtgcttttgaaaaagggccaaacacttgtaatggcagtgatttaaaaacaaaacaaaactttaatttatatatagcatagatagctttctcctaaaccattttgaaagatccaaattcaacaaaattaataattctttctagtaccttataggtgtactttaaaagattatgaacataatttaaatactgaaaattagaagcacaggacttttgagttcaaagagaccttaagagaagcagcccacatcacccatttcttacccatgggtaagaaagctgaggcccagagtgctggagagagttcgccagggtcccatcaccagcctgaatgaggactcattttttctacaggtagaacatgtgcctccccagaatgagaagaaagagtgagtctgtggtttttagcagttgggaaaattgcctcaggctttctgtgtacttaaaaataaaaataggataaaatttgaatttcaaagacaggtacaatagttagaagctatcaaatatgaagatatatgaaaagatagaacatggtggcatgctgtgagatttttaatattttgtctattttagtgctgttattgaaatatcgtgacactaagatacagcattgctcattaacaagcatataattttgctgttacactgttttggatgtcctaaactgctagtttttagtttcttttaaataaatattattttaacttgaattttataacacaagagacatgttggggaaaaccagtgatgcccacagtgaaactgtctactcagctgcacaccaggcttttctggaggtctcactgtcattctgttgatagacacttctacaaaagcaaaatgaacaattgggagacataagtctgtgctgagatgacaaggcatgagctcctactaccatcaatctgtgtcacagagaaatgtctattcattttccatatcagcatatatggtaacatataatggcatgcagtttaaagctcattattcactgttttttcagtctctgccttagacacatatagctttcaacattacagggattagggtttctgggaggagagagaaggaaagtcaaataaatataatagaagatcatagcaaacaaatgtgtaagtaattaaaagatgatcagagtgtcagctttattacttgatgaaagttgaattaaaagagggggtttggataatcaggaataacagatttcttaacactgagccccagaattggacatacccactgctccagacagcatggaacagccttagttcttccatgtgagagcctctcttgcagttccgctcagcacgaatgttctcagaaggtcagctcagctcagctcagtgtgcatgctcttgagaggtagggaaggagtgaaactgaacttcaagttccttctaccaactcagcaagtggattaagtcatatcacctcccctgtagggagaggtaggagactaagtattttggagaatcttccctcttcttgggaaacacgaaataagtatccacttctttccatgtgggtgagagagtggaggggtcaaggtaactaacccttttggaacctcagtggtcttctccgtgtagttaaattccctgtgttcaggaagttgagaaaataaaaggtatctatgtatagtgtgtggccgggcgactggcgcagagtgagtgctaaaaagacagtagtgattccattccatcttccttaggatgattccatgtgctcttctttgcccttattttggttgtgttttataaccaagtttctgatttggacaattgggtgtcattctctgcaataaagtcaatatgaaaaagaatagatgtgtgaggaatagcaaattctattttttatttactgagtttgaggtatgtgtcaataggtgcttggatttataattttcgtgatgcaggagaaaatgaactagttggtttgtagctcagctggaaattaagtagttaaagccgctaaagagactgaagactgaccctgaagaatataacatcccaaggagcagcagggagaaggagttacagaggcaataaagagaaattcaagaggctagagaataaggaagaacactgggagagtgggcaacataaaagtcaaggaaagggatcatctaggaaggaggagggcatcaactgtgtcaaatgttgcaaaagggccaggtaaaataggaagaaacagaacaaatagatttgcagaaagccgtagccattattataatagctctcaggtactgagcacttactgtatgccaagcactgtgttaaatgcttcatatactatcctgatttaaccctcaaaaacacccctaattttatagaggaggtaagtgagacccagaaaagtttagtgccagcttggcttaggtcacagagcttggaggtgacagagctgggactcagacccctgccatcgatgcttaaccacacagccttccctcctctggcagacttgcttctgcccacgtggtgggtgaggaagccaaagtgctgacaggaaaggtgacaaagaggtgccccccaggggaggggagggagcgtggcaagtagaggagggtaggctggtttgtttgtttgctgtaagatggcagaaactttggcattatttaacgcattattaaattcccaccagggggcacacgagagatgctgagagtgaatagacattcagaaggcacaagacaggtgtgtgtgttggcggagaggggaccttagaaagaacagcccgtcttcctttgtgacaagatagggaagaagctattaacgtctgtaggtttattgtcagaaaattgaggaagttctcttctgattgttttaattcgtctctatccctcccgctttgcccccttccctgccaccactccccttctccagaacattctgcttacccttcaagcttccactcttgtcacttggggcttctgagaagtgctctgcatccatccactctgcaggcactgccagttgtgcaccagcaggactggccctctcacctgctgggtgtgccttgccttcgggaggagggctcctgtttgctgggtgctgaggttgtgcacagagccaaaaactgtttgctaagtaagcaatggattgatgcttacataaacagattcagcctgcttttaagacacggtaccaccctgcaagagttaggactaagataagcgcgtgaaggattataacaaaacccctagtggggaaggaccacaaaacagagatacgcagggtgcagtggacttaaagacgcacacagtggagcagggaactgagtactgtgtgggtgatttcaggagaaactttataaggagcgtggttttgaacttattgttgaaggataggcacgtttttcacagaagaagataaagaacaggctttttatttaaatgaggtagcataagaaatggcacaggttgggcacagtggctcatgcctataaccccagcaccttgggaggccaaggcaggaggatcgcttgaggccaggagttcaagaccagcctgggtgacatagtgagactctgtttctacagaaaaaaaaaaagaaaaaaagaagaaagaaagaaaaagaaagaaagaaagaaagaaggaaagaaagaaagaagaaaaagaaagaaagagaagaaatggcacaaaaagcttatttggggatcatggggcagtctattttggctgaagtatggaacatagctggggtggtcagtccaggatgcactggaaggaccttgaatgctaaacgaagaaattctgttttatttgacttccttgagaggagccttccattttcatctttatctgtatcagaaaaagttgtggacatattcaaaaaaactattttaaacaatcttttggacatagccaagaagtagattatgagagtttaggagtcatacccaccatttacatcccagaaaccaagccagtatcctggagagtttcagtatactatccacccactctcccaagaacacattgtagcagataggtaagggctgcattgccttccttggcagtcactgacttcatcacaccatctaggggaggaaatggaaggcgagcctgcagtgtgccttctcctgcaggtctttggtggagaccagcatcaggtttcccactacttgtaaattgttatgcttaataactatttctagtcaaaaaacgttaaaaataaaaatctcttttttctttcagttaagaaaaagaagcctaaacttttaaataaatttgataagactattaaagctgaacttgatgctgcagaaaaactccgtaaaagggtaggttgatattttttgtgcaatggttttgttgttaaataaactcaggcattactcttgatttgttaaaaaaaaaaaaaatagtaagtgtaaaagaaacaacagttgaatagagtggatttttccccaggcacatgaacattccacatgaaatgaatcagatggaagagaattgctaccacatggccaaagagaaatagaactttccttcaggccagccgatgcgggtgtcagcctacctccatcacattctagttatgcagctttggggaaaccacttggctcttctgggcgttagttttcttacagacatgataatgataaatattctttctacctcctaattgagttttttaaagatcaatttaaagatcaaatgagaatttttttttttttttttttggacagagcctccacccaggctgaagtgcagtggcacagtctcggctaactggaacctctgcttcctgagtttaagcagttctcctcctgagtagctgggattacagatgctcaccaccatgcctggctaatttttgtatttttagtagagacagggtttcaccatgttgcccaggctggtcttgaactcctgacctcaagtgatccacccgtctcagcctccgaaagtgctgggattacaggcgtgagccataagtgagattaaaataataataataataataataataacactgtcaagtatcatagaagtgcaagtttttaattttatagctccttgatgcaaaaagaaaaactaggtcagtccattactcaggatagtaattggtagatgaaatgacattcttcttacttagggttaacctcatgcacctccagttttcagggtaccttatttatattttaatttgtcgatatatttgaaatattacttgcatttctttatagatattacaattttgagaacaataaattgaaactggatttaagttattcgttcccttaccttggtcatatcatctaatcatcgggtgcaaaaatatttattataatgtatttaatcatatcttcaattaatcatctccttgtttttggcggaaatttgtttctctactctgcacttgaatgtagactctgtaatgttcattagttttcctgtaataggctttttaatcagtagacattggctgcaataataaaggaacaagtgggctttaagtaaacaaacaacaataaaaacactggttaggaactaaaatgggacaagaatgtacgtccgcatgtttattgaaagtgtaccaatgagcataaaggcttttggaactggcattaggtgaggctccaaagccaaggtttgccaataaaaatagagtaactccacagaatattgcagcaaagtcattgttcacttcccttaaatctaaccacgtggaatgattcctactttctgatagtaaacaagaaagttaactgtcttgtttaactttatgaagtgaagccatctactgtttgtggtcagtttgtatttcttaatagaattgaagcaataatctttttctgccacctcctttggcaacctccactttctctatactaaatgtcatatataaaaatgggagtgcctattgcacaggtgacttttggtgtaaaaaacatatgagcagctttagagaaggattttaatgtaattatatgaatgataaaggagggctcagttatggggtattctgcagtgttgctcctttggagaagttatatttttctcaaggagcatcttgaatttataccagggaaataaaagaggaagaagtagccccatatacaattcttgcttctgaaacaacaggaagctatgttattgactgactcatcaacataattcagtcttttagggttgtttttatggctagtattttcagaggatgcaccttagtgcactggaccagccgaggccaactaacacacactccacacagagccagtgcagcctcagttcatgccttaggctcaaggactatgttacatgaaagtatgtgttcgctttttatccccccagaaaagtatagatcagattatattccaatcctctattttaaaaaataataatatttattatttaaaatgctttcctacctctggaaaaagggtttgaaatgatatactgaaatatatttgcttatttgttggaatcacttattattacagcattgtaagtgatttttgaaaaggtggggagggagtaaagaaaatgtaatcaaatacctgaaagttcacaccactggctctaaaccatgctaggaatgaagtcaacaattcctcgagggacaacatggaaaacagaatcagaagataagattaatattgttcatcagaagagctgttctgctccaagtccagagagaaacatttggctgtagatcttcataaaaggtatactgatggatgcaaaacttcctacttccccactgacatcataccagtggattattctaccatgcagctgcaggaatgtatcttattatccttccgcacagcccattggcctcatgtcaacacagtgtggcctacgtccatgtctctcccatgaactgtcttggtcctaggagaacattataagctatgttgaggaacagatcattttcaggcaattcttcaaacattttgtgtcttgcagctgagtttttaaattagaattgagcaatagtgtttggagctatacaaaaacttagggaagggaaattctttcagactaaaagcaaacacatttactttgccagccaactgaagtgaaagcaaggctgatggcccctcaggaaagtcacagagcctctgtcttgcagggattcaaaggatgctgcagacagagccaaaatatcccattattttaacagccttgacagtgtcaagcaggaatatctcaccttatcaaatttgttatgaacattgttattcttatgttttaagtctgatattagtacatttagcacaattatcattgaaatagctttgacagttgcaatttaagttgcatggggtgcatactaggctgaaaatagacccccaaaagatatgtgtctggaacctgtaaatgttatgttatttgggaaaaggatctttgcagatgtgattaaggacattgagatagagagattatcctggattatccagttgggccttaaatgcaatcatgtttcctcataagagagggacagagggaaatttgatgccgacaaaataaaaagtagcacatacagaggagaaagaaagcagtatgaagacagaattggatattggagtgatccatccacaaatcaagaaatactgggaatagacaaggacaaatattcccgtaaaacctctggatagagcacagccctgccaccatcttgatttcatcccagagaaactaattctggaaatctgttctgcaaaactgcgagagaacaaagttctcttattttaagccatcaagtttgtggtagtttgttacagaggccatcgaagagtaacacagatttcaatactgggcctgcaggtacacagaagtcaggaattgaggtttgggaacctctgcctagatttcagaggacgtgtattgaattgcctggatgtccaagcaaaagtttgctgtacgggtggagccctcatggagaacctctgctagggcagcgtagaagggaaatgtggggttggatcccccacatagagtccccactggggcactgcctagtggagttgtgagaagacggccaccatcctgcaggccccagaatggtagatccaccaacagcttgtactgtgtgcctggaaaagccgcagatacctaagaccagcccatgaaagcagctgggagggggactgtaccctgcaaagccacaggggtggagctgcccaagaccatgagagcccaccacttgtatcagcatgacctggatgtgagacatggagtcaaaggagatgatttcagagctttaaaatttaatgactgccacactggattttagacttgcatggaacttgaagcccctttgttttggcgaatttctcccatttttttttttttttttttttttgacattggcagagctagctgaggttttattttggaccaaaaaaaagcaattgaattgttttgtagctggaggcatgggcaaggggggtccccaggtagtaaactccccaggtgggctgagggctagggctgagcctcaggtgggtctcctgttcccagtgctaccctgaatagtggcctccttctcaggctctggggcagcgcaggaggggtaggctgggaggggctgccacagctgttcacttgggcaggatgtcagaggactcggacaccagcttcccatcacatgtctcgatcttcttcacaaccacggccctggaggaactggtgcggctgagggagctggagcctgcgccagagccaaagctggagcccaggccgtagctgaggccggggcttgtgaggcccccataggccgagctcagaccacctgcatagccgctggtggtcttcgtatgaatactcatgttctgcatcccagacttcagccggctctctttgccctccagcagcttcctgtaggtggcgatctcgatgtccagggccagcttgacgttcatcagctcctggtactcacgcagctgccgtgccatgtcctgcttggcccgctgcagggcagcctccagctcggacaacttggcgttggcatccttaatggccagctctccacgctgctcggcatctgcaatggcggcctccagggaagccctctggcctttgaggccctcaatctcagcctggagctggctgatgttccagttcatctcagagatctcagtctttgtgcgccacaggtcatccccgtgcttcccagccagactctgcagctcctcatacttgatctggtacatgctctcagcctcagcccgtctttggttggcaatatcctcgtactgtgccttgacctcagcaatgatgctgtccatgtccagggagcggctgttgtccatggacagcaccacagatgtgtccgagatctgggactgcagctcccggatctccttttcgtacagctgcctgaggaagttgatctcgtcagtcagcccttccaggcgagactccagctctaccttgttcatgtaagcttcatccacatccttcttgatgaggacaaattcattctccatctctgtatgcttattgatctcatcctcatacttgttcttgaagtcctccaccagcctctgcatgttgccaagctccgcctccagcttcagcttctcctggcccagagtctccagctgccgcctaaggttgttgatgtagctctcgaacatgttgtccatgttgctccgagccatcttctgctgctgcaggaggctccacttggtctccagcatcttgttctgctgctccaggaaccgtaccttgtctgtgaaggaggcaaacttgttgttgagggtcttgatctgctccttctcctgggtgcacacagcctggatgttggggtccacctccaggacaagggggctcagtaggctctggttgaccatgactgcggtgatgcctcccatgccgctggccccactatagccgcctcccaggccaccccgaaagctgctgctgcccactcaggagaagctcgaggagctgatgtgggcaccgggcccactcgtgtaggagcggctgctgaaggcccgggggccagaggtggacaccttgtaggacttctggatcaccctgatggacatggtggaggcaggagtggaggcaggcgggccgaaccaggcggagatcctagaaggagcggagaagctgcttcttggtccaatttctcccattttgaatgggagcatttatccaatacctgtacccccattgtatcttagaagtaactgatttgcttttgattttacaggcttctaagtggatgggacttgccttgtctcagatgagactttggactttgactttgggtttatgctggaatgagttaaacttttgtgggactgttgtaaaggcatgattgtgttttgaaatgtgaggacatgagaattgggagggatcaggggtggaatgatatggtttcactgtgtccccacccaagtcccatctcaaattgtaatccccataatccccatgtgcctagagagacacctggtggaaggtgattggatcaagggggcagtttcccccatgccgttctcatgatagtaagttctcatgagatctgatggttttataaggggatcttcccccttcgctcctcactcttctctctcttgccaccatgtcaggagggtccttgattcctctttgccttctgccacaatcgcaagtttccttaggcctccccagccacgtggaactgtgattcagttaaacctctttcctttataaattatccagtctcaggtattttttatagcagtgtgaaaacagactaatacaatattcgagaacatggtagaacctgtacttatattgagggaaaattcaatttctttagcaaaaccacatattacatcatttatcaggtgtcttgtcttttttttttttttttttttttttgcgagattgggcatccttgccattttcttttttttttgtcattttattatttatttatgtttttattattatactttaagttctatggtacatgtgcaccatgtgcaggtttgttacatatgtatacagtatacatgtgccatgttgatgtggtgcacccgttcacccgtcatgtacattaggtatatctcctaatgctagccctcctccatccccccaccccacgacaggccctggtgtgtgatgttccccaccctgtgtccaagtgttctcattgttcaattcccatctatgagtgagaacatgcgatgtttggttttctgtccttctgtctttttaaaaatgaagtaaatatgtgttcattactagttttctgtttgccttaatatagctttttttaaaatcttagataaaactatctttacactcaggatggaatctaggaaactctgacaaaaccacttgctgaatattaaataacaatattgattgattattcattttaatttattttatttatgtaattttgtctttctaacagggaaaaattgaggaagcagtgaatgcatttaaagaactagtacgcaaataccctcagagtccacgagcaagatatgggaaggcgcaggtattctgagacccttctccttaggacacttttttgatgttcatgtgttttgtgtgattgaattttttactcctcactattttccctttctaatttctctacagaatcagtttctcatgtatatgcataagcaagaaatacaattatcactattgcatgctgctgaatttagtaacatttttttctgctccccctccatatgacttctctctggctttgaaaagaaaataaacagtaacacttttgtcattgatttaccatcccctcatgtcccattccatctaatcccaccatacagtgttcacttgaggctcctcagagctttcagactctcagttttataactggaggttgcaagtatgcttaggaaagacctttctaaaatataaagtggaacatactttgatgtctctatagttttttccaacggactcatttcttagcagctacctttatcctcatctcccaccgtctcctttcttatctggctttttctagtttccaactcctttcatgaagcatgtcccctttcacctgtaactgcataaacccactgtatgtcagtgttttaggccctgggaatgtctgttttgcattcttttatgagatggttagtcaggtgcagctacaagaggtctcacaggacaggattaggaaaaagcaagtttattatgctcacagagacaggaggcccagcatgccaaacagggctacatgggaaagactcaaggtgatcaggggatggtaggcaagaacgaggggaaggtttggccatagcctttattgaggtttccatggaagaggcaaagtagggcagggtgaacagtttaggactggctggtttgaataatttcagcctacagcggtggtaccttttgcctacagaggtggtaccttttgcctataggggtggtacctggccctgagatgattaaagtcgaggaggcgtggctctggattggttaatttgcatatcaaaagctttctcctggctgagcactggccagctcagaattgtctagctcagggcagtctctccctagccagagaggtttttttaagatgtcaaaacatcataatatacagaaaatttaaaaataattacaatacaatacagtgaacattcttgtggattccagtggaagatttttttaattattaacaaatatttggtgaaagcccactgtgtgctaggccctgttctaagcattagagatacagccatcagtagaacatattttaaaagccctagcacttacagagtttccattgtaaaggggaagacaatgcataagacaagtaagtccaatgtatatgctttctagggctaagtgctaagcagaggaaaaagaaaacagagaacagccaacagacatgtgagggggtcgacgtggtatgaaaggtggcagggaaaggtctcatcaaggaggtgacatttgagcaaagccctgaaagtctttataaataaatatgtacttaaagaacattataaagtattaagaataaatatgttagatcatcttacctaataagacatgctgtaaagaaaataagaaaatgtaatggaatgaagagcatacctattaagatttttttggctgcaggtaacatgactgaaagaatggggcagacagcgctttggacaagttgggcaggaaaggtctctctggggagacaacatgtggctgagatgtgaggaggttatattactagcaggagctatccaggcaagagaaagcagcaagtcaaaggctttgaggcaggaaaacaatcttgggataagcctgaggaaagaaagaagggcatgctggggcagggaagcaaggatcaaggaggctgtgaccttgcagattttattctacacgtgctgagaagccatgggagggtttgtttgtttttttgggttttgtttatttgtttgtttgtttttatactttaagttctgggatacatgtgcagaacatggaggtttgttacataggtatacacgtgccatggtggtttgctgcacccatcaacccatcacctatgttaggtatttctcctaatgctatccctcccctagccccccacccgacaggccgcggtgtgtgatgttgccctccctgtgtccatgtgttctcattgttcaactcccacttatgagtgagaacatgtggtatttggttttctgttcctgtgttagtttgctgagaatgatggtttccagcttcatccacgtccctgtaaaagacgtgaactcatccgtttttatggctgcatagtattccatggtgtatatgtgccacattttctttatccagtctatcattgatgggcatttgggttggttccaagtctttgctattgtgaatggtgccacaataaacagatgtgtgcatgtgtctttatagtagaatgatttataatcctttgggtatatacccagtaatgggattgctgggtcaaatggtatttcttgttctagatccttgaggaattaccacactgtcttccacaatggtcgaactaatttatgctcccaccaacaatgtaaaagcattcctatttttccacatcttctctataatctgttgtttcctgactttttaatgatcgccattctaactggcgtgagatggtatctcattctggttttgatttgcatttctctaatgaccagtgatgatgagctttatttcacgtttgttggccacataaatgtcttcttttgagaagtgtctgttcatatcctttgtccactttttgatggggttgtttgtttttttcttgtaaatttgtttaagttcattgtagattctggatattagctctttgtcagacaggtagattgcaaaaattttctcccattctgtaggttgcctgttcactttgatgatagtttcttttgctgtgcagaagctctttagtttaattcgatcctatttgtcaattttggcttttgttaccattgcttttggtgtcttagtcatgaagtctttgcccatgcctgtatcctgaatggtattgcctagattttcttctcgggtttttatggttttaggccttacattgaagtctttaatttttgtataaggtataaggaaagggtccagtttcagttttctgcatatggctagccagttttcccaataccatttattaaatagggaatcctttccccattgcttgtttttgtcaggtttgttaaagatcagatggttgtagatgtgtgatgttatttctgaggcctctgttctgttccattggtctatatatctgttttggtaccagtacaatgctgttttggttactatagccttgtagtgtagtttgaagtcaggtagtgtgatgcctccaagctttgttctttttgcttaggattgtcttggctatatggctcttttttggttccatatgaaatttaaagtaggttttttctaatgctgtgaagaaagtcaattgtagcttgatggggatagcatttaatctataaattactttgggcactatggccattttcacgatattgattcttcctatccatgagcatggaatgtttttccatttgtttgtgtcctctctgatttccttgagcagtggtttgtagttctccttgaagaggtccttcacatcctttgtaagttgtattcctaggtgttgaattctctttgaagcaatcgtgaacgggagttcactcatgatttggctctctgcttgtctattattggtatataggaatgcttgtgatttttgcacattgattttgtatcctgagactttgctgaagttgcttatcagcttaaggagttttaggggtgagacgatggggttttctaaatatacaatcatgtcatctgcaaacagagacaatttgacttcctctctttctatttgaatacgctttatttctttctcttgcctgattaccctggccagaacttccaatactacgtcgaataggagtggtgagagagggcctccttgtgccaacagtctggttgttttttgtaaagtttgctttggttactgagtggaaaatggattatggaggcaaaagtagatgcaaaaagaatagaaggctattgcaagtgtacacaagagatgctggtggcttggactgcgttcacggccatggagatgagggaagtgggcagttggtggagctgaaaggacttgaggatggattagatgtaaaaacatcagaggaagaggactcaaggctgacccctgagtttttggttcggccagctgagtggaggataatgccagttactgaccaggaagagcaagtctggagtgatgcagaagtcaagagttcaagagtttgctgttggtcttattaagtgtgtgatgcctatgagacattcaggtggacatgtcaagtagaccattggattcacagagcctggaacttggaggaaaagccagggcaggatatcaaaatatgccaggaagtaaagctccaacagctctgcctagaggtcaagattgtcaaccctgctgggaaatggtagattcagagtgcagaaattttccagacagaggagatgctgacagcacccctatggagaaggtccatgcagacatttgtacaggacacacacaggaactaactcagctgtagataaaacaagtgaattttgttctgaactgaagatggtgaccacttgagatccagatgctcagtatcttcttatatctccattaaaaagtaattaatatattttttattaattcgattttaattagatttgtgaaaaattgattcaaataaattcctcttgtccatggtacagaccagctttagcagacagcaactgtatgatttttataaattagtttggtcagtaattctctgaaattgctaaatcattttgctattaagtaagagagagtgtgtttgttaccaaaaagatcatgcctattcaaataagtagtgttttttatcactagtattaagtcatttcattaagagaagcatattaactagagagagaaatggtttatgcaaatgctaatttaattatggcaaaaatgttttataccttagaagttttccttatatgtaatattaattgtgagtaccaaagtctaagtaaatgaaatgctcttgaaacagtgtgattgttatatttacagtcagccctctgaatcctcatgttccatatccatggattcaaccaaccacagattgaaaatattcagaaaaaaaataaaaaataacacttcaacaattaaaataatacgaataaaaatgatacaatataacaactatttacatagaagttacattgtattgggtataataagtaatctagtgatgatttaaattatacaggaggatatggataggcaatatgcaaatactataccattttatatcaggaacctgagcatctgcagactgaggtattgcagtgcggcagtgatggtggtggtcttggaactaatctccagtatataactaaggatgactgtatatccttatgtcacagtagaaaattgagatttaggcttcaagcaatatcttttatctctatgctattatgcttcaatgtgttattgctattaatattaatgtggcatacagcaaaatttagccatggtaaattaaattttaatagagtaatttaaaggaaacttcaagttcatagtagttttaaaaataaaaattcaacagaagatgggttttataggaagaaattatgactttcattctttgttagcagattaaacaattactttggaatattccaacaaatttttaaaattttgcaacattaagtcatatataaactatagtatctctcatttctaaagtagcactgatattgtctttttcttcatatcaccaaaattaattttgatcaagttccctgaacattggacacaaaatattaaaatataaactcaattcactttattatctttcacaaaccattaatgcctttgaggcagaaaatgacacatctcataggaagattggttgggtgaattagttagagtcaacaaaaggctttgcgatgttaacatcctgtaacaaatattcagtttcagtttagcttgttttatctacagatgctacactgataaaaatcaatctgcagacttttcagtgcaagtgcctatcagttttattcaagagcttataaagaattatgtgccattttagtagtgatatttttccaattctgcaagttgtaaatgttaatacttcattaaaacaaagggccctggggcaccagagaggggacaaggcatacagattatactatctctctcccttttcagattgagtttaaagatgtttattccaatctcaataaagaaggattatcttggtaggcatttgtcctcccactaatgctacagagacctccagttccaggatctttttgggcactctgtaggttcaaaatgaagagagtgaaccacagatggtttacaatttacaatgtcttttcttaacaatttttcaactttataatggtgtgaaagtgatacatattcagtagaaactgtacttcagtatcatatccaataaattacatgagatattcaacattttattataaaataggctatatgctaggtaattttgcacaaatgtaggctgattaagttttctgagcacatttaatataggctctgctaagctatgatgttcagtaggttatctgtattaaatacattttgacttacgacgttttcagcttaccatgaggtgtaaacccgtcgaaagtcagtgaacatctgtagatggttttgaaaggactctcaggtctagaactctgtgttttgcaaagttatctatcaacattcatattctggggagttaactcactataacaaaactcacaaggagctgatacctatacagaagagccagtatatgaatatatgatagaaggccatgccagcatcatgatcagtgtgggtcattgacactggactttctctcctggtagataagactattctggagaacatttacagacttccaaagatagtgaatggtctggagcatatctccatttagcaagggtgaatttccttttctaatctagagatttttatcctaccaagttttctttctcataaatctgtccacttccatcactttaattctagttctcatcatcttgggtaatttatcctaatcagttcatattatcaagttatttcattgatgtcttattttgtgaaaaaaaatcccatagttgtcttattttgtcaatttgtgctgattcttaggtttgtttgtttgtttgttctttactttgggatatgggagggatgggtcattttcttactgtgccctcaaattatggagcgatactttattttgattctgcatacatctatatattaactacagcacacattttaacaacataaacatgtttaaatattctgagaaaaaaaaatatatgctacttttagcatctagccagaatcatttttcctcgaataataggcttcagattgtagcctcctaaatctgatgagatattgatgacattttacacattctcctctctcttcctgactccagtattttactctccattctcagtttccagctaagaatgttgattcttttttcgttaagaaaatagaaatatccagacaatttccacctgatgctgctactttgctaacagccatcctctacctgtgcctgtatgttctgccttccctcctgttagcacagatggactattctggtccctgttcctctctcacctgctgaaggacatccctctaatttttgtgtctccttctgtatcatcagattttccctctctactgagtctcttgcatctccttggaagcatgctgtactatgtcccatccttaaagaactccccttgtctgcacattaccctctgccagctggctcatttttctgctcccctttacagtgaaactcttcaaaagagttatctccacctccttccatctcatgttctcttgaacctgcagtactgtggtgctccctcctttttgctgctcctcccttgttatcctgatctctaatgacctttaaacattggagttctttaggattcagttcttggaccgcttcttttctctgtctacactctcgactgcttctagcttcctagctttacataccatcttcatccttgatgattcccacacttaacttctcttactctgacctccctcctgaacttcagactcatatatgccccttcctggtcagtaactccatttggatatcttatagacattttaggtttaatatgtccaaaacaaatctcctgattctatactgcccccaaacttgcttttgccctttcttcccattctcaaggaatgacggttcatccagtaatcactgaagcccaaaccttgttcattcatggtttttctctctccccctttctcacaccctacatttagacaatcagcaaatctgttggctctgaccttcaaaatgtatctataatctgaccacttgttaccacttccattactgctaccttagtccaagccataaccatcccacacctggattcctgctggagtgttctgcctctcccagcttctcagtctgttctccatacggctgccaccatgatcccttcaatacatacatcagatcatttcaaaagcccccattgtcttcccgtctcactttgtgtactagaattgtcaatatcttgccaggccctactttacctcatggcctccattggtcttccctttcctcccctccactgcactggcctgtcctcgattcctcactcctacctccaagcctttgctcttgctcttttccctgcctagaatgctactccccaaggtatcttcataatttgctccctctcttctttcaggccctccccaattatcctgattaaattagcaactccttaccattcctacccagcactcctaagcctgctttgtttttatccacagcacttatggctgttagacacatagtacctttatttgtttattatatttgccacctttccaaaatggatgcaaagtagaagcaaaaagggctttgtcagttttgttcaatatgcctgccacatttgtagaagagtgcctctttcccagaaaacagttgttaaatgaacgaatgcatacacgaataaattaatgaaagaacgggaacttgggctggagacctgcctatataatgttagtgtgtaataggacgtacatctccatcagccccagcgtgtattagtcctgcatttatgacattctttcttgtctttagtaacaaactttaccttgtattattaaaatagtgtgttgattttctatcttttgttagttttttttatctcttgataaggagaaaaggctaacgtgtcttacatttcttttaaagcatgtccaaaagttaactttttatgaatattttgggtaattacaaacacagctagtcatgggacatttatccagtctggggacttcttctagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtaagatgcaatcaaaggtaattcagtaggaaatggcatatgttttatcttgaagaagctgaagagtgtattcttctcttagaagaattacgtgggagaaaacctgagttttacaactgatttcaagtaatgtgtctgtcctaggctcaccatctctaaaactgaaattgtaatcctaatcttaatagaggcatgcctcacagatactgtgggtttggttccagaccatcagaataaagagagttacacaaattttttgatttcccagggtatctaaaagttgtatttatactatgtcatagtgtcttaagtgtgaaataacattatggtttaaaagacaatgtccaagccttaatttaaaaatatgttattgctaaaaaatgctaacgataatctgagccttcagtgagttgtaatccttttgctgatggagggtcttgcctcaatgttaatagccagtgactgatcagggtggtggttgctgaaggttggggtgactgaggcaatttcttaaaataaggcaacaatgaagtttgctgcattgattgactcttcctttcaggaaagatttatctgtagtttgaagtgctgtttgacagtattttgcctacagaacttttttcaaaattggagtcaatcctctcaaaccctgccactgccttatcaacaaagtttatggaatattctaaatcctttgttgccatttcaacgatgttcactgcatcttcaccaggagtacattcagtctcaagaaaccactttctttgctcatctgtaagaagcaactactcatctattaaagtttgatcatgagattgcagcaaatcagtcacatctttaggatccacttctaattctagttatcttgctatttccacatctgtagttacttcctccactgaagtcttgaacccctcaaagtcattaatgagggttggaagcaacttcctccccaaactcctgttagtttttatattgtgacatttaaataaaatgtatttattaaataatagaacttaaaagtctaaattactccttgatccatgaactgcagaatggatgttgtgttagcaggcatgagaacaccattcacctccttatacatctccatcagagttcttggtgactaggtgcttatcagtgagcagtaatattttgaagggaatcttttttaaggactcaacagtgggcttaaaatattcaacaaaccatgctagatgtcctatcatccagactttgttttcccatttatagagcacaagtagagtagatttagcataatttttaagggccccaggtttttcaaaatcgtaagtgagcactggcttcaacttaaagtctccagctgcattagctcctaacaacacagtaggtgtatcctcaaaactttgaaagcaggcattgacttctcctctctcactatgaaagtcctgatggcatcttcttccaatagacagtgattttgtctacatagaaaatttgctgtttagtgtagatcacttcatcagtgatcttagctgtttagtgtagatcacttcatcaatgatcttagctagatcttctggaaacttgctacagcttctacattagcacttgctacttcatcttacacttttatcttatggagatgttttcttcccttaaatttcatgaacaaatctctgctagctctcttctccctctttcttcccattttatgatagcttgtataatttgcctaaggaatcatagctaatagattaataggtctggaataaaaaactcttcctgtgataccaaattcttttcttccttaactatagcaaaatgattcatggaggttgaaattatctgtggaaattttgtataaatgaataatagctgtttctggtactctaaaaaaaatttactggtaagatttgaccctatatcaaggaaaatgctagaaaaaaaaacatgaagtaaatttgcaaatactttgaaaagaacatcatatcatatatcatcagatttaggaggctacaatctaaagactatcatttgaggaaaaatgataccagctagatgctaaaagtagcatacataatatagaacatcatataccatcctctggactgacccaggttcccagtaccaaaggcaagtaagactagctgttagctaacttcacgataaccaggcttacaattctcttcccataacagatcatcagtcaacatggagggaaggagctaagctatgagtcactgccaaggcaggtgctcggctggcaagatagttacatggacagattattaatgtcacttaggggaggctcctatagattagagtcaaggcccaatggaccctcctatcagttttccgaggattagaatgaagaggagttgtatcacttttgtagataaataaaataggactaaagtccatgtgatgattaaaaatgataagaaatggtcagttagactaatattcatagggaccagtgcagcagaacaaaaacatgcagcacaaattcagcacagaaaaggcagggccgggactccagagaggcaatgcgggcactcgccatggacgcagaatcagcattactgcccggacgcagtggctcacgcctgtaatcccagcactttgggaagccaagatgggcagatcacctgaggtcaggagttccagacctgcctggccaacatggtgaaacctggtctctactgaaaatacaaaaattagccgggcatagtggcgggcacctgtaatcccagctactcaagaggctgaggcaggagaatcacttgaacccggaaggcagagattgcagtgagccgagatcatgccactgcactccagcctgggcgacagagcaagactccatctcaaaaaaaaaaaaaaaaaaagaatcagcattactgagttttcctcttgcctcagtctccactatggctctgcttagcactgtttagtgattctgtcactaaagtgttaacattttcttcatcatgaatgttttacattaatattgattttttaaaaggatgcattaaactagccttcacatcaaaattatgaacttttttggcatcctctgaaatctaactctgagtgcctctctggcctcaccctgtcctcggccctgggaaggtgactgcctcttccacagcaatccatcagcatttgaatgtagtcctctcagaatgtccttgagaataaagcaagttcactcgaggaggctctgaggcaaatggagacagaagattttagtgaaaatgacatggtggtgaagttggtcacaacacaacagggttcccagatgcagagtggaagggatggggagcagatggctgcaaggaggagtttgtgtccatgcttttgttgtggataataggagatttctagaagaaagtgtgagcctaggtgggcagatagggggaaggaaaggtatagaaaaggaagcccagatttgttagtgaggaaatgactagggttctggttggaatatgattggctggtaatggggcataggccgtcggatgagttggtgatgctttatggcagatggtttggcagtggaatatacagctgctttagcgtactgacactcccatcactctcctagattgtgggcaactaagccctttagataattcatggcttttttcgttgatgctagtcctctttttgcacatgttcttttatacagataattgaagctgggttttttcatgattcatgcgtgcaaagtatgcctttgtccacgagagggccccataatactggatgatgtatcatttgctccatgactaggtcattacctagagatgagtacacttgtcattcataggggatgtgtcagcagttaggtactgtcctatgtactttggtgccttttcgaattgcatacagggtgctagaccctgaagttagttaagactttttattgcttatcccctattcataaagttaataaaccaaaaagatttcagcagaacttttttttttaacgaggaattgttaactaagtttttcttgagaaggaatttaacataaaatggtaaacattgctgaatgtaaaaaatgagaatgtctttagatgtttataatcaataccatattcagtatctacttatggcagttattaataccattgcaactacattatgaaatcctactaggtacttagtaaaccactaataaagccagatttgagctggttctcaggctctggtgaatagtctctcatgacttacattctcaatacaaaagtgtacataatctgtttttatttctattttttttaaattcccacctactcaggtcatatgagaggttccctgcttaccctgcagagattagttcaactatttcccaatgatacttccttaaaaaatgaccttggcgtgggatacctcttgataggagataatgacaatgcaaagaaagtttatgaagaggtaagcatcaatcttgtattaactacgtcaaattaagttctaaggctatttgcaaattacatttattatacccagtctctctttattttaaattaagttaaaaagcatgtaagtattattatagttaacatattctaaactatgttttaacattgcttttcttcctagatcagaagatttttaaatcttagttaacacttagtacattaaagccttcaacttataattgtgattcttttaaaacttcatatttatctttccatacatagtctttctaaaattgttcttcatgacaggaagaagaatttaagttcctgtgaatgttacacacacacacacacacacacacacacagacacactttcctttttttttttttttttttggcagaagtatggtctagagagaggctatatagaacaggggcctttcaagcatgtgacataaattacttttcagcagggcactgactcttcaaatcctctggcaaggatacctttcaaaggatttctactttataacagatgttgatagataacctctaagtcacaagtaactagaaaatctagagaaatgtgacttctttaggcagtggaggaattcatttggtacagaatgaacaggatgcccaatgaattttgaagatggagaaagttagcgcctctgtaaaagaaagatgaacatgtttacttgttattctttaatttaggccctttgatcaatggttttcaagctggtgaagtctacatcaatatgctaccactcagtgatagtatgatttctgctacagttttgttttgcttttgtttttgtttttgacacgtggtctcactctgttgcccagactggagtgtaatgacatgatatagctcacctcaacatccatgtcccggactcaagcaatcctcctgcttcagcctcttaagtagctgggactacaggcacatgccaccatgcccagctaaattttaaaaaattctttagtgatggtgaggtcttcctatgatatccaggctggattcaaattcctggccacaagtgaccctcctgcctcaggcctcccaaatagctgggattacaggcacaagtcatctcaccctactccttttacagtattttttaaatgccatcaagaacagcagtttcatactctggtagggactgggtctatcctcaaagcggtactttcctctgtgtattgctattattgtgtaatgaaaatcattgaattgtgaagcagttgtctttttacctttctcataatttttatattttctgagagaacagaaataagacctttgcttttataacatcactaatagctacacagggtggattgaacctttaatgttgacaatgtgtgccatttactaaagacctattccaggtcataaattaattccatgtggaacattgcatttgttaatggccaacacataacactcaatgccctgtcttacagagtatggttaagagaagcatcatatacctcagtgaatcagggtctgtgaatgtaagaattgtgaagctataacaaacatatccattagtttgtcactgtcagaggccacaaaaatggaacttgtagaattcctaacttccttcctccctccctccctccctccctccctccctccctccctctctccctccctccctccctccctctctcccttccttcgttccttccttcttcccttccttcccttactcctcattcccttccttccttgtagaattcttccctattttctttcttctgtccctctacccctccctctctcgcttcctaccttcctgcaccctttcctccttctttctttccatctaaaaaacattctgaagtgttgactgggtgcaagcacgtttgaggttagggcaggatctgacagcatactggtttctctaatacactgtggatttgtccttcctcacctttttaaaacctcccttcaggatattcatccctttacctgacgctaaatctcagatatgtgaaacattttacttcatcccgaaaaataaaatttacctgttgtttatacattttatatcataatctcatctgaatatgcataataggatgcagaaagtctaaaatataaggatattattcaattgaatgagttttttttttaaagcatgaatagactgaaaatatgtgtgggggtcgccttttttccggtcctctcacttttaagttaataagctattatctaatggagtctctttcattaaccaaggtttttcttgatatgtttatgttaaagatcatttttagaaaacagacattgtaattttatatttttcttcatgttaatttttacttttgagtacatttataaaaatcattgatatttttatttttccagctttttgctgcttttagttgcaacaaagaaactggctttaaaatggtgtgacatcatttgctccagtctgtggctttttgcggcccctcctgggattctcttgcaagttggcaacattagcagctgcccaggtgttacagtggggagtttcatgccactcctgactcacccgccactgctcacgtatacccattcactcagccaacacacatctattaaaacccatacacactagctagagaaacagtagttcatgaaacacacgcagaatgtgcccacatgaagtttataatctggtaccaaatcacgaatttgtgttcattttaacttctgattaactttcaaatcccttccctttgtaaccaaagcacccgtcatctcttgcctgagcagggacaggtttatcctgtcctagcttgctcccccccccaaccctcaccaacactaaaacacaaccctgatcatctccctcggctttaaatcttctgtggttctcatttcctgcagcagtggtcttcaaacatgcttgatggcggcccttccagactaaaatgttcaagcaaatgcctgagatatgtttatgtacttatatgttatgtgtacatgtatgtacccacataatattatgtatatatatatgcactaatatacatgtgcattacaaaaggtacataccccaaaacaatttttaagatgatgtcaaatataaaattctatttaactgccagaaaatcttttaactcttgctgaaaaattaatatttatgattttatgattatataactttttaaaatcccaggaatgtatcacgcaaagagtttgtactggggatagaaatgtcggctgtatgaggttgtggttgtttttgtctgtgctttgtgtttgtgtatggatgtgtgtgttttatagagagagagaaagagagagacaatctgtctaatattacatttggcccttgaacaacacaggggttagggatgctaacctcctgggcagttgaaaatccatgtgcacattttgactccccaaaaacttaactactgatagtctgctgttgaccagaagccaccgggtagcataaacagtcgattaacgcatattttgtatatgtactatatgttatattcttataatgaagtaagctagagaaaagaacatgttattttaaaaagcatataattggattatttgtaacacaaaggataaatgtctgaggggctggataccccatcttccatgatgtaattagtatgcatagtatgcctgtatcaaaatatctcatgtaccccataaatacatacacctactatgtacctacaaaaattaaaaaattagaaaaagaaactgtaaaagccataaggaagagaaaatatatttgctattcattaagaggaagtggatgattaaagtttgcatcctcactgttttcaccttaactaggccgaggaagaggaggaggatgagggggagttggtcttgtctcaggggcagcagaggcggaagataatccatgcatttcaaaccaatgttgttcaaagggcaactgtagcctcaatctgggttttttagaaatctcataaaaccacttgtcattttctgagggtttgttgattacaactagataatacaacctgcatgtccattacacattcgcatataaactgcagtgagcatggtacccacgcacaaagaagcaagcagggagggcagcactgtcagctgccctggggcctgagccctgaacctcgcctcctgacagtgtttttcctgaatgggacacatggctgtccaccgtgcagatcacagtagagccacagagcttgtttcacactatttgagagacagatacaagtagaagtgtatgtaatttttttctactccccaggagattaccttgtacttgatactaaacaggaccctttgtgatttaatttgacttctgccttttctccagtctcttctgctatcaccttttgttcataatttaacaacattctcttttgcttttcctggcccactatccctttctactcactttctaatataccttgaatgccttttcctccatcatcccacacttccttttcctggtgaactcctatttatccctaaatacctttcagagcttggccccacccacactcatcctagagtgagccaggtgcccctcttatataacccctgcatgcttcgtgcctatctatagctacatttaccatcttgcattgtctacttctaaatttgtctacttctaaatctgtctccctcacttgagtgagagccccctgagaaaagagagtatatctcatttatctttctatgcccagggcctggaagagttctgtgtgttctaagatgtctagtaaatcaataaatttgttaattacttgagataatggctgtgtgcctgcagtaggcagaaatgtcatctgtgtagctgtaataattatgataatccctccatggttatgctggcagaatcatcatctgtgtcaatttagttcaatgccagaggtatttattgagctcctgctcaatgtctagcttgggaacagtactgtggaaactgcagagaagcaggatctgggctttcagaggtctagttagggaggaaagcccagcatgtactcatctgagcatttagtacaggtttctcgggcacctgaatgctatgctatgcataacaggcagtggggatgagcaatgagcaaaacagacaaaatccctgtagagcttgcatcttagtgggagaaataaaagtatactaggtcagacggtgataagtgctatgaagaaaagtgagacaaggtaaagaagttggagagtgactagggatggagggggttcagttttagtaatgcgggtaatggtcaggggtaggcttcacggaggtaagggagcttgctgtggggatgtctggcggaagagtctgagccagagggatactgtgaatgcaaagaccctgaggcaggggtatctttggcttgctgtggagcagcaagaagtccaacatgcctcagaggcttggctgggaggggcaggggcaggagaggaggccagagcaatggagaggcccagccaagggaggccttgggggtggttccaggaaccctatcttgcactcactctgagtgcaatgcagcagaggagggttgagatctgacctaggatttagcaagcggagagtggactacacagggtcagggccatgtgtgcagaggatctgcagtgaggaggctcctgtaagaagatatagagagatgatgagacacctctcttgggtcagggtagcagtggtgaaggaagtgacacatggtatgtttctgaatatattttgaaggtagtgttggccagatttgctaatcgatgaggttcaggacaagatgcaagctgaaaatgctacagcatctgcagtgtgtgttgtgtgggccccccgagggcctggtgtcccctgcgtgtacacttgatccttctgtgtaaccccattgtagtcctactgtggctgtgacttccctttttctactcagtctcaaggatggagagaagagatgggagatgcatctttccctacatgcacatgcaccgactcaaaccttctccatccttctcttttgttccataaattagtttgtctaagtagcttttcaagttgaatgttgttgttctggtttctcactattaatatttaatttagaggcactttgcataatttatctttaaatcataatgaatgcatataataataaacagtgatgtgatttatatgaaatatttacctgggttttatcacagaatattggatttgctcaccactttatcttcagggcttaaaatggtctgggcactcaagaagttttctgttgaatgaatggattgtgatgtattacaaatgcaaatctaaattttctcttaattaaggcaatgtataaagcttgtatatgaagtgatgtctaataaccattcagaattgtcttcaagtatagcaaatttaaagccattttcccttgatcactaaaaaatattgaagtcatatcaattgagagatattttgctgatttgcattgttaaagtgatgctttaacggttattgccttttcattcatttcttcattcttgaagaaccattgtgtaaatgtgcaaagcatattgagttgagaggaaatggagccatttaagcttaatgatattgccatgagacaaagtactatggtgttttcagctgtaacatcataatccaatccaagtacaacaaagctaattaaaactggttttgacagtcatctgtagaattttctaagcaatcacctatgttttctttgagttatgttctgtgttttctttgagtttaggtgctgagtgtgacacctaatgatggctttgctaaagtccattatggcttcatcctgaaggcacagaacaaaattgctgagagcatcccatatttaaaggtaatgctcactgcttctcctctcctttcatctttcaagtccttcgagttattgggacacacttgcttattccttgtagattgattgcatgcactgctgagtattttcatcctcaggatgtccaccctcagaccatgacattcataagcagcgtgggcctccactgtaaccaaaagtgtcagatgtcaggataccaaccacttgagcagagatgatttggaaaatattttattttaaaatttataaaactgaagttgttattagtttttaaataaatggcaaaggcagacaaaattagtgatactttaaatatttttaaataaagacaataggccgggtgtggtggctcatgcctgtaatcccagcactttgggtggccaaggtgggtggtcacctgaggtcaggagttcgagaccagcctggccaacatggtgaatccctgtctctactaaaaatacaaaaatgagcctggtgtggtggtgtgcacctgtaatcccagctacttgggaggctgaagcatgagaatcacttgaacccaggagacgttggagaagtctggagaacccaggagaaccctggagaagttgcacaccagcctgggcaacagagtgaaactgtgtctcaaaaaattaataaataaataaataaaatatatatatacacatatgtattaaatatagacaatgcattatatgttccttttacaagttaattatatatttactgtactcagaatagtactcttaactacccacacaaagttaggtaacaaatactggctgaaaaggtcattgctcaaaatattcaaattaaaatatgccttttttctcatatctaattaaatcctcatcaattcagcagaatcacaggtggtgtagaccagggcttcccagtagaattttctgctgtgggccaggtgcagtggctcccacctgtaagcccaacacttttggagaccaaggtgggagaatcacttgaggataagagtttgagaccagcctaggcaacctagtgagattcccatctctacagaaaattctaaaaatcaaccagatgtggtggcacatgcctgtggtcccagctactcaggcccaggaggtcgaggctgcattgagctgtgaatgcattactgccctccagcgtgagcgacagactgagaccctgtctctaaaaaatgtgtataatattaaaaaaacaaacaaacaaaaaaaacagagcaagacccagtctctaaaaaaaaagaattttctactgtgatggaaatgttttttatctgtgttctccaatatgatggccactggccacatgtggccattgagcacctgaaatgtggccactgggactgaggaagtgaatttttcattttattttaatttagcagtaatgtgtggctagcagctaccatattggacatagctaattagatagctgtaggctttttttttaagtatcaatatattccacttttatgatctctttctttcacatgacttaaatcagagatcccaaatagtaacccactgattgcaaatagcttgcatgttttatttggctggcatggttctattaaaaaccattttaattgcttgccttatttgagaatctgagcatttttatataattatgcagacttctagtttctcttgaaacgtcatatctggctcacttccctgcacacagacaagcagtgatccccccttgggatggggctgtccctggacccctgtcaagcacttcatatttcctgccagggccctgtgggcatgtgggtttctgtgatttaaagtgtctccttacatttcctttgacataggatggcttactggtactctgcctgcttcagagatagggaaagcaagagctggcctggtcagttatcaagcaaggacacttgagtgttggtcaattagaagccctcgccacagctcccttcctctcctgagtgatgatgcctttcccattctatcgtgcagcttgctcatttccaacattatgtaaatacaatttcttcctagtgaaagataataggcttcttgtgaagaggcctcaaggatgcagatttttagaaagaagtccttgacatttacatatttttaacttttgtccttctgcttttctaaacgcattctgttgctttaatattttctcttttctctttgtggggacgggaatggggttcatcaatctcaatttcagtccttgtgtgagaaatcagagaattaggtaaatgttttagaatagggatttgtttaataaaaattacatttttaaagattcaaattggctttaattctcctgtatgttttgtaaaaaaaaaaaaaatcattaaaaggtaaggacacatttgttttgaatggaaagaaataatgctcgcagttggactgccatcacttcaaacatgagcagttaaacattttggtttaggaataaaaagcctctagatgacatatggtcagatttggagagcaaaataaatgtaagagctatccagccagagaaattcttcaaaatattgaaatatgattgttcccacacagaaggtacacaaagtatcatactaattttgtgggccattccacagtgaattaatgatgaatgcattgttaaatttagctttatgacctccttttgttttggcattgcaaatgttgaccagtaacctcattcccaaagtttaatatggagatatatttttctggtttttaggttttcatacgatgtgccataagaaaagctatgtaaatcaattaatggaatctggtatttaattattttacccatactaacactgtcctttctacaggaaggaatagaatccggagatcctggcactgatgatgggagattttatttccacctgggggatgccatgcagagggttgggaacaaagaggtaatgggtatatgaatttctgattctctctaacagaggatggagttgggagaataattatttctaggaaagttagaattcaaaaaatattttgagtgtgaactttcgaaagcagtgatataaactatttagttacttaaactatctttggaacaacccaacaactccagcttaaccctttaaagaatttttgggatttggcttttatagtttctttcaagaaatcagctaagtaatcacaaaagcaatctctaagttggtacatgtctgtgtatgtttttgtctgtgtgtatctgtgtgtgtgtgtctgtgtgtgtacagagagatagaaattgccttggaaaagtattttttaaattttgaaatgaagagatgtcactgaaataatttaaatttttagaaatattttaacagtttgactagattcatttttgttttattttggacttttaaaagtagttctttttagaatgaagtctttatcagctgattcctaatcacacagatcctaatggttagttgtgtaacttatcctctgaaatatttaataccaagtttaagacgaacattgtggtgatagtaatgatagggattgacacaaaaaatgtagtagctaaaaaagttccatgtttcctttgtaatggttacctttttctgagtacagtgtctgcttctataaccataacattgtctcattaatcatgacatcgcatgctataaatttcaaaactctgtcacagtctaccatgatttacgatttatgcagccctgctggatggcaaagccctcctttcctgtcctgctttattgcaggggtgagagctgggctctccttagagtcagtggataaaagggtaaagtgagacactgaatctttgtaaccattgcatcccatgtatgtaataaagtgacatctaaggataatacagcttcaggtttctaaaattagtaagaacatggaatcatctggggaattgagggttcagagaagtgaaggggtttgtgataacgtaattgtctgctaggaacatgaaccaatctggaggtactagaggttcagataattgacaatttttgatttatacatgtctatttatctgtacctttccccctctaacctaccagtcaactgaaatggaatgagatattagaattaaagagaaagatgggagaagaaattgctgattagtagtcctttttgcatcgcatttttcttttagatgtaatcactcagaactcctttgaatgagagggataagaaagattttgctacaacatctaacactggataaatgttcatgtctgactactgtaaatgtaatcatcactaattaatttatctttgaacatttcagagtccagggcaaagacagatgaaagaagcctatgatttatctcacatcttagatgaaaacagccgttacttcaagggcaaaaagttcattactatacacttgttaagggcttgggatttgaacgtatgggactgttctaccaacttaattatcatgaatatgcaaagaacagcacagttcttgaatttaaaaagttcagaaggattcgttcttacaggagaacagaaacaaacctgtagaaactccatgttagtatattcccagcattaggtgttgagtctgacttggctgtcgtgctctgagtttgcatgtcaggaagtaaacacctttcacgtttttatgcctagagcactgctccaactctgaaagaggatggatctgcaaaaagcaaagccacagcctctgtgctgcagagactgacaagaaaatgggttgtgaggaaaatttttctaagtggtccgtttagtatgggcaggaagacgggggacaaaccatgagggtctgcagcaattcagatagcagttctcggtattcccataacttccaaatccacgttctagctagatttagtctccttctccaagtccccattctcatgtctactgccagctcagtgtcccacacgatggcacagagacaacttacttgtctttctctaaaccgtttttcctcctaggttccttctctcattcaatgatattcccgtcttcccaggatcaagatttgagtgagcttgagctcctccctctcctccttactccagtctagtcagggccagctatggagatctggttttctcatgtttttggcatccccctcaccctccctcttgctcagtcagtgctaactcctgtctttgtcaactgcgtcctcaatgatagctgtgagaacctggatgttgtttcttgcttggtctcagtttatttcaagccaccctatgctcaaaaagcctaccatgcaaaataacataacattctgtttgcacgcgatagcatttacaatccttaggcaagttgcagccagctcttctcaccagaagtgtgtctctcaggcctcactggacagtgggctccaggcagaacataccccagctggggccacttatgacagcccattccacagatgtggcctgggcttttctgggatccagtcatctgacatactttctgtctctgtctctctctctctctctctctctttctcttatgtgtgtgtgtgtgtgtgtgtgtgtgtatgtacatgtgcataaaaaccatacatagcaacgattggaagaaagtagagacaacattgatataaaatatatttaacttcttaaatgtggcccaggggctcttactgcccctgtgtcccagggcctcctactgtctattttaatattcctaattgctgattagacaggaaaattgctgatcagacaggaaatagtagagaaattttcaggggattctaacttgatctttgattttatagcaattttttattgtaaagtagtttaggttttttttaaaaagcactctagctgaattcattgggtcccctgtgtcacatattattaaaggtgatttttaaaaatttctgatatatcactttcacaattttgtttctcctaaaatttatatgacaggagagtgaaaaattgagtcctacttgatgcaggattacttactttgagtgtcagaaaagaccttatagatagtttaaacatgctgttgtaacttgcccagacatctagcatgtcgagggctaattaaaggccggaactaaaatctaaggcttccaactcttgaactacagctataatgtttgctgtttttatttttctacaataacttcttttctcactattctagcaatacactttatccttaaaatgaattgtgatgactcaaaaatggactgtcagatttttgaaaaaacaatctgttgtccttagtattattgttcacttttgccctgaaaagcataggaagtaaaatcctaaattttagttggacaaaaataaccacaatagtcaaattaatttcagagatatatgctattttttaaaaaaattagataacaattagccattttaactttctagtttttaaaggaattctggctacaacttacatgtattgtaaggaaaatatttaagaatgatttgtatatgcattcttagtttcagatattaataaaaaagataactaaataagaaaatcatttttcatagtgtttgctaaatgatataaataggaggagagtagaataagttgccaggagccccaaatgctagttcagaagatttagcctttataaaccttagtttcaacatttgtaaaatggagatatttggggttattggaaaaatcaaatgagataacacattcaaagaaagtagtcaatgtaaagtgttactgaaaatatgaggtgatattgctatcccccttcagtctcctaatgagggaaaatttgaaaagttaacattttttacatctaaagtgtatctggtgatttacaaagaagatattcaagttactatgaaatgcttatttttatttatcaaaaatacatttgaattatctctgtaaaagtaatcattagatcaggtttgcagtagtggaggggataatattaagtgtaccattagaaagccttccattcaaaagacaatggaacatgcatggtgcaggaagtgggcagggctccttggagagcatatggtgagggcatcatttaaaggagccataaagagcgtcatgctccgtagccagctgtccctgaaaaggctagtcttggaggcaagtagtatcatgttgcagctagcctaaagccacacatgttatcccttatggcagaaaaaaatatatattatgaacaaaaattccttctttaaaaatctaaaatgggctatcactgtatttattgcccactcagaataatttttcccttctgtctacttaatttaatggagggtttgcactctgacgccttggtgtgaccttcttaaatgtggacatggaaagtacatgtgaaaagaagctgcttttattttagcattctgattcagtaaatgcaaatatctttgaagaaattattaaaatcataatctttttctaatggaaatagaaaatagaaaaggccctttggtgtcttatttattcattcaaaaaataagtgctcgactccctgctggacactcgagggagaccaaaatgtgtagggcatgaatccactatccagagagactgcagcctaagggggaaaagaaaatgtacatgttcattatacaaataggtcataatcagaaacccagtgaaataacaatattttcaccagatttcaacagatttgagtacctagcagtaagctctttatttaaatgtgtcaaagtaataccttatttttaatgttttcaattttaaaattaataaaaatgctctgttgaaggaacagtttggagcacattctttctgttccttcaggcatataagtggtatgagcttgggcacaagagaggacactttgcatctgtctggcaacgctcactctacaatgtgaatggactgaaagcacagccttggtggaccccaaaagaaacgggctacacagagttagtaaaggtaagtataacttagacatcatcctcaccagatctttgtctatttcctcctcaaaatcagaaaatgtttatcataaaaaggaatgtcagggaagagatagattttatttctagtgacatttgcaaaatataatggaaaaagaattgtcatctcattaaccaaaagtttcatttagatgatgaagggaatttgtgcggaacttaggagttctcaacctttttggccttaggaccctcttatactcttaaaaattattgactaccccaaggaatgtggcttacatctaccaatataatcattagacattaaaagtgaaagaaaattatatatatatttatgaattatttaaaaataataacctcataacatgtcagtataaataactttttaaaaaaattatattttcaaaacagaaaatgtagtgagaagattggaattgttttgtatttttacaaatctttttagagtctggattaatagacaacaggagaatcctcacatgtgcttcacacatgtacctgttagagctgtgatgtcctacctcatgtagcttctggaaaactctactgtgtgcccagaaaagaatgaaaagagcacataatatctttgtattattaagaaagtagttttgatcttgcagagcccctaaaagggtctagagaactctcagatgtccttgaaacacactttgagaaccactggccctgcaactatggagagaaaacgcagttataaatattgttagaaaatgctgtggcagaaaatgttgtagcatttggagaaactaagtgattctaaatagctataaaaataattggaaggttttatattagtaggttaaacctgaactttaacggtctctacttggtgactttggtagggactggtcagaagtttacttttgctttggtaagccccctcttcttagacagtcataaaatgagactcacagttaattaactcatagttccaatcatgttgttttctactcaaaatgtaaaaacttcatgtatcttacaggttagatggcttcagggttttgacctcagactctaattgctatttgtacatggtttatataagaaaatatattctgatgttcaaacaattgattttacatgtgcaagaagcagggatgaagaggaagagtgacaaaatattgataatgttagaatctggctgatggatatgtggaggtttgtcatactgttctttcttcctttaggtatatgttgaaatttttcataatttttcttttaagtaacatctaaaataaactgtatctataagacttacaagacttcactgattaatttggtctacttggggaaaagaggttttcatgtacttagattatgtcttacttgactgtgtttattctgtatgtcattataaaagcatactttataatcttcataatccaattgtaaaataggctgccattggttagcctttgaatattttatagctcagggaaccatggcatggtgacaattaatacagattgattttttaaagttccatatccagattagaaatagcacaagaacaacatcttccttgataggtcggctacatttagcactgtcgggtttttttgttttgttttgtttttgtcaaatttcaccctccctcagattggatcccatcgaactcttctgattctgctttactatcttttattcatgatctctttgtgagttcatttctctactgtaccttttgggatcctttcaaattcaaaacacggaaatgcaattcaaacctggcttaaacaacaagaaatgttactgattgacatagctggaagcctagcagtagggcagacttcggggcagtataatcaagggaagatgttcttggctctgcacttcctccttggtcagctttgtccttgtgctggctgactgcaggatggctgccagcagccactggaagagagggggagagagtgacattgctgagctaccaccccagccgtaaatggccttctggaaacctcctggcagaccctcttctattggtgggaaccatgtctcatgggcactcacagttacaagggagtctgaaacaccagatggctggcaacagtctgaggcagccagcttccaggaggagagagggtgtacctctctatcatctaaggaccagtaatctttcctttcagtcttattgagccaatttaagtcagatttccactctagatgaattactggcagggggatatgagattattcttaaaccaacagatcaaaccctacagccagaaaaggattagtttcctctaaatcaaataaatggtttatctggaggaaggtggacgctcaaagtcagacttttgttaagaagaaagaagcatgattgattgtgtgaaggcagtctactatgggctgacatggacccaaacattgttctttgctttcttttctctttttcttgccattcattttctaagaaatcttctccactgtggtttaactgctgtgaaaattctaccaaagctatgttccccaaatggacttctcactctttctattctatgttcagctctattaaaacattaacattcggtgtgaacattaactcaccacgtaaccccttggttaatatcgttttccagctttccagttttggtcagtgtcttagtagtccatttaagctgctgtaacaaaatgccataaactcggtggcttataaacaatagaaatttactttgaggaagtccaagactaaggtgttagcagattcagtgtctggtgaaggcctgcttcctggtttgtagatggtgctttcttgttgtgtcttcacatgatggaaaagagaaggcagctctctgaggctttttttataaggacaataatcttacttgcctaaatcacctcccaaaggccccacttcctaacaccatcacattagtgattagatttcaacatatgaatttgggggacacaaacgttcagaccacagcagtcagtgattcagctttagtctgcctttatctcttaccactgccctttaccatcctcattccagacaaaattcttccaacagaccttcccatacggtagccctctttcctggaggactctttctttacctctttctgttttccttctctcatatatccttcacagccaattcctttttatccttcagatgttagagaaattgtcacttcttctaggaatatcagtcctttgcataaagccaaaagccctttatactttctttttaaatagcacactatattctaaagtctcttagttctctgagattgtgtcttctaagatgacagggaccatgtctctaatacatgatgggttctcaaaaattaggttcattgtatgaccttctataaactttcttttctctagttttttcataaatatgttagaagctccagggatttaaaaatgttactactgagcatttcttacatataagaagttgcaacagttggtatccttggtttttcctgaatgtgaggaaaattctcccttactgcactgcaccaggagaggaaggcctagagagaaagaaaattatctctacctgctattttaggagcaagggacaaaggtattcattttcttgaaattgttactgcttaagaaagaaggatatttagaatgttctcagttcctgatgaaacctcaagcatttaattgcttataaaacattgtgtaatgaggcagaacatcagaatggcagagggaatgtcttcataaatctacccctccacaaaagcactgagaaaaattgttaaaatcaacttctttagaactctgtacattagcaaagacatacaacaattagaggaatatttattgaaggaaaaagtgctgaacctgaataagaatagcagggtttgtggggtggtaattttaactgctcccaaccattcttccccagttccagggtagccttgaaaactggcaatctcaaaacactagagcagtgaaaaccatagctttccaggcactagtggggccacatcacatttttagtacctcacaaatttccatacccagagcattgtcaccattttaaacctctctctttctacctggaaagctgcattctcaggacattgttgttatttgtcctcacttgcaagaaaagctctattcccaggctattagtcaaaacaattattggcaggtattttttttaacattacaagtgcccagagcaactacaggtaaggctacaggcaatagagatttcacaaaattaatccagaaagtcagtaaacaaacaaatagtgacaacgataacaaaaatgaacaacaacgaattttatgagagggaccgaactgatttccagaattgccacattgtattatctaaaaactgtccagtttcaacaaaaattatatgacacacaaagaaataggaaagtatatacatgcacagaaaagcatgcagtcaatagaaactgcctgtgaggggccctgatgctgaacttactaaacaaaggcttcaagtcagctatcgtcagtatgttttaataactaaagaaaactatgtctaaagacttaaaagaaattattacaatgacgtctccccaaatagagaattccaatgaagagacagaaattataaaaaagaactaaacagataatctggagtcataaagtacaatatcttaagttaaaaaactcactaggggggctcaacaccagatttaagctggtaaaagaaataatcaacaaatttggaaataggttctttaagattatccatgctaaggaacagaagaaaaagagaatgaagaaaacaacctatggagcacgatcaagtgtaccagcatatgcataatggaatcctcaggggaagaaagagaggtggcagaaggactgtttgaaaaaataatggccagaaatcctccagattagataaaaagcattaatctacacatctgagaagctcaatgaattataaggaggataaactcagaaacatacctagacacatcacagtcaaattgccaaatttaaaatttattttcactttcattttattttttcaaattctaatctcaaattgacaatcaaataaaatgagattcttgaaagcacacagagaaagaggacttattgcacaaaaggaaccttccttttaagatgaacagccaacttgtcatcagaaaccatagaggagagaaggcaatgaatgacattcaaatactgaaaggaaaagactgccaaccaagaattctatatctagcaaaattaagacatttccagatatataaaaactgggagaagttaatgctagccaatatttcttgctctacaatagatattaaaggcagttctttagattgacataaaaagataccagatggtaatacaaatccacatgaagaaaaaaaaagagcatcactaaagatagtgggtaaacataaaagggataatatatgtgtttttattagttttttcttctatcttattccaaaaccaatgcataaagcaataaatgtaatatgtattgtttgtggacttatagcatagaaagatgtaatttgtatgataatagtgcaaaggaggaaggggaaaagatttatgttggagcaaaatttctgtatgcccttgaaattatgttagcaataaattgaaattgattgttttaattaaaggtattaattctagtgcccagggcaaccactaagaaaataactcaaaaaagtagggtaaaattaacaacaaggtaattaaatggcacactagtaaatatctatctgttgtaaaggaaggcagtaatggaggaacagaggaacaacaacagcaacaaaaaggacattaaaaatgaataacaagatggcagactttatcagcaattacattaaatgtaaggacatgaaatactgcaatcaaaaagtacagattaacaaaatagatttttaaaaagtgatccaattcaggtccacatgaaacattaaccaggaaagactatacactaggccataaaacaagccccaacaaatttagaagcactgaaatcatacaaagcatgtttactgaccacaaaggaatgaaattaggaaccatcaactaaaagctctccttgtcctcaaaatctgtttgcttgccagtaccccactactgctgtcaaagttactgacttctgcttatatatcttgtgtccttttcctttttgatatcaagtattttattaaaattcttatttccttgggcttttttctttcagccctgcctgtcttaaactctgctttatttaagaagaaaagcaagatcagagtgtgaatcatagaattctcagtgcatggaatctcagtgtgtgtggcatctcatggttacaactccatgctgtgtgattgtactttgagaactatatttgcaggaatgttaatttatgacttaaaaaaaaagtaacgtcaggatgaccacttgacagtagtgactgtgacattaagagagctgctgtgtgcagaaacccagagttcattgaccgtttagttgacagaccctggaacatcaagatattcttctattgtaattttcaaattacagaattgaatattatgagtcatggaacatcacccaagtattgacgtcttaaagtggaaaccctctagatttagtagctgcaacatttggccaaaatacttttagaataattacccagattttggcccttgagtgacttttaactaccatgaatagggcatttccctttttttttagacggagtctcactctgttgcccaggctggagtgcagtggcgcaatctcagctcgctgcaagctccgcctcgcgggttcacgctattctcctgccttagcctcccaagtagctgggactacaggtgcccaccaccatgcccggctaattttttttttaatatgaattatatctttactcttataaaagtcatgttgaataaataaattctatcttttaaaatacaaaaccattatattgccttaactctaattttttgtattttttagtagagacggggtttccccttgttaaccaggatggtctcgatctcctgacctcgtgatccgcccacctcggccttccaaagtgctgggattacaggtgtgagccaccgtgcccggcctctcatttccctttcttaatttttttttcaattcttatttttaaaattataaagatggcgtttcaccatgatgcccaggctggtttagaactcctgagctcaagcgatccacccacctccgcctcctaaagtgctaggattacaggcatgaaccactgcgcctggcctgatagcacattttcattcaacttacttcttgctctacattacagtgagagatagagtgcagttttcctgaaggcaggggacagtgctcagtaaaatgcatcatatgtgttttcccctttggttgaatttctgtatgcccttgaaattatgttagcattaaactgaaatagtccattcttgcatcgctataaagaaatacctgagactggtattagtccattcttgcattgctataaagaaatacctgagactgggtagtttataaagaaaaaaggtttaattggctcacggttctgcaggctgtataggaagcatggtggcatctgcttctagggaggccacaggaagctttcaatcacaggacgcttacatggcagcatgaacaggagcaagagagctggggcaggtgaggtgttacatacatgtaaacgaccagatctccaagaactcattcactatcacgaggacagtaccaagagcgatggtactgaaccgttgatgagaaatcacccccatggtccaatctcctcccaccaggccccacctctaacactgaggattacaattaacatgagattatgagatttggatggggacatacatccaaacaatatcacccctcattgtgtaaatataatttggcagctctagcactaggagtgtggagaggctattcaactcaaggaaaacattagtgaaaaatattccagtagagttttctcttttcagcttattttccttaaaattgagtaggttgttgcccaaatcacaactatcaaagcaccaagtgccttgggcttatttaacatagaaattgaaacaaaaatggattaaaatctttgctagggtaaaaatagaaaagatgtcctatagttagagaaaagccattaaagcttaagagttttgctcttcccttttcgggattaactatttgatccacactaatttagatgtaaacacacattcatagaaaacactatagtaacattgaaaataaacaaccaatagcaactcaaaactgttagagtaggtagctcgtcaggcataagcagcgcaggagagggacagacacacacacacacacacacacacacacacacacacacacaccccagaagtgttaggtgaccatcacatgatggtcaggcggttgttaacttttctctaaagtaataattggtcacagccggcaccagggaaaggcagtctcctaatagatagaaaacacctgaaactgatcagcagcttcccagtaaggtctcaggagtggggagaagtaacgcaagatcctggaagtataaccccaagccgagaggtcaagcagggcatttgatctctcagcctgcttggccctcatccaggtgtgctttccttccttcctttctttactgttctaaagctttttaacaaactttcactcctgctctaaaatttgcctcggtctctcctgctttatgcccctcagtcgaattcatccttctgaggaggaaagaattgaggttgctgcagacccatacagaaaactaccgctgataacaaaaactataattttaaatatatatatattttgagatggagtctcactctgtcgcccagtctggggtgcagtggagtgatcttggttcactgcaacctccgccctccgggttcaagcgattctcatgcctctacctcccaagtggctgggattacaggcgcctgccaccacgcctggctaatttttgtatttttagtagagacgggtttcaccatgttggccaagctggtctcaaactccggacctcaggtgatccgtctaccttggcctcctaaagtgctggaattacaggcatgagccaccacacctggcctaaaatatattttttgtatttgtttctcctgctgtctaactctgcattcatcactgagaaaaaggaaaactgcattcttttcccagtttttcagcgcagctgcttggatataaacacatccaaacagcatcataaataagttttgtgatccaaaatagcatcatatataagtttgcctttcttcatattgtagttttattacagctggaagagtgcccagtaatattttgccagtgatgtgacatagtgcattggaatgattgattagaatagcactctgtcactttccttcacactgtggcttttattaattaagaaatccattgtgtatgaatgacttcgcctagacaaaaataagacttacacagcactaaattagtggttcagcatttctttctttgtaattaaatacttgaatgttttcactggactgcttttgaaatgaaataatttgagaaagcaaaaatgtcagatttatagtggaattaagctgtaaattaagaggattaataatttatataatttacttttatgtaaaagtaaatatagtatcaagaagtactgaaagcaatttcttaagattaacataatagcttagtcttatctttctaaatcaaactttaaactgtttgggtttcgatgacactttcactgaagatgtcaacaaaacaacaattggagtgtggagtttgataattacatgatttaacggtgaactttttaaaagggctccataattagaaacagatttgttttgctgtcagctctgacactttgggcaagtccttttacccatctgagcctgtttttttgttgttttttgtttttttatctctaaattcaaaataattacctcagctcctcttctcccgtgacgttttggtaaggcttaaaacacaaaacaaaatgaagccttccatcatggatgttcctgtgtgctatttagatatgagcccttaataagagtccacacggctgaggctatagggtggcctatgatgccaattatggcagcagagcaaaggaacacagtgttttatattctttgagttatttcatacaaagaggctttttttttctgaaagcaaaatcagtgagtttttattatttgtcaatgtgggagaaaaaaaaagacctacaaattggctttctctctgaccctctttgggaacttacagcacaacgtttgatatttcagaataattgcaaactatacctctaggttggtactccatttggggttctaaaatgtctaattcagtaggtcatgatttgtctcaatatgctacacagatagatgtcttaaatatgcatatgccctttgggaggctgaggcaggaggatcacttgaggccagaagtaagaaccagcctgggcaacatagcaagacctgttgctacaaaataataataataataataaattagccaggcatggtggtgtgcacctgtagtcccaactatttgggatgctgaggcaggaagatttcttgagcccagaggtttgaagctggagtgagttatgattgtgccactgccctccagcctgggtaacagatcaagaccctgtctcttagaaaaaatgtgcatatgcacatacacattataggcaatttgtttatctctttgtcaagaaatttgttgcttatatacacataaagtttcagctgcctgagattagtgactgtggggctgctactctagcatcactcaggatgtcccttagtgcactgtttccagctggtaggtgggacatgaagtcagctccccatcttccctttaccttctctgactgatagggcggactggcttccctgcctgtctgagccaatatatgaggaatatggttctcctctgccatctgagtccttgaagccctcaggctggttgtttgtcctggcaacctggattatcttttctccttcctctcaggtgaagcaatcctttttctctcactcactagaacgagcaaaagtcatttctccaagactctcctgtcaccccagtgctagctaggtgcctcatgttatccttttccttcagcaaggatgatgagaggctgaattcacagtcagtagccagactatatgtaaaaatagaattttgacccacaacctgcagtaacctgcccaggaaaccaatcccttatctatgataaacagcccaggaaaccagcatgctataagtcagacttgcaggaagccagacttctgtatctagtaacaatccagggagctacacaatcaattctgtaacaatcagaatagccccaaatagccaggatttgattaataactgaaggcttccctgaattttgtccacagttccaacgtaagcccaaccagagagagccaaatatgcaccctcctctaatcacataggatgtcctgcttctagttagccacttctagcttccttaggccaacagcccccactcagagcatgcctgaagccttctcttcctattataaagctttcctactcctctgcctgcctttagagtgtctgccaaaacacaagtgacagtggctgactcccttgctgtagcaagcttagaataaataggctttgcatttctcacttcattgacttttatttccacaataagaaatgtcacctgttggttgggtgcggtggctcacgcctgtaatcacagcactttgggaggctgaggtgggcagatcatgaggtcaggagatcgagaccatcctggctaacatggtgaaaccccatctctactaaaaatacaaaaaattagccaggcatggtggcgggcacctgtaatcccagctacttgggaggctgaggcaggagaattgcttgaacctgcgaggcagaggttgcagcaagccaagagcatgccactacactccagcctgggtgacagagtgagactcttgtctcaaaaaaaaaaaaaaaaaaagtcacctgttttcttttatctgtatattcacacttgaaaaacaaggagatctaatcaaagtgtattaggaccagtgagagattacactttaatgctagtaatttccttagcggtgttgttagaagtattgcaaagagaatttgctgcaatagcattacagtcccatggtgtttgatgtaataacctcgtctcagcacccagggggatccccgccatcctgggatgttgtttctaaggcagattacactgctactcgtcttatcatgtttagagtataggcatgttttgactaaaatttaagcaagctgattttatctcttaaaaataagatacataattcctcaaataataactaatgacaagcatattcttaaccaattagataaaatttagtacacagtatactaatgcaccattgttatcaattcattctaactccaatttaatacacagactttgccaagaatagcctttcacagcatccctttcctcaatttagagtcagaaactttcaaggaatgtataaaactctgggacttttctcaatttccagtgtctgttttctcgatgcctctttttcttaacagctagtcacaaacagttactaacctaatcttgcttatgttacactgaaccctaagagttgttttgttcacatgttaaaaacagctcttcctgcatttcttcaaaactgtgttttattttgctcctgcgaatttaccttttcctatgttgatgtgaatatattcttgatccccttccatctgctgtttgcttttgtagctagagctttttcaaacttgaagctatataagtgttatgggctgaactgttgcttcccacaattcctactctgaaattctactccccacgacctcagaatgtgactgtattaagagactgtgtttgggtctttaaagagatagtgaagttaaaaagaggccattagggtggaccgtagtccaatttgattggtgtccttataagaagaggaactttggaaacaaagagagacacccaggatgcatgtccgccaaggaaatgccacatgcagacagtgagaagttggccctctgtaagcccaggagagagccctcgaaagaaaccaaacttgctgaccttggtcttgaacttctagcctccagaactgtgagaacagaaatttctgttgtttaaaccacccagtgatactttgttatggctgcccttgcaaattaccattagtgactttccttcgtaaatcccgttactgaaatgtgtactaactgcctcagcaaaaacttttctcggaatggtcctattttcccacatacaagaaaatatttaaagctcagaccaattatgattgattagaacaaaattaaaatggtttaggtcaaacctcaagtatcacttgtatcatcatctgagtgtgtcatgggattgaggatatactaactaagtgatgcaaggaaagtgtataggccaagaggcaaaaagaaaccaggtcaacaagaaatcaatatatggattagcagagtttgattcaaaatgtaaaatatgctgatacttttttttttactttctactgcatatctctagcatgtggaatatcattactttgagtttgatgatctcttaaaaacgaatttgaaagactaataaggggttttgccggctaataggattttctttctaagcatcactagatggttggattacatattacaagatttgactagtctaggagaaaaggaggtaaaagtaaagaaagaaaattcaattattagagatatatagaaaatatgagtgggctgggcatggtggctcacgcctgtaatcccagcactttgggaggccaaggcgggcggatcacctgaggtagggcattcaagaccagcctgaccaacatggagaaaccccatctctattaaaaatacaaaattagctgggcatggtggtgcatgcctgtaatcccagctacacaggaggctgaggcaggagaattacttgatcccgggaggcagaggttgtggtgagccgagatcgcgccattgtactctagcctgggcaacaagagcaaaactctgtctcaaaaaaataaagagtcaagaaggattaaacaaactgagcacatgcatttaatagcaccccccacctgaaacctcacttaaatgacaatacaagaataaaatggcacaaattgtattttttaaagggagacaatagcagatgaacagtgtcagcgtgtaattttgaaagtggaaaacagaagtagatgatttggcagatctaagacagcagaaactgtagcaattacagagaagcttccaaagaagaaattcaaggcacctggtactacagcaattcaagaaactgcatggcctcagagaatagacttatctacgctgacattttaggatccccaattaaaaaacaaacaaactggcttgacaatgcacccaacatggaggcctgtcagacacaggctctgccctttcacaagatgtccaattgtagtctcaattttataggactgacagccaaggatcacgaaacattaaggagatttttaacacgaaagatgaacaaaacaaaaagaatgatgtagcttgtgggaaatcgagaaaatgtagggaacaaaagaaaaacaaaataatacctctaatatactcagagcaataagagaagatgtgtatctgtaaaacaagtatgggatactgtaaaaaggaagaattgaagacccagaaagggctctcagaaattaaaaagtgtgatttgcagaaataagaatttaaagcagtattagaagctaagttaaggaaatctcccagaaggaaaaacaaaaaggcaaagatggaagatagaaaacataggatgattagaggctcaatttaacatagctgacattcagataaaaagagttccagggagaataggcaaaaaaaaaaaaagaagaagaaatgaagaaatgaataatattagaagatagttcagaatagaaaaaatgtgagttttcaggttgaagggtgccactgagtaccctgcctttacattaaggcatattgccatgaaatttcaagaaacaggaaagaaagagaaggtcttaaaatcctcatcatcatcatagctatacttgcatatagtgcaagcacttttcacacatttaattcttaaagggcctcttgagaaaagctttataaactaaggcacagagataagtaatttgccccaaatcacacagcaaataagtggcagagtcagatctccaaacatgcagtctggctccaaattttatacccctaaacactatactatcctgactcctataaagcttctagagaaggaaggataggaagagggagaatctaaaagtcatcaggtttccaacagcaacactaaaagttataatgtaatggactaatcctttcaaaattataaaaagacattcctcttggcaataattttgtggatatgacatggaaagcacagacaacaaaagcaaaaatgaacaagtgggactacagcaaactaaaaagtttctgcacagcaaaagaaacaataaaatgaaaaagcaatctatggaacaggagaaagtatttgcaaaccatatatctgataaggggttaataaccaaaatatagaaggaactaatgcaactcaatggcaaaaaaactgaataacccaatttaaaaattggcaaagggcctaagtagacattttttcaaagacctgcaaatggccaacaggtatatgaaaatgtgctcaacatcactattcatcagagaaatgcgaatcaaaaggacagtgagatatcacctcatacctgttaggatggctattatgaaaaaaatgaggtaacaagtgttgatgaggatgcaaagaaaagggaacacatgtacactgttggtggaaatgtaaattggtgccataatggaaaaccatgtggaggttcctcaaaaaattaaaaatagaattattatacaattcaacagtcctactctaattatatatctaatggaaatgaagtcagtaactcaaagaggtatctgcacccccgtgtttattacagcattatttactatagtcaagatatggaaacaacctgaatgtctatcaacaggcaaatgaagaaaaactttagtatataaacacaatgggatattattcagcctttaaaaagaaggatatcctgccacatgcaacaacatgaatgaatctggaggacattatgctaagtgaagtaagccagatatagaaagacaaacactgtatgatatcacttatatgtggcatctaaaaaagtcaaactcatagaagcagagaatagagcagtggttgcctgggagtggggagtgggagaaatggggacatgttggttgaagagtacaaactttcagttataagatgtatatcaactcattgatatatattgccctttgccttgttcactttgaatatattcaatctctgtcaactatacatttttaaaataaaaatagtatcacactagataacaagaaaaaaattataaaacaaaattatttactaactaaataaatttacaacctaaatacctaaccatacacactcaaaccttcaatcaggtataagagcttgagacactttcagaattcaattttacctgtggtgtgtccttcctcaggaataactagaatccagtaattagggagcccagtaccaggcagaggccaaggggagttccatggccatcatcatctagcaaattcagacagtaactgatccagatcagagcaaggcaaatggctgcgggagggttatcttcagaaaaagagaaaaagcaagaaagtaatcaatttataatgtttttggcaaaaggtagaataaaagcatcaagggatttaatagcactctttcagagttagtgaagaaatagtatgaagtgcattacaaaataaagccaatgaaaaggggacagaaaaaaaatgctgcatgtgacatgaagtgtaatcattacaactcaagtatgaatgatacctgattgtcatactattataaaacctgaatgtgaatttgcactgatatgaaagatttgtgaaattaactgtattacaaggatggagaaggaagacattaaattgtttaattgttaaccttctataatagatgagtgataatgcctcaaattaataaatcaagaatagcaatataacaggctatttagatataagcaggttaacaacagaagaaatattttaaataattagccgggagttatactgaggattggggaagagttggagaagagactgcaattctcattataagacctgtagtaatatttgactttaaaaaatgtgtattttttaattgaacaaaaacattagtaagaaaaatagttaaataaaaatgagttaggctttagtttgcttctcaaaagaaagactttctgcaggaagtcaattttaagagaagattttaaaaataggacttaatttgatgttacagagaaaagtacagcatccaggtggcatgagcaggctgtctggggagatgaggaaactgctcctaactggatgcaggtctgggattcaggagagctggggcaggatgtgggattcatgaggtcagaactgggaaggccatttatagatgcctagagtgaaaaatatagctaaggtgtaactggtgaggcacatgctgagatggctttatgaagccatgtgctgccgtagaaagaatcaaacctgtgctttctaaagtctcttttgccacaagaagaaatgggaattagaaactggtgtctttcgggcaaccaactgaatactgatgcaattagtttctctttcagttttatgaaatagatgagtttagagtcaagggagtaatatttcagaagaggcttttaaaaatgtaggcattgcctgctgtttgtgagccttcaggttttctgttggaatttcctaaaaactggattatttgccattgaagacaagtgggtggtattagtgtagagaaaattcatattctctctccctctccctctcttctgcacacacatacgctgatatggtctgaatgtttgtgtctcccccacattcatctattgaaatttgactcccaaggtgatagtattaagaggtggggctttgggtgatgattatgccttaagggcaaaacattcatgaatgagattagtgcccttacaaaagagtccccagagagtttggttgtcccatccaccatttgtcgaggcagctagaaggtaccatctatgaaccagaaagtggccctcaccagaattgaatctgcctacatcttgagtttgaacttctcatactccagaactgtgggaaataaatatctgttatttataatctacccagtttatggtattttgtttttgtcctgaatagacatacacatgccgagtgtaattaggattgatctttaatttcctctaaccatgtgaatattatattacgtgattccttggtttgtgcttaaaaacagcattcttaggtcccatcccggatttccccccagtgcccctaaaggcccctggtttgtctttccaaagttggaaaacgccttcaaacacatgtcatcaggtttaactggtgggattttttggttccctcagttttccccatttgccaaagatgttgaactgtcttggtggcatgccctctgcagggcgctcaccagggagcatgttgctctctaagcaccttgcaagtgctcctgaccagtacccacagtcacaggtacccagtaaatctctgagaccaggaggctggggtacctcgcaattgctcttttgctcgaggggagcagggccccttgagtccactgcagcctgaaatccctgtgcctaaatgtgaccttctctaattgaggaggagatagtacagaggggttttggcaccacctgtgctgaccaccagactgtgggatttaggctcattaaccacacaaggagtcatttcatcatccctaaactgaagaaatttcagctagattaacagtatggttccttcccaatgtaaaattctgtaagaaagtattgaactcaaaagagaaaataagcgactgttttataatcaaaatggactagatagtactgagttagtagtactagttaggactgagaatgtctggtggcatattagggcatgtgttcagagagacccttctgcaccagtttgccccttttgagcacgagtctgtcatccagtacatgtgtgccacatataacaaggaaaagccaaaacatttcttaaaaaattattactattcacgaaaagtaccttggcaacacttcccaggggaggctgtgggtgaaggggcaggaagggcaatgtttcatatataaaagatagtctattcttaagtaaaaaatgttaaattatattgagtgatgcaatcactttaacatttttccctagggctttgtgccctatttttagtaacaaaagatcagctgtttccaaccatgcccctaaatcagctttaaagaaataaaagaatcttctaaaatatcaggagggaataaaggaataggttgtccttataaggcaccaataacctcatttgaaaagtaattttatgtgttagaggagcaattcttcccttgtctgtgtgtcaatttaacaagaatgtaacagatttatctagcaacttaaacaagtgacaatatccagagtgagtgttggcaattgaggtgcatttgggaagatgtgaacatacagcgaaatcctagggtgcatttttttcttttccatggtcttggggttttttacaaaatggttgtatgctctcaatctgtggatctgacaaagtaagggcttttgaatgtctctttattgaaatgcgatctttgccctgttcttcatgaactgcccacttgggatgaagtaatatggaacctagttggtggaacagagccctaaacatggataaatgaccaggacaacgccaagctgggcaatggtagtagcaggtgtagatgtggtcaaactatgcccccagttggcaaacaagatgaactccctctggctcaaaagttaaaagcagaactaagaggccatgtcaaggtgaggaggcagtcacgctctctgtgtccttggaaggtgtttcagaatttgtttttctgcaaccaagtcaaagaacagtttttgaaaacaactacaactggaaattcctccatctgaccaccaacaagaccacctagcaccaacaagccaaccaaccacctggaaccagccaattaaccaccagagactggtgatctggggctgaaaggccatccagccaacattcttccttgctcccaacactcctcacctgccctgccctgcagttttggcctttgtcatctccttccccccgccacccttcctgggagtgtactttccaaagctgcatctccctaatctgcagattgcttttgaaaaataaagttctcctttggcctccccacatctcattggtcttccgttaacaatattaacacaaattaatgcatacatatcataaaattataaaatcaaccaaaatctctttcttgccctagaatattttaatagctagtgttttcatgtgatataaaaagtattcccttgtttggctggggctggcaccatgtttccacataaatctctgtctatatcacagccttctggctctgcagccatcctgattccatatcaccttcttatgtggaatcatgagtttataaagcaggacttggtaaaaagacactctacacattatctcgtgctttgctctaaccaataattgatcattttgcttgaccaattcaaatgatagagaaccatgatttacaaagaaactcaatcaatctttagaatattctactggttttccatttttccataaaaatctgttttttggtttgtaacctattagttctagtcccatgctcttgagtcactgaaaatagatctgcccctgattcttgttgaaatcagctaacatgttcctccctgtccatgaatctatatactcaactatttcatccatttctcatagaacacagaaatgattgaaattattaacatttcaaaattctggtgtatctgtacagctttgtctctgtcctgaagtaggaaagctgtttttatgcttgtctcctgatggaaatccatcttagtttgctgctcagatcctcacctttgccttctcccctacccaccctactgtcccccacctcccactcctaatcaacacccagtgtgatggtgcagattgcccagaggatcttccacaggatctaccgtcacctgcccctccactcctagtctctactggtcataagctccctttctggcaggggctaaggctccctcacaaatgagaagtcaaggaaatatttttgtttggctgaattctaaacactagtgcatttatttgttttggtttgctgttaatgttatatatcaaaaatcctccagtggatactcttctgatatgttgaatgtttaacttatattgaccatctttaatggcatctttgtgaggaactctgttgaaaggtgaaattacgtctgtgatttctgttccagtttagaggctggagtgtcacatggaagttattacagtgtactgatgtaatctgatcaacaagatcagtactcttcttaggttgtggtttcaaaaaaaagtctttaggcaaaacagattgtggagagggttattctgtgaagtttctaggagttattgaaattgttatgttataaaaacttttggtttggaaaagtcatgagatttggggtttttatagctgtgacaagaagtcccagaggaaattgaaatataagcaatctagataaggcaaagaattagttcctttctgagacgaacctcaaaaaaaacaagagtcattatgaggtgctccaccaggccctttttcagtccagtaaagccagaatcttccctctagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggtgagtttctgacttctagatggttctctgcagcccaaacctgatgggaagtgggtactgacaagagtcttctggtgatgcttcccagagctgggattcccaggcttaaacgaggggcccaaaaaaacctagatttttgaaatccattcattgtttttgaaaactacatctgagcccttatttgtatgtgtccaggtatattgctgtgtgtgtatatccatgtgtgtatttggataaatattcatgaatagtgttctgatttttctggtctttcctgttgaatgatgtgttactgactgtaaccctactgtgtaggcataactgaaaaatctagcaggtgttatcagtgtattagaaagttatgtccctgagcatcatttgctcctataaaatggaggtgacgttgcatggcaaaatgatatcaacacggatgatggtaaaaatggtaacacaccagctggtaaaaatggtaacacaccagagtgacaagacaataataactgctgtctcagctcttcaggaataggaagtggctcatactgaacttcatatttttttagcttaacccaggtacaggcacacatatggagctccagcgtgtgtgtatgtgtgtgtgtgtgcgtgtgtgtgtgttttcagtgaattgatatattcatctatctttaaaatgaggagcatttaagactccaattttctccttgaaaagtggagttagcctggattaacaataactatataaaagtaaatttattttgaagactaaacagcacgtgctgcatatcttcagctacagaaaacaaattcagattgtaatatgcatctaatttacactaaaggacaaataaggacagtggtttatctcaattatgctttcagaatggtttctatgtaagaataagaggaactactttagtaatgttttcagggatacttccatctaaagagagagaaccataaagaaaagtgtctatccactttttgccaacaagaattttttaaatggagctatacaatccatatttgggcaatatgctaatttacctctgacatgtcactaagatgagtccattctattggcacttatgtgttcaccttgtactttgattccattaacatccttatgcatcacagaacctactgggcctcctagagcaatgcttcagaatagcaggcatcctagcactaatttctagaaactgtagtttctgccaaaaaaaaaaaaaagtatttgataaaattaatatgcaaagtattataggatataaaaagcattaagcaagaaagaaaataaattatggagtcaataatgttgttggaggtaacattttgtcttctacattttcacataggtggaatatacctgattttccatgaactacttaacttcttagaatgtgttttactttcttagtatctttgttaaattcttattcccattgaatggaatttacatgttctttctttctctttcttacatgtgatagaattgtgtctaccctgttgtttaaaaaactcataaaattatttctcacttacatgattatgattatattttctaattcctgaatttgtattttctcttccttctcctgttcttttttgttttgttttatttttcttttaaatattttgattggaattccttagtaaatttattttcattctttcttattaataatagcatttaaagctatgcactgacctacagttacaggtttggatgtattccctacactgtaatatatggtatttttacctgagttattttcaaaaaaagactgcatttctgccctggtttccacattgacttaaaatgatctatatgtatatgtgcctgtgtgtgattgagcatgtgttttccaatctgttgtagttgcttcaacattgattgattgattggcaggatcttgctctcttgcccaggttggcgtgcaatggtgcaatcctagctcattacagctccaactcctggcctcaagcaattctcctcccaagtagctaggactacatgtgtgcgtctacatacctggctaatttttaaatgtttttatagagatagggtctcactatattgcccaggctggtcttgaactccttggcttcaagtgaccctcttaccttggcctcccaaaatgctgagattacaggtataagccactccactcagcctgcttcaaattttaaaactgaatttctagttttattttattgtcataaagggataaaattcacatagtttcccttttaggaagattttttaaagttctttatggtctttggtttgtgattccatgcttctagtgggggaatccagtaactattttctagaaacaaattcatagtttaaagaataaatttggggctcggtgtggtggctcatgactgtaatcccaacactttgggaggccgaggcaggcagatcatttgaggtcaggagttcaagacaagcttgaccaacacggtgaaaccccatctctgccaaaaagacaaaaaattagctgggcatagtggcacgtgcctgtaattccagctactcgggaggctgaggtaggagaatcacttgaacccaggaggcagagattgcagtgagccgagatcatgccactgcactccagcctgggcaacagagcgagactgtcaaaaaaaaaaaaaaaaagaaagaaagaaagaaaataataagtgtgatggcaagtactatcgtagcttatgctgaagcaggatggcatccatgtcaggtgctgtggttcagaaatagaggagaagaattctggagtggaagggacaggggcggacgtcatagggagggaggtgagtgaccagtttgcttagccacattgagaactcagattcagagaaaaaggtgatgaatatctggctcagtaaagatttagccgttgtctagttagcaaatcatgctgctgggtagtcgaatgcctaaggctgatgctggaagttttgggaagtaaaattacggtaggtctcttctatggactgaactgtgtaccccgcaaaattcatatgttgaagccctaacccccagtgtgactgtatttggtgatagggcctttaaggagatagttaagattaaatgaggtcataaggatgaggccctgacccaatataactgattccctgataagaagcggaagaaacactgggtgtgttagtctgttctcacactgctatgaagaaacactaggtaatttataccaaaaagaggtttaattgacacataattccacatgactggggaggcctcaggaaacttacaatcatggtggaaggcacctcttcacaggacagcaggagagagaataagtaccaagtgaagggggaagccccttataaaaccatcagatctcgtgagaactaactcactatcatgagaacaggatggggaaaaccacccccatgattcagttatctccacctggtccctcccatgacacatggggattatgggaactataattcaagatgagatttgggtggggatgcagccaaaccatatcactagggatgagaaaatgacgtgtgaggacacaagaagaaggtggccacctaggagccaagaaaagaggcctcaggagaaaccaagcctggccacaccttaattttggactttcagcctccagaactgtgagaaaatacacttctgttgtttaagccactcagtctgtggtatttgcttgtggcagccctagcgaactgatacagtatccaagtagtttcattaggactgaactatgtttttttaaaggactggctttttagagttgaaggaaaaaaccagaatcagcaaatataaataatgattttgttccccaaaaataactttttaaattgttatgtgaatattatggaacgtctattttgctcttatcttaataagtgccaccaacagtgattaaaatatgccacacatgtgcagtcatttttttcttccagagcccatgggaaaggtgctaactgaccccaacagcctttctgaataagctgaggctgaacctctaagtccttctcaacgcagtgttctaggtggctgctagcaactgatcagaattgtcatgcaagatggaacctgttgttgccccagaagcagagccttgaaatttataaaagatacaacccaggatatcagttccatgaatagccctcacaaagtatattcatgtgtaagaagtgataaatttaaatgattcttccagatttgcattggctgttagatctctttctagagctattttcccaaagaagcaaggtttattacttcttgagggttagtttaacgctggtgagaaataatcaaacgacaacaaagccacagtgagttgcagatgctgggcattcctcttcaggctgagttaactggtttgctcctgcacagctgccttctaacttacaatgcaacaaaatgagaaattatgctttaaagcataggctttggaaaccaacaatcctaggttagagtcctggatgcaccgcttgttagctgtgtgatgtgtgcatgtccctgaatctctgagcttcaaatccctcatctgaaaaatggcaaatagtgcctcaagtatggggttgttactaggatcagtgagcactagatgaaagacttggcacagttatccaatatatgatagtaatattatatttttatggtctaacaatagcacatgatgtaataacagtagtggagaggtggtctctggtctggttaagagcatgaacactgggtccagtctggctgaattgaaattcctgctctgctgttcgctatgtgacccctctgtggctcaattgcctttctataaaatacaacactaattgagccttcttatgacatgttgtagacatcaaatgaggcactctcatcatgcagagtggttcctggcctgtcgtgagcatcaaggaactgccgttgcattccttggaccctcatgatcagacgtgaagagttaaaatgaccagtgacagtgcatgaatgcccagagtctactgcacagagaatctgggtttacagaccagaaagataaatgtgtctaaagagctagaggtgttctctaattccttgaaaatctcagggacacaacccatttggttacccattcatcacctgtcattcaggtaaggcacatctgttctccaggtagcacatgctcagccacctggtgcttgtgagaactccaggccacctatggttgttccccaagccaccagtttcacttaactgctgcctggacagcacagagctcagaattggggactcctgccaagcagccccaggccctgcataccagaagacttggaaagcccaggctcaaaaacactttacggtgactcgtaggtttatgtaatattcacccaaactgacatttattgttcatttggggaactccattaataactaaaaatagcaattaacattttattcaattaagagccaaaaaggttacttagaaaaagctaagttgttttctaaaacattgagctccatttgattggggtgaataccttttagttgcgttttttgtaactcttattttattctcagtatgtgattatcttaggacacaattaacattaattaaataaaattaaactcagctttagatgtagcagtctcttttaggaatcttgaatagggaattaaaatgtctctgacttttaaaaatcccattgttttactcccccgttagagcagatgacattgtgtacattctgagcacatcttccctaataagcaggggctttatagagtgtaaagaaatttgcatagttcaggatacttaaatgacatgtcccagaatctgtgctcttgacagttaatcatagaatatgtcccctctcaaagacgccttcttcatttaaatcctattctttatcatcatataaaggatgatctggatatggaaaagacattgaagtccaataaaaatagtgttttggcaactaatatagtcctagaaatgcatttctaagttagaaatataatataagctattttccttctttaggggatgtattagtttcctgtggctggtgtaacaaattaccacaaaacttaatagcttaaaacacagacacatttattatcttatagttctagaggtcagaagtctacaatagatcacactgagctaaaatacaagtgtcaccagggctgtattccctctggagtctccagcttctagaggctgcccacattccccggcttgtggcccccttccatcttcagagccagcagtggccagtcaagtctttctcatactgtatcactctgacacttactcatctgcctcctcccacatttaaggatgctgtgattaccttgggcccatccaggtaatcttggataatctccctattttaatgtgagctgataagaaatctcagtgccacttacagccttaattccctcttgcatgaaagacaacatattcacaggttatgggatgagggtatggacatcttttgggagctaactattatttttcctgtcacaggggaaaaaataagtacagttggcctttgaacaacgtgaatttgaatgttatgggtccgcttatgtaagaatttttgtcaatatattggaaatttttttgagatttgtggcaatctgaaaaaaatttgcagatgaaccttatagcctggaaatattttttaaaattaagaaaaattaggtatgtcatgaatgcatgaaatatatataggtactaatctattgtatcatttactatatatatacaaatctattataaagaaataaaatttatcaacatatgcatggaagcacttacagaccatacatagcaccattcatagtcaagagaaatgtaaacaaacatgaagatgcagtgttaaatcataactccattaaattaactgtagtacagattatactactgtaataatttcatagctgcttcctgttgctattcggcaagctcaagtgttttcagtatctgcttaaaataccatgtgatactgtcgtctccatgtgagcagttcctctctctggtaaattgcatatcacggtgaaaagtggtctcttatggttcttgtgtatttttccttgtgtttaatgcaatgctgcaaacctcgaataacaccatgggacctatacaaagagcaactaatgatgatggacacgctgccaagaagcagagaaaagtcatgaccctacaagaaaaagttgaattgattgatatgtactgtagattaaggtctgtacctgtagttgcaggccatttcagacattcaattcatcttgtaaacagatgatgtaaacttatggtatcgataaaataccgtacagtactgtaaaagtattttctcttccttattattttcttaataccattttctttttttcagcttactttagtgtaagactatagtatagaatacatataacatacaaaatatgttaatcaactatttatgatatagggtaaggcttccagtcaacagtaggctattagttgttaagtttttggggagtcaaaacttaacatgcatggaggatcgaagcccctaatccctgtgttattcaaggtcaaaggcctttaacctgtgtcttgtctgttagacattcttagtcaaatagtccaacaccgagtgaagaatttggatccctgctctgccagtcactacctattggagcaagacacgtcttctttattgataaatttttatttatttccaataagccttttgcattcctacttcatcttctcatgtttactcaatcttctcattcctgcagtgaggatgacatatagctctcacctcatctaaatgggataagtttaagctttactgtgatttgtttccaacaattatgttatttattctaggaagaagaaatgaaaatgcctgcaaaggagctcctaaaacctgtaccttactagaaaagttccccgagacaacaggatgcagaagaggacaggtaccaagagtgtcgtgctggggagaatacaattaattgttaggaataagggcgtgttgacctttacaaagaaatggttgtttcctttggcccaatgaatgcctctttttacatgccctttttactgaaacataattttatgtggttgacgtcagaattgagggtggaaaatgttcagtgtttatagctttgtggaaaatgtgagtgcttatttttagttccttcacaaagaaataagacttgaatataaatattaaatcttacaaaggctctaatccaaactgacagtaattttgtactgtcaccttaacttagcagttcctccacaccttgataaatggctgaatggagtgtcatgttttctatgcagatcaaatattccatcatgcaccccgggactcacgtgtggccgcacacagggcccacaaactgcaggctccgaatgcacctgggcttggtgattcccaaggaaggctgcaagattcgatgtgccaacgagaccaagtatgggtcctctgttatccgtcatatccgtcacctcagaggatgagagtttgttacaacacagttgtgttcctttggattacttatcttcttttgtagctgaagtagactggagcaaagtgatattaatccaaactcttaagtctatatcccttcttggtgctttctattagcctggagacattgcccagctctagggctgccctcctccattatttctcggcagagtacttatctagttgaggagctgccttgtttctctctctgggtagacagatgtgcattcagagtcagccaacatgcattgagccctgcagatgttatgcattgtgcttcctgctttgcaacttgacttattcatgactacaagaagtacccctaactgaagaactcaccccatgatatttatacgttttgatatagaggagatggtatggtgcaatggaagctggctgcctttttcaaatcccagctctaacacctaacctgtgtaaccttggctagttacttaatcccttcaaacatcagccttcttgcttataaaattggcagtgataacatctactttgcagggttgttgtatggattaactggaataatgcctataaggtgctcagtccatgttctggtatcagtcgggacgtgatgaatgttagatctcctctccctcccttgcgtgttactttcctaatcctgacatgtttattcatgatcttttgaacaaaccatacttgctctggcttctgtacctatgatgctgataatctctgtccctagaatgcccgtcttttcacctgtccaaaataaacctattactaagatccaatttagttttataaaaatagaacctctcagagtatatatcctcagtaatcccattcctatcttctattactctttattcattaatatatattacccttatctccatagcaagctgtatgtaagctcctggagatcagaaagcaagttattgttgtcttacacatttcttattgttcttagtagaggtctgagtggaggatgagtgttcaggggtctgcagaattgtctatttgattattggcagataactgccctgggcagcccatggtgctgtgggaaattcagagatgactcagaaggggccgtcctcttctgaggacacctagcaaggtgtgtctgctcaggaagataacacaagattgaaggccaccgtggtcatagaagaggtactacagatggcctctctacagataagctaaaaatactacagatggctccatgagcaggagcctcacctgctcacagacactcaacttgcagagtggtggtttttaaagacaagaaggattcggacattgaaagctaaagaggggtattctggaacagtatccattaaaggcacagaggccaaaaattatggccacatatgaagaatattgaataataattcagcagccagcagtgtatggtacataaagaataaggttgcaaagtgaaagagtcttttagaaactaaatcataggaggctttgaatcccaaactaatgggatcagacctttgttaggaagttactgtggaacccatgggtgaatcctatggggacagtgggaagaacaattagcaggctgtcacagcagcccacccaaaagataaacagagctggaattgggatgctggaaagaaatggagactagagagcagatgcaagaggtgactcttgaatgtgtgatacaggaatggggcatccaagatgctgctgcaattgcagtctttggacagtggagggtggcgatgcttgagcaaaccttgggaatttgggaggcatgaggcaagttcaaggaaaggaagatgaatttagtgcttatgtattttatttagttgctattggaacacacttgtagaaccatccaggaggtggctggaaatagagacctggcactcaggggagaaggtaagtctagagataaagatttgagagtcagacttatcaggaacttctagaggaagcttgagacaatcgaaggatgacagaaatgaaaaggttccatgaaaacatctgtatttagaagacggaaggaggaaggagaaccaagaaggaaatggggcaagaaaggcaaaatcgggtagaccaggaggaggaatcagggatcactggacaggcagaagtttcttcaggcatggaatgaatcttgtcttacactgggaactcggtttgggtcttcagggtctctctgccaaagtgaaaaggagcagggacacattggaggatgcaaggaattcagagaggaggttggagaatgctggagcaggcagagattgacaaggtaactccttggagatcacatgagagcatgaggcagtggagatggagaagagcacccagcctcatgcctcagtgcttcttaggcttttacagcctatttgttctttcaccagctcacttgctctctccctcacctcctacctcctattttttctctctccctccctccctcccttctttccttcctcctccctcccttctttcctttctgcctgcctgcctccctctctccctccctccttccctccctgtccacccgcctcctgcctccctgccttcctgccttcctccttctcttctatattctgcttgtagatacttggaacaaaatcactagagaaaaatccacttaggaccaggcaaggtggttcatgcctataatcccagaactttgggtgcccaaggcaggaggattgcttgaggccaggagttcaagaccagcctgagcaacacagtaagaccctgtctccacaaaaacaagtttttttgtttttgttttgttttgtttttgagacagagtctcgctctgtcgcccaggctggagtacaatggggcgatctcggctcactgcaagctctgcctcccaggttcacactattttcctgcctcagcctcccaagtagctgggactacaggcacccgccaccacacctggctaattttctgtatttttagtagagacggggtttcaccgtgttagccaggatggtctcgatctcctgaccttgtgatctgcctgggcctcccaaaattctgggattacaggcatgagccaccacgctcagccacagaaacaacttttaaaaaattgcccaggagttcaaggctgcagtgagctgtgattacaccactgcactccagcctgggtgacagcaagaccctgtctaaaattaaaaaaaaaaaaaatctacttaggcataggcagggagaggaagagagatggaactgagcctagtcttcagtagcctgatgcagaaagagaaagccaagattggaagaatgggtgtggcagccaagaatgggagcaggtggatggtgccaggaggcttagcacaaagtcacagagggcttaagatgcatgttgggcatggtggcatgggcctccagtggctgaggcaggaggatcaccagagcccagaagtttgaggctgcagtgagccatgactgcgccactgcactccaacaaacatagtgagaccccatctctttaaaaaaacaaaaaaacaaatgcaggagtgatgctgggagacctgcctcaggagcacatttgtaggtgcattccccaccccaggctcccagcaaacaccttgtgtccatgcttgataaagaaaacaaccaccaacccctcccctaaagcttaaaacataattaggttaaccatcttcacctagcagaggcagaggagggttagaaggaccactccagcctactcagaggggggtcttgaatgagaatattaacttggcagcccctcagtttctgctgaggtaaaacacaacctactttgtgtgacaggatggagctgctgataataataatttgcagacgatgtattttgcaaatccacagtgattatttaaaagtgcttgcaactcacctgcctattgttgggccagggagactgcaatgcttctgtcctctcctccctgaagagttgctgagcacaggggtccttctgcctcaccatgactgctggtcagcagcccttctccacgttctttttattttaccagctttatgttgtgttacattctcatccttaatatttcttaattcaagggtggttgagttgggcttagcacttcattacaaaatagtgcttttcataagagaaatgggtcaattaaagtgctgtgcaatgcttccagtgaaaagagctagaaatctgatagtagacagtttataaactctgaggacagaaagagtctagtatgaaatctggaagttctgtgctatgattgtagaagtacttttggcatggaaagaaaaacacacatgccaagaaatcagtttccttgtgctagccaaaggcagcaatttttcagactgtctcaacttctaaaagaggaggttatctgtagcaatttgtacattgttcttttcaggtattaataatcggattaagatttccaccagtgtgtatactgtttaaatattccatccctgcaaagcgtagcatagctctctgaggatgaactggcaggtatgcagcccttaccactgtaaatgaaattattatttcaaattaataaatgccttctgattagaaaactgatacacgtccctcacacataatttgtataacacagagaagctcaataaaaatgtattgttttatcccaatacccagagctattgccaggtgcttctcaatgtctatatatgtgtattgatgataatgatgatagtaataatatacattgttccaaaattatatctgtgtcaaacacagctctaagcactctacatacgttaactgattcatgcttatggcaatcctgtataattaggattattaaaattcctgttttacagtggaggagactgaagtataaagataagtaacttgcctgaggctgacatttatatatgtttcctaaggctgccacaacaaattatcacaaactgaatgacttacaacaacagaaatgtattatttcgtggttctggaggccaaagtataaaattagggtgttggcagggttgttccttctggaggctctaagggagaatctgttcccctgtcctagcttctggctgctggcagcccttggtgttctttggtttatagacacgtcacttcagtccctgcctctgtgttcacattgctttctccctgagtcttctcctcttttcttttctaagaacatttatcattggatttagggcctaccctaatccaggttgatctcatctcaaaatccttaacttaattcaatctgcaaagatcttttttccaaatcaggtgatagtctcaggttccagatggatctatcgtttttagcagggaagggggacagggcggcttatggggacattcagcccactacaatattagtagtgggttcagtcccaggcattctggcttgaaagtttgtgttctagacatgatcacatagccttgcttgggctttttggattttgttgtagtttataaaattaggatcatgctgtacttataaggtgatcacttcaaatgctgggttttgtttccagacaagtagagaaagcagctgggagtttccctttctgggccttctgttcatgtcacctcagggggaccatgctttgtggtctgtaaaataagctcgttagagccgggtgtggtggctcacacctgtaatcccagtactttgggaagccgaggcaggcggatcacttgaggtcaggagttcaagaccagcctgaccaacatggtgaaacccagtctctactaaaaatacaaaaattagccgggcatggtggctaatgcctgtaatcccagctacttgggaggctgaagcaggagaatcacttgaataatggaggtggaggttgcagtgagctgagatcacaccattgaactccagcctgggtgacaagagtgaaacttcatctcaaaaagaaagataagctcattagcaattttgatccggagctgagtaaacctgagtcaggggataaacatgtccccagcaagtgggaattaattattatactcaggaggtggctgagtttgtgagctttgaatgatcccagagagaaattcattcttctgaatctccaagggcattccacaatgtgctggaactgtgctaagagaaggaaccgtgaccttggagctctcctgcagattcagcattattgcctgccaattactagcctgaaatgttgaacaagactgataggttgtcaggaaagcacacatctacattagcgtcacttagcgacagactgaaaaaatgaattggcaatcaatcatttaatcctatagaattctatattgctgtagaaataatggccttcctccatagacctcaagtattttataacatatattttcattcatttctcaaggttccaattaggaagattgtgtgaaagtcatgctaaaatattaacagtaagagagacttaatttttttaattcatcatgaattcctcatagacaataattgtttagttttcataaagtgtccaaggagataattttaagactgtcttaaaatttttgaatcacatgtggaagctgcaatttaccaaatcatttagagccaaatattttcatccctcctttctcctttttttactattctccctgaaatcataaaccttctgttccacaagatattctcccatcttcatctgcattgcagtgtgaccttatccacaggtcatcactgaagcctgcccatctaggacaaaaaggacagtttttaaccagataggatgttttcctgaaggtttgttgttgaatagtaacattttttcctcttctttcatttgagcaacttggtgagttaaacacatccataccatgtcttgacccctgctctgtgacccaatggtgtgtctgtggctgttcctacacatgagtacatagaaagtgcacacatacatttctctacctccacagggaatggcatttcccatatggaaaatggattatgttccaaacatttgtttgttgaaccgattggtgaaaaggtgggatccatttttctctggcaatagtaaatgatgtgtggtggtttctaggtcagctcccagaagctttttaactaataatctttattaatagggctctagaaccagtgactatttatagtaatgtttctgcaggaaaaaatgcatcctgagcttttatttcagattttagtgttatgtatcttcataaaaacatattcagaacattgaagtctcatgacttgggttcaaatcctggctttccctcttgtaaagagtaactctatacaacttacataacctcattaagcctcaatatccccatctgtatattaggaagagtaaaagtatgtctttgtatggttttgagtattaaagtaatccatatgaatgcactcagaactgtatttataaagtgttgtgtggtaaatgcactcagtatatttgagcttttattatcctcctgtctgattgctgcagaaatggagacttctgtccttacgttccagggagtgagatcaagcactctcataacactggaggtggtgcttacagcctggagtgagtactttgacagcgatgggggaagggactttaaggagttaggaaggaggagtgaaataggagctggtcatgtgggccagggcaggtgaaggaatggtacagataggggcgtgatttgataggcctggagctgggagggaccctggagaagggaggtgtgacaagaatgcagcagagaccctccccccctactcacatctctcctttttctctctgtgcccctaccctggaactggagaggtaggggaaaggaggaaggcatcccatctctacagccctattgtcagaggcatttgaaccagagcagctccatcttgaataggggctgggtaaaatgaggctgagacctactgggctgcattcccagatggttaaggcattctaagtcacaggatgagataggaggtcagccaaagatacaggtcatacagaccttgctgataaaacaggttgcagtaaagaagccggctaaaacccaccaaaaccaagatgaccatgagagtgacctctggtcgtcctcactgctacactcccaccagcgccttgacagtttacagatgccatggcaatgtcaggagattaccctatgtgatctaaaaatgggagacatgaataatccattccttgtttagcagataatcaagaaataaccatagaaatgggcaaccagcagcctatggagtagccattggagtatccattcttttattcctttacattcttaataaacttgctttcactttactccatggactcgccctgaattctttcttgtttgagatccaagaaccctcttttgggctctggatcagggctcctttccagtaacactatgactttttctttcccttttccccttctttttcctcctccttcagtgccttcatctgagttacaaaccccttaaatactggtgacctggaactaagaggaggaaggcagaagttgtttgtgtgtgttagaaggggagagagagaagaagaagtgtgacaatgcagttttacgttttgcttacagtgtgtgccatcccagggctttcaatggagtctgaactggggaatttcagtagatcagaatgagtaagagctgtgtcaaatattcttattgacacagtaagagctgtgtcaaatatccttattcctgagctctctgacccttttctgttttcaactcagcctgtttcatgccttgcaggccacctcagcatgtcatctacagacactaagaatgtctcttgaccatggtcttaagtcaatgtgttgggctgtaatgactttctgcttctgccacagaatcacagtgtcactgcagacatctgaacctgtttccatgtgattcctttgcgtgaaaatcacagtcatgtcctttgcctatctcagaacattttagcaaagatagctaagatattatctataaaatttgtaggtagaagactctataagcacctagtatcattacttagccttattaatatcaatggtaattctgtgaccaaattatagttattaaatatgcactgccaccattttatcattatcattatttataattataataatttgagaagttgacagattatggaatactgttttatcttaggacgagatattcttatatcttttgacaacccagagagagactttcttctcttagtggtaagaaattctaacagaaggccaggaacagtggctcacacctgtaatcccaactctttgagaggccaaagcaggagaattgtttgagcccaggagttggagagcagcctgggcaacatggggaaaccccatctctacaaaaaaatccaaaaattagctggatgtggtggcacatacctgtagtcctaggtactcgggagactgaggtgggaggatcacctgagcctgggaggcggaggctgcattgagctgtgatggtgccaccacactccagcctgggtgacagagcaaatcctgtcttgaaaaaaataaagggttaggtgggaggagagaaagagagagaggaagggaaggaggaagttccaacagtgagccaagcttccagggatggagagcagtgcccacccccaatgctgcttctctgggtccttagacaaggctgtaacagtacttccaggcagacctctgtcacaggccgctctgaagattgtttctccaaagggctgattgtatgtcgtaattcgagtgtaacttaatcttatttgatggagctttgttcacaaagcaagtggcctgaaaactagttctttgcattctaatgagagtctttggttttcagtcagaagcgatttgacatctttatgctcctctccctttgttgtggaaaaaaaacatcctttcccaagcatgtgatacatctcgaatttaacctggagtcacttaagtctggacatggcttgtaggatgttttattgttcttcattttccccttttaggtgaatcgtgactacagttttagtcattctatctctaataactgattgaaagacaccatttttttaagaattcagaagaaatctacattaaaaaatctacattatgttattgactatctttgctattttctggggaaatgtatgaaagaaagtggaagggcaaataagtccgacagcactcactttccccatagagttttatgaccctgaaacaggccaattaacaaccctttggtatacctccccaaatttcttatttatacaattggttaattaatggtttacactgatctgtattgtacttaatgtatctggaaagctgcaagcctgtggttcttaagttctacttttatatgcactgatgttccatgagtgaccagcgtgttccggtgctaataacttttcccagttctcaggaatttaatttaatgaatggaatgcttaaggcctttttcccagaaaacaattctagatctttggctttgttatacgtatcataatctagtgaaaaatgtcattttgtgtgggctagaattttctattcagttattttaattacttctagtgttttaagtagtttccaggttctctgccacccaaaaaactttgaaaatcacttgtcattgctgtacaaactacatttcacagatgctctgaagatgtttttatatctcatctcccttggaagtttttagttgtctcaaaggaaggcagacaacatcataaagagtgatgcatatgtcatttttgataacataccacttcccaacatttcacctctgtcttttatcttttccctatttttctttatattttcatttttctgtcattaattgaatatctactattgccaatcatatgctaatcctcacatcaattatgccgatgaagacacaaagaatcaattatgctaagtagctcaccttaggtcccataagtaataaatgccaaggtcaagaggattcccctcaaagaccataaatttccatcttcctgtattgcttctttctttctcctctaccacatgctctcctttgcctttcccttttttctctatttaattgtagtaaaatacacataacaaaatttaccatattatccatttttaggtgtgcagtttagtgacattaagtacatccatattgtataaccatcaacatgatctatcctcaaaactctttctaacttgcaaaactgaaactatacccattaaataactcccattcccgtcctcccaccggccactggcaaccactcttctcctttctctctctgtgaatttaactactagtctaggacctcagatgtgtagaatcaactagtaattatctttttgtgtctggcttattttacttgacataatgtcctctgagttcatacatgttgtagcatgtgtcaaaatttccttcctttttaaggctgaattaatattccattgtatgtgtataccacattttgtttgtctgttcattcactgatagatacgtgggtggctctcaccttctagctgttgtgaatagtgctgctgtgaacataggtgcactgcctttcattttgagtacacttcctccctcatcttctacataaattataggctcgtttgtggtacccactgacattgcttaatcccggtgacaacactgagacctagaaaatgcctgcctaactgtggaagctgtggactgtttcactgatttttcttgtcagcgtatttccccgccttggttttgcctttcttctcaagttagattttgcatggtaatgaatgcatattctgtcattttctcctaagtccatagatttctgtcttttgctacccttgatggaactccaatggaactctaaaaaccttcagaggagttgtagaagagccaatcaacatgtgtgtgttgaatgcaagagatgaggcaaggtgtattagtccgttttcatgcagctgataaagacatacctgagactgagaagaaaaagaagtttaattgcacttacagttccacatggctggggaggactcagaatcatggtgggaggcaaaaggcacttctttttttttttttttttttttgagatggagtcttgctctgtcactcagtctggagcacagtggcatgatctcagctcactgcaacctctgcctcccaggttcaagcaatttcctgcctcagcctcctgagtagctgggattacaggcatgcgctaccacgcctggctaatttttgtatttttagtggagatgggggtttcaccatgttggccaggctggcctcgaacccctgaccttgtgatccactgtcctcagcctcccaaagtgctgagattacaggcgtgagccaccgcatccagctgaaaggcacttcttacctggtggcggcaagagaaaataaggaagatgcaaaagcgggaacccctgatgaaaccatcagatctcatgatacttattcactatgatgaggacagtatgggggaagctgcccccatgattcaaattatctctcatcgggtccttcccacagcatgtgggaattatgggagtacaattcaagatgagatttgggtggggacacatccaaaccatatcacgaagtgtatgagatagcacactgggtggaggtgggagggtgggtagtagaagtagaggttcagttcccaacttcagtgaactttcaacttgcaaatactcagtactttatctgttagtttacataacttggaaattttattatcagacttattcagtatgtcagttattttccactggaatgatttttgctcctgctcccaccctggacatttggcaatgactagagatgtttctggttgtcacaactatggcaaaaactacaattacttttgcaccaacctcatggtatagggaatgctactgccatacagtgggtggaggtcaggggtgccgctaaatatctcatagtgcatggaacagcccctacaacagagaatgatccagcctagatgtcagtagtaccacggttgtgaagccctgcaatatatgtagtattgctcagtttatattagttaatcacctgatatggaacataaaaattcaccactagttttcgcacagaaaacctctttatgataatatagtaacttgaaatcaagctagcatttcccatgctataatagtcattatttgctaatccaggatgtaaaattttgaaggcttaagtggcattttagtatctaaggaaaattttctagcaaaaattttattttaaaaacataacttggtatttaatatattggcagttaatatctatttttaaaataaggaaccatcagtgtccctcataaactctctttggatttgaaaagcattgtgttactgcctcctgtatgtttctctcttaatagactaacactatatttagatcgcagtccctatacagatatcttatgaggtaaagttggaagctctatagggtgttttgcagcattgatttaaaatatcccatggataacccacttgcatagaagatgatactaaaaatataaacaaaatttattcccaatctgcccattttcttcagctggaatactagctaggaaactcctaatttagttttctgctttatggtactgtgtttaagcagattcctttcttccataaaatgaaacttgaacaagtggagtgagctgaaaagacaattgattggaagtgtcttgagaggcatagagatgcctgagacccagtcactgcccatatgtctaaaccagaataattgcaagacatgtaataatatacagaataattgcaaggcatgtaatgagaccaatatgtcttcatcacaaatcctctgttgtttgtacatctccagcactgagcaatgaaaactgatgttcatagcaagatttctgaaattctttcctaatcatcaagggaagaataaacttgggcttgatgttctagttatttggttatgtcccaaaggttgttaccaaaggtagttctcgcacatggacaggaatcgatcctcagacatctgaaccacacaaaactatattcaggaatccttgtctttctgctgcaggacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttc

SEQ ID NO: 772 - DNA, 88156 bp, Homo sapiens
aggcgcagtgtggtgagcgagccgaagcgcgggaagcagctcttgtggatcctcagtggcggaggctcggtcacccgggtgagtccccactccggctgcccgcgtccaccaaggagatgcgtgttccctttccggcttattgtctgacagaccctctgccttatcccgctggtgtcactcgggtgggggaaaccgggctgcggagaacgggccctagaggagactaagctctcttcctatccctagcctcgctgcttttctcttttgaaataataagactggcttttataaaacattttcagataggtaaaggaaaacatgcctgccacacggaagccaatgagatatgggcatacagagggacacacggaggtctgttttgatgattctgggaggtaaggttctttgagaaacaacgttttaggtgcaaatgttaaaacatttatccttaaactttatatgtgcagtcagctaaaaatgactcatgcggatagaggaataatgttgaaatctaaaatggcacacatatttctttagattattgtttgattcgggccgtcatggtagttgtagtatatcgacaaagttataatcgtacttccagaggagttggaaagatgcgagcttctctccatatattttccccttccctgcatcttacattattaattttgtcagatcactagttactgcctacttgtcaaattcagtggcctgttctgtttggaatgatatccttccatgcctttagtgatgctatttccctttttgcttatttttttttaactttttgacggcttaaaacaattttttcctctgattcctaaactataatattttcctacggttattctggtcccttttatctttccaagtcccattcttacgcactactgctcgattgcacggcttccactgtcgcttctatgttgattgattcattgaaaaaatacttgtgtgtctcttttgctggggactacagatagaatagagcgaaccagacacagtcttttcctcctttgagcttaaggtctttttggattgacaggcattgaacacaaattaatcacaaaaataaatgtgtatttagaaacaagtaatatgtgcagtgataaacatgtatgaggagaagctcatctagttaaaggagtcagggaaggcttctttggacaagtgtttcttgagacgccatctgaagacggagcaggcattaagcagtataaagagatgagtggtggtggcggtggggtggtgatgttggcatagtaagcagaggcaatactgtgtgtaaaggcccaatggggccagggatcatggtatgctcaaagaactgaaggaaaactagccttactaaaatgtggagagtgatgcagagtttagtgagagatgaatctgtgaagttaggcaatggatgtcctatccaagaccttctggactttattaaggaatctcgttttatcctaaaagcactgagaaggtattaaaggcttgaagcagagagatgtgatcaggtttgtttttgagaaaatgcatggaggatgaattggaaaaggagcactcatggatgcagaaagactgttagaagatacctgtattagtttgtgtaggggcgggttgcccctccacacttgtgggtgtttctcgtaaggtggaacgagagacttaggaaagaaaaagacacagagactaagtatagagaaagaaataaggggacccggggaaccagcgttcagcatatggaggatcccgccagcctctgagttcccttagtatttattcatcatttgtgggtgtttctcgaagagggggatgtgtcagggtcacaagacaattgtggggagagggtcagcagacaaacacgtgaacaaaggtctttgcatcatagacaatgtaaaggattaagcgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccatttaactctgagttgacacagcacacgtttcagagagcacggggttgggggtaaggttatagattaacagaatctcaaggcagaagaatttttcttagtacataacaaaatggagtctcttatgtctacttctttctacacagacacagtaacaatctgatctctcttgcttttccccacaagtttgggtaagtgtgatagaagcttggactagagtaaacatgggtgtgtagaaaagagtaaacattcaggaaatatttaaaaagataaagtcaacaggatggatcagatattaaggatggagaaagaggcaacagggataacgtctacatttctgaatgttacggttgagaaagtgatgcttccacttgcaaataacaggaacacttgaagaagggcgtatttcagaggtagagctgtgggtggagattgagtttgcgtttggatgtgattattgtaggatttctttgagatattcacctagagggataaagtagacagttggataattgtgtctcaagctcagagaaaaatgtgagctagagatagaaatatacaattgacccttaacatgaatttgaattgtgtatgtctacttatacgtggatttttttcaatacacatattagaaaatttttggcagtttctaacaatttgaaaaaactagcagacgaaccatgtagcctagaaatatggaaaaattaagaaaaagtatgtcatgagtgcataaaatctatgtagatactagcgtattttatcatttactaccataaaatatacacaaatctattataaaaagttgaaatgtactaaaatttacacactcaaacatttccagaccatccgcagtcaagagaaatgtaaacaaacataaagatgcagtgttaaatcgtcactacataaaattaactgtagtatatactgtattactgtaataatttcatagccacctcctgttgctatttcggtaagcttaagtgttgtatctgcttaaaacactgtatgaggttgtatctgcttaaaacactgtatgatgctcatgagcagtttgtctctccagtaaattgcctatcccagtaaaaagacatctctggtgattctcatatatttttcatcatgtttagtccaatgccgtaaactttgaataacaccatgggaatcatatgaagtgccactagtgatgctggacatactcctaagaagcagacaaaagtcatgacattaagagagaaaagttgaattgcctgataatgtactgtagattgaggtctgcagttgcggttgctcacaatttcaagataaatgaatccagtgtaaggaccactgtgaaaaggaaatttgagacactgttactgcagctatgccagcaggcatgaaaaccttgcactttttgtgaaataactttatcttgtattgaaaacgcagcttttatgtgggtataggattgcaatagaaaggcatagctatagactctaatgtggttccagaaaaagtgaagtcattatctgacaacttaaagtgaaaggtaggtgaaggatctaaagctggaaagtttaataccagcagaggatagtttgataatatcagaaagagatttggcttcgaaaatgtcaagatggccgggtgtgatggctcacacctgtaatcccagcattttgggaggccgaggtgggtggatcacctgaggtcagagcatgcccaacgtgttgaaaccctgtctctactaaaaatgcaaaaaattagccaggcacagtggcaggcacctgtaatcccagctactcaggaggctgaagcaggagaatcacttgaacccgggaggtggaggttgcagtgagccaagattatgccattgcactccagcctggggatcaagagcgaaactccatctcaaaaaaaaaaaaaaaaagaaagagaaagggtcaagatggcaatagaatcagcttctgctgaccaagagacagcagattcccagacaccattacgaaaatcattgaggagaaaggacatctgcctgaacaggttttttgtttgtttgtttgttttgtttttttgagatggagtctagctgtctcaccggctggagtgcagtggcgcgatcttagctcactgcaacctccgcctcctgggttcaagcgatttttctacctcagcctcccgagtagctgggattacaggcatacaccaccacacacagctaatttttatatttttagtagagacggggttttgccatgttggccaggctggtgaacaggtttttaatgtagactaaagtgccctattctgtggggggaaaaatgccacaaagaacatttattagtaaggaaggaaagtgagcactaagatttaaggcaggaaggctaactctaatgtttggtgcaaatacaatcagatttgtgatcagaactgccattatttataaagctactaacccccgggccttgaagggaaaagataaactccagtctcttagttgtataacaaaaagacctagacaatgagaaccttcttttctggattggtttcactgatgctttgtgcctgaagtcagaaagtatcttgctagtaagggactgcctttaaaattcttttaatgttgggcaatgcccctggccacccagaacaccataagttcaatactgaaggtgtcaaactggtatacttgcccccaaacacaatgtctcgaattcaacctctagatgaggagttcatacaggcctttacgggctcattacataaactaatctatggaaaggattgtcattgctatggaagagaaccccagtagagagaacatcctaaaagtctggaaggattataccattgaagatgccatcattgttatagaaaaagctctgaaggccatcgagcccgaaacaaattcctgctggagaaaactgtgtccagacgttgtgcatgacttaagattgacagcagagccagtcaaggaaatcatgaaggagattgtgggtatggcaaaaaagataagggagcgaagtaatttcaagatatagaccttggagacattcaagaggtagcagacatggctgggcgcggtggctcacacctgtaatcccagcactttgggaggcccaggcagatggatcacttgaggtcaggagtttgagatcagcctggccaacatgatgagaccccggtctctaccaaaaacataaaaaattggctgggtatgttggcatacgcctgtaatcccacactccaccttctctcaggaggtggaggttgcagtgagccgagattgtgccgctgcacattccaggctggccaacaaagcaaaactctgtctccaaaaaaaaaaaaaaggaacgctaatagacactaaaccgaagagttagcagaagacaatttgatagaaatgagttcttcctaactactgccaagtgataaggaagaagatgtagaagaagtagtgccagaaaacaaattgactttaggcaatctggcagaagggttctgattattcaagactgcttttgacttattttacaacatagacccttctatgttatgagcactgaaactaaaggaaatggtggaagaaggattggtactgtatagaaacatttttagagaaattaaaaaggaaaagagtcagacggaaattatgatgtgtttttataaggtcacaccaagtatgcctgcctctcctgcctcctcctctacttcctccccctcttccacctctgagacagtaagaccaactcctcttcgtgttccccgtcagccttctcactgtgaagacgataaggatgaagacctttatgatgatctacttccacttaataaatagtaaatattttttctcctctttatgattttcctgatatattttttctctatattgctgtattgtacagatacagtatataatacatagacaaaatatgtgttaattgtttatgttatcagtaaggcttctactcaacagtaggctgttagtaaagttttaggataatcaaaacttctatgtggatttttgactgtttaggggttggaacctgtaatgcccatgttgttcaagggtcacctttacatctttggctgataccttccagagttcagggttgaggttctggctaagaatataaatgtgagaattgtccttataaacataatatttattactgtgaacttggatgaagtcacctagggaaggagtaaatataggtaagaaaagaggttcaaggatactccaaaatatttagagatcaagttaaagaggatccagctaaggagactaagaaagagtagctagaaaagtagagaactgaaagacaagaaggatgtttagaagccaaatgaagtgtttgaggaacaggaaataatagactctgtcaaatgctcctggtgagtcaggttgaagactgagaattcaccattagatttagcaatgtggaggccattggcaagttttatggaatggtaagaatgaaaaccttgaagtggattcaagataatggaaggggaggaatttgaattagtgaggttgacactacgtggttttgattttgtctctagtaccagtggggtatagaaagtaatcagtcactacttaagagggctgaagaggaagcagtgaccccagaagaatgaccagaaagaaagctgagtatatagagattttgcttgtgcctcaccatgaacctcatgagactcaatgattaagagtcaagaagaggtggtcagattagggaaggaatgttgctctctgaggatagagttgaggtagtaagaaatgcgttggtaatcattgactccttgaggttatgtcataaagctgatgaagtcttgatataattaatcttcatgcccagacactgatagcggatttcttttttgttgagatggagtctagctctgtcgcccaggctggagtgcagtggcacgatctcggctcactgtaacctctgcctcctgggttcaagtgattctctctcctcagcctcccaagtagctgggatcacagatgccctccgcaacagctggctaatttttgtatttttagtagagacaaggtttcgtcatgttggccaggctagtcttgaactcctgacctcaattgatccaccagccttggcctcccaaagtgctggggttacaggcatgagccaccacaccccgccttactctttattattttaaagtaaatcccatacatcttataactaaaatctggtttattgggggtagaacctagtagaacaatgctttagcaagagtcatgaatcaaaaaagagaaggcacaaataaaataatattagagataaaaaaggtacaatataggcttcaaaatacgtgaatacattgacacccttatgccaatagttttgaaaatttgaaacaaaggtataattttctaggaatatgtaaattaacaacttacccagtttacctaagaaaaaaataaaaatatttatttacattgattatccaaacattaaacatatgatctaaatgttaacatatgtaagataatcatttctggtacatatttatgtgctttaatcagtttcttagcctgtctgtcccatggtattgctgatatttttctgaaaaatatatttttaatacagtgttattttaatttttctcataaaaaattagctgtagccttgtttagagttgcattttatgctgaataaatttgaagttaaatcttcaattcttttcttttttttatttgtttgagtcagagtttcactcttgttgcccaggctggagtgcaatggcaccatctcggcccactgtaacctctgcctcccaggttcaagcaattctcctgcctcagcctcccaagtagctgggattacaggcatgcgccaccatgcctggataatttagtatttttagtagagatggggtttctccattgttggtcaggctggtctcgcctcccaaagtgctgggattacaggcgtgagccaccatgcctggcctagactataatattttttaatgagaaaaatgttaggttctaaggtacttggcaggctcagagcaaattctactagctgggagagtcataatttttaagaatttgttttaattgaaatgggtaaatacttcagcctcagtatttttataggttctgtctttttatctccattcagggtacacttcttcaataatagggtcttcactgtttttaaggacaaaattcatcaagttgtctatgattcttttggatgtttcacagattttaagcctactcttttatttcattctggcacagaacataaattaatacaattaaaaataggagttctatcaaaatattcttcccacaagtcaagatattccaaagtacagttacagaattttaaaatgaaatcattcaccatttcagcttttcatgtacaatttgttcaattcttatttgcttttgtagggataaatttcagtgtcttcctgtgcataagttttgttttcatgaattgcatttcactaaaagcttcaaaagcttaagtttaatgctttgattaaagatgtctgttttcaactaaatgcaactaagatttagaggacttgtttctaataataataataccattattacagtaggacacttaggttgttttacagagtcgctcgctcttcaaaggcttaaagattttaaaaacccaatcactccaagcagagggagaaagtatgtcctgcaatgctagtattttttgtgtatttaattaacatcggtttgtgcgctgctgaggtgggaggattgcttgaggccaggaggtctagtagtttttctgtatatcacattgatttgtgtgcagctgaggtgggaggattgcttgagcccaggtcaagcctgcagtgagccgtggtagggccactgcactccagcctgggcaacaaaaacagaaacaaaacatgtttttttcaaaaattctgttgttcagcaattctagatataaataaaatctgaaaatttgacaagtatggcttcttttttgttggtgtgttatcttgcagctcatttggatagaatcatgaattgtaattccaaattcaagtacttttgtgtttcacagatttcctaatatagtaagaacattgatttttctggctgggtgcagtggcttacgtctgtaattccagcactttggaaagctgaggtaggtgtatcacttgaggtcaagagttcgagaccaggctggccaacatggtgaaaccccatctctatgaaaatacgaaatttagccaggtgtgggtggtgcgtgcctgtaatactagctacttgggaggctgaggcaggagaatcacttgaacctgggaagtggaggttgcagtgacccgagatggtgccactgcactccagcctgagcaacagagcaaggccctgtttcaaaaagaaaaaaaaagaatattgatttttcctacagcactgtagaaaacaataaaattaatatgtagttatttgatacaataaaggataaaaccatttagaagaatgtttagactactctaaaagcacttctttcgcaggactgctgaacgctatttcctgccaaagtttgtatttgtattactgtaaaaattaagaattttatcattagtgttaaacttttcaaataaatttagatagaatccccactgatgtcagatatttcactttcagcagaatgaacttccagaagatttactttgtttccatgaactgaagagtaaactaaactattattggaattaatacgggcgattttctatttaaaactcctgatgacattgatataatacttttatcatttaactgtttgaaagttcttttgctgtctatggccataccaccctgaacgcacctgatctcatctgaaagttcttttgataatggagacaacccattaacagtcacttcactttttatgcttgcaccagaaaacttggaatgaaaaatgaacaaaattattttagaacaactgacatttcttttaatgctgcgctgtccaatacagtagctactagccacatgcagctatgtaggtttaaatcaattaaggttaacttcgttaaaaagtcagtttgtctgtcacattagccacatttcaattgctcagtaccaggtatagaccattttcatcacctcagaaagttgttttggagagcactgagttcttaggaagaatcatgcttcacaagatataaatcaccttctgcaggagtagaatcacagtttttaggcagccttctcaagataactactaacttgaatagatactgatgcttcttcgggacttctttctcttctaattttcttgtggttggtgttatcactatagtatgactgtagccccgtggtaaatgtcaacaaacattttattcaagttatattttcattatcaactttcctgagaagaagaaatttagtatttaatcttttattaaatatgtacttgatatacttttttagctcattaccactgaaagggttgtgttggttttcatttttttcccaaaatttcaaaagcatagcaatcaataaaattaatatgtagttagttatttgatacaataaaggacaaaaccatttagaaaaacattcagactactctaaaagctctttagaagattgcttaactctattttctgcctttatttcttattaattctactatatttcactataattttccattggtcccaccaactggcacctgtaactttgtacgtctcctccagtgcatctgctgatacaccaagaagcccatcggggctgggtgtggtggctcatgcctataatcccagcactttgagaggccgaggtgggtggatcacctgaggtcaggagttcaagaccagcctggccaacatggtggaaccccatctctactaaaaacacaaagattagctgggtgtggtggcgcacgcctgcagtcccagctacttgggaggctgaggcaggagaatcacttgaacccgggaggcagaggttgcagtgagctgtgatagcaccactgcacttcagcctgggcgacagagtgagactgtgtctcaaaaaaaaaaaaaaaaattccattggaacaaaaacgtgaaatacttctctcatcaccattgggactgaaagaagtagctatccctagggtcttacatctgaatccattccgttttttattgaatgcctcacatgttgtccccgaaaggatttgttagtcacattgcatcaggaaagggtaggaaaaggggagatagcttatcactagtcattttacagatttaaccatgtgttatgtgtgttatgttaccaaatgagaccatggcagaagctggaagtacaaagaagaggtctgccaaacccaccctagccttttttttttttttttttttttttttgagacagtgtcatgctgtttcccaggctacagtagtgcgatctcggctcactgcatcctctgcttcctgggttcaaatgattctcatgcctcagcctctggagtagctgggattacaggtgtgcacagcactatgtctgactaatgtttgtatttttagtagactcagggttttgccatgttggtcaggctccaccctagccaattttgatgcaactaatactaatatgttttaaagtgaaaattcctggacaatgccaggccagttggacacataaaccaggagtatctcaggcaaactgagacttatagtcctcctatctactctctatagaagggagcctaaccaccttactctggcattaaggttattctaaataggtgacctagacttcattttcctttttctttcctggcttgtctgctccaggtaaactcccccatgctgtattaactatattttttttcatgtggttttctctggaactgcccttgtcaccagtcttagcatatctagtcctgcttgttctttgacttcccagtgtaaataccatctttcttatgaatctttttgactttctcaggtgagaattaatctttttcttttgaacatccacagctctttatatagattttttttgctgtttattatatgttatttttgtattttattatgtacattatattttgtgtttttatttgcttttttgtatgtgtgtagatagggcacatactaaatgagtaaaagcatttggaagataagtttaaaacaagttatgatagatacagatggttatttgaaacacgtttggatagttgagctcatacatctattcatttattaattcaacaaacatttattaaggtttctgtcagagactgtttggtgctagggatacaatggtggacaaggaagatacggtccctattttattgttgcagattatatacccatctttcttacattcttacaaataaataattttatgctggccaagcatggtgactcatgtctgtaatcccttgactttgggaggtcaagacaggcagatcccttgagcccaggagctcaagaccagcctgggcaacgtagggacaccctgtctctacaaaaaataaattagccaggcatggtggcatgcgcctgtagtcccagcgacctggggagctgaagtggtttgatcacttgagcctgggaggcggagggtttagagagctataatcatgatactgcctaggcaacagaatgagactctgcctcaaaattttataattttatgccaaagaagaactagagtattaaactcatcttttattttatagaaggaaattagcactttatttttaaagtttaagtgtataaaatgagaaaaaatactggctaatgtcttcattttgtgaaaaagtggtaaatatagaagtagcattccaaaaaactaatgtatatgaaactaggtgacttttttttttccttgagatagagtcttgctctgttgcccaggctggagtgcagtggtgccgtcatggttcacttgcagccttgaccttccaggctcaagttatcttcctactgcagcctcccaagtagctggtactacaggtacacataaccatgcctggctaattttttaattttttgtagagactaggtctctctgtattatccaggctagtcttgaactcctggcctcaagcaatcctcccaccttgtactcccaaagtgctagcattataggcatgagacaccatgcccgatgactttaatttgtgtcttttcttcacagttttattgtgacttgtggaagtgatggtgatgtgaggatttgggaagacttggatgatgatgatcctaagttcattaatgttggagaaaaggcatattcatgtgctttgaaggtagtaaaaacagttatatcaattgatatgaaatgatactggcatgtgatttttatgcttgagtgaaaaaatatttttgaatatagatatacctttgtttatctcatgaaataatattttaaaatgtatgataatgccgtaacttgccctaccatttttttttgagatggggtgtgaaaaatatttttgaatatagatatacctttttttaatctcatgaaataatattttaaaatgcatgataatgccataacttgccccaccaattttttttttttttttttttttttgaaacgggatcttgccatgttgctcagaccggtctcaaactcctgggctcaagcagtcctcccagttcagcctcccgggcagctaggactgtaggtgcatgccaccatacctgaccaccccaaaatttgtggtttattaaaagtgattaatggacatgaatggtgaaccaattaaaataaatgcaggaaaataatacttccaagaaaggtttaaatgttcccttttttcctttaagggaaaactcagtggtgtttttagctcactgctatgatttgaatgtgttcccctaaaagcatgtgttggaaacttaatccccaacataacagtggtgggaggtggggtctactgagaagtaatgagaccatgagggctctggcctcatgattggattgatgccaccatctcaggagtgggttcatcataaaagggtgagtttgatcctcttgctctccctctcgccctctctttacctttccaagatgggatgatgcaataagaagacccttgccagatgccaacccctcaatcttgtagtgtccagccttcagaatcatgagacaataaatttctgttcattgtaaattacccagtctgtgggattcttatagcagtacagaacagactaaaacacctactgattcagataacttaaggaattgttctagaaaacgggaatgtttcattaactttcccaatatatattcatatgtgtttctgatgttttgtgtaacgcaaatatgggaatgagatgtaggttacttggagaaagaagacttattcagaaggactttggaaattaattatctataaacccctaagctttttatttgtgatgacttttaacttgagtgtattgtgtttaggtagaaaaatctttccacagaattcatattttttccaaacccaggcgcatttaaggtagataagatgatgtttagatattctttttaaaatgatcatatataattagaaaatgcgttcccagaagaaaaaatgtaaatgaccaacatacattaaatgtaagctaaatcttactagtaagcaaagaaatgcaaattttaaaattggattttttttccccataagattggcaaggatgaaaaatattgctaatcccagtaatagtgagggctttgagaagtaagtattatcatacatagtggctggatacataagtgagaaactttttttttttagagcaaattgataccgtgtattaaaattagaatgtacacagtcatttctggctattttcaagtttatgtggaaaaggatagtaaaagcacaattcataacaatagcaaatgtcggaaacaattgaagggtctttcaattgagaagttagtttataaattttggtggagccatataatggaatactatgcagccattataaaagtagggtatctattttcatcagaaaatatatttataataagttgaaaataagtttacaataagtaaaaaaaatgagattcagaacagttaatatagtgtaatcttatgtttgttaaaataaataaatacatatatatatacacacaaacacacacacgaatataacaaaattaagaagacttaaccccaaaatgttaatggagattaattcataaaataaggaactcaccctctgctcaggatacttttttttttttttttttttttttttgagacagagtttcactcttgttgcctaggctggagtgcaatggcgcagtctcagctcactgcaaccgccgcctcccgggttcaggtgattcttctccctcagcctcccaaacagctggctgcccaccaccatgcctggctaatttttttgtaattttagtagagatggggtttcaccatgttggctaggctggtctcgaactcctgacctcacgtgatccacccgccttggcctcccaaagtgctgggattacaggtgtgaaccaccacacccagccccaatactttcatattgtcatttttttctgttcagtgagcatgtactgcctttgtatatgaagaagactgtaaaggaggaaaaagtaaacatggtcttgtattagtttactaaggctgctgtaacaaattgccacaaagttggtggcttaaaacaacagaaaattatctcacagttcagaaggcaagaagtctgaaatcaaggtgtcgtcatggttggctcttcccaaggctctgagggagaatatgttccattcctgtcttctgggttctggtggtgtggcaatcctcaacattccttgccttgtaggtatatcactgcagtctctggcatggatgctgcatttagactttactctaaaaagacatgtgatgtgtcttttgttgtggaaacatagggcagtggccattgtggccgtgccttctgatgccttctcctcattttgagactagctctgttttctctgaaaagctctcttgagtctccttcctttttataacacttaggatccatagaagtactattcaaacatttttcttaccagaagtaaaagaaaaattagaggctaagagataggctgcttaaggtagaattaatttttctaaagctagcaaatttttcttgctaatgcacattccagcaaagttgtacatttagtgataatttttctcttgatatgaactagatttttaaggttttttgttttttaccggatttttaactatggagagactcccagtcatttggatttgttttgctaatgtttcttaccttaatttttcttttagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctaggtaaggctctttgacatcagaaaaggaaataatgttagaacaaaaggccttgtttatttgtttcagggtagtgttttcaggaccgtgacttaattttttgttgtttgttgtttcttcatatattcttttatctagtaaaggtttttgaggacaaacttgggcttctttttgaattgaaatatattgctttggccggttgtggtggctcacgcctgtaatcccagcactttgggaggccaaggcaggcagatcacctgagctcaggagttcaagaccagcctggccaacatggcaaaaccccgtctctactaatacaaaaaattagctgggtgtggtggcgggtgcctgtaatcccagctactcgggaagctgaggcaggagaatcacttgaacctaggaggcagaggttgcagtgagccaagatggtgccactgcattccagcctaggcgacagagtgagactctgtctcaaaaaaagaaaaaaaggaaagaaatatactgctctgcagatgggcagatggcctattttataatactgaaagcatagcttgatggaaaatttaaaaaaattattttagggctggcgtcgtggctcatgcctgtaatcccagccctttgggaggccaaggtgggcagatcacctgaggtcaggagttcaagaccagcctggccaacacagtgaaacctcgtctctattaaaaatacaaaaatgagctgggcatagtagcgggtgcctataatcccggctacttgggaggctgaggcaggagaattgcttgaacccgggagacagaggttgcgtgagctgagatcacgccattgcgttccagcctgggcaacaagagtgaaactctgtctcaaaaaaaaaaaaaaaattattttacttagaacttgggctgtacagtcagaatattttggagtttctcttgatgcttctttgtcataggaaaacaatatagttggttgaattgctgaggtgaagtgaaaggtatagtacttttaaaaatggttgtagctataattagattagcaaataatagaagcttaagatgtaactaaagaagccatttaggaagtgtttgtattttagcataatgggaaatcttgacttgtgttttcaacatatttatagagcaaaactaaaaggtaagccattaaatttgggtgccaaattttataagttgccataaagattttgtgattttaaaatacttggacaggcgtagtggctcatgcctgtaatcccagcactttgggaggctgaggtgggcggatcacaaggtcgggagttcaagaccagcctgaccaacatggtgaaaccccatctctactaaaaatacaaaaattagctgggcatggtggtgcacacctgtaatcccagctactcgggaggctgaggcaggagaatcgcttgaacctgggaggcggaggttgcagttgagatcgcaccactgcactccagcctgggtgacagagtgagactccgtctcaaaaagaaaaaaaaaaaaaaagaaatatttggatcatagcttttaggagaggcctttgtgttagcatttattcatttgcgttactctttttgttcttagtgattttctagtcaaaattgtggatgtgatggatagcagccaacagaaaacatttcgaggacatgatgcccctgttttaagtctttcctttgatcctaaggacatctttctggtaattattttttccttctctttttgtgtttttcctgaatatgtttaaaaatatatttcctactaactctctaaaaaattttctgctaactcaacttttcaacctttgttttattcagtaagagagttagcaggaaatttcacccagttgataaaagggctttttgatttaattaattgaaccactttccatgtagtattatggctatgactatagagaaatgtattgtttattcctgcaggcatcagctagttgtgatggatctgtcagagtgtggcaaatttcagatcaggtaaactcagcaatttaaatttaaagttttttgcccatttctgtaataaattgttatatgtcgtattactgggccaaattaataattgcttttctttggaatttgtttctttggtaccattaaatactgtttttgtgatcaaagtccacagtattctagtgccaaataaatacgttgaagactaattgcatttttacctaatcacaaggggaatgataatcttatatttaactttttaagttttgtaaatgaagggaataaattcagttattttatatttacaatgtaatgaccatgcgttgggccttgggttagatggttggggataaaaaattatgggtcacatttgatttggagagtcacatatacagtttattcaaatgcagcctaataaaggttttaaaggaggtacgaaataaggtgttctccagattggcagagggaacagttaagtctgcccaaggcaatccaagatggcttggcatttctagagagaatatgaatgtaattgactagagaaatatcctccacaaatatgccttaatatccacagttccttcccttcattcttgagctatttaaaagaagcgactttgacactttaacattttatagtagaccattgaagttttatttttgtagtcattctaagaatttcacgtattggggttttgtgtatgtgtgtatgattattcaatgagtatatcatttgtttattctgcacagaaaatactctagttatttaagatttgtactcatcatacctttgaaggacttaaagcagtttaggtatatcaggtattattataattaaggtgcattaagttgcatttttctgagatatatattgatttgaagaacctttaaatatattcagttctgcatatattttgggggggattttcataaaggaaagaaattttctttttttaccaattagacatgtgctattagttggccactgctacaaaaatgcaacgatgtgataaatgcaaaatcaatctgcagacttgcttggcagccaaaaagtgggaaggtaagtgattcttatttttcttttcttttcttttttttttttttttttattagagatggagtctcactctgtctcccatgctggagtgcagtggtgcaatctcggctcactgcaacctctgcctcccaggttctagcaattctcctgcctcagcctcccgagtagctgggattacaggtgcacactgccatgcccagctaattttttgtatttttagtagagaggaggtttcatcgtgttgcccaggctggtctcgaactcctgagctcaggcaatccacgcacctcagcctcacaaaatgctagtattacaggcgtgagccaccgtgcctggcatgattcttatttttaacctttgttttattcagtccttttcaactttgagtgtaaaaatagtttttttaattactttttaaaaatttggattataaattttagagtaccaagccaaataattagtattgaaatgctttaagaaacatttgaactttttcaagattcattttgaagtataaattttgcatgaatgaattaattttatatttttgttcacattcatgcttaatggaacaactctggagacagtcttattatgtccattctcaccattagtacctaacattttggaggtactaactgatacagttagacaacagaaagatatgagaaatttgaaaggaagaaagagaatgttcattatttgcaaaggaaatgtttgtatatgagtaaatcccaagaaaatcaactggggaagaaaatcattactactaataagaaaatttagtaaggtaactggaagcaaaattgtttgtatacaggattgttatacaaatacaggattgttatcctgtatacaaacaatagccatttagaaagcatgtaggaaaaataatgcatttacttttaaattgaaaaagatacagtaacaggttaaatgtacaagaaatgtgaaagatctatataaagaaacttttaacatgctaccaagagaagtaaaagaagacttggataaatagaaacatatattcttagaaaggaattatttgatataaataaagatgtcagttcttccctaaattaatctatagttttgataacattcacatataaaacaacagcctatgtgtggtggctcacacctataatcccagcactttgggaggctgaggcaggaggaccgcttgagctcaggagtttgacaccagcctgggcaacatagcaagacctcgtctccacaaaaaaatgaaaattagccaggtgtggtggcatattcctgtagtcccatctacttgggagactgaggcaggagtatcacttgagcccaggagattaaggctgcagtgggctatgatcttgtcactgtactccagcctaggcaacaaagcaaaaccctgccttaaaaataaaatgtctcatctgaaggctctaaggaaaaaaaaaagaaaacaaagtaaaataaagtaccaataagatgtctaggaggaccaaattgagctgattctaaagcccatgagggctttctgcactacccagagaaggatccttatgatgttgttctggattcccatcgtaacttaaagggaaactttcacaatgtctagaacctctatgtcctgcaaatgaaggaggaggatgtccttaagttccttgcaggaggaacccacttaggtagcaccagctttgtcttccagatgggacagtacatctataaaaggaaaagtgttggcatctacatcataaatctgaagaggacctgggagaagcttctcctgggagcttgtgccattgttgctgttgaaaactctttcaatgtcagtgtcatatcatccaggaatactggtccgaaggccatgctgaagtttgctgctgccactggagtcactccagttgctggctgcttcactcctggaactttcattaaccagatccaggcagccttttaggagccacagcttcttatggtgactaatcccagtgctgatcaccagcctctcacagaggcatcttatgttaacgtacctaccattgctctgtgtcacacagattttcctctgtgctatgtggacactaccatcccatgcaacagcaagggagctcactcagtgggattgatgtggtggatgccgatccaggaagttcgcatgtgtggcaccatttcctgtgggaggtcatgcctgatctctacttctacagtgttcctgaggagattgaaaaagaagagcagcctgctgctgaaaaggctgtgaccaaggaggaatttcagggtgaatggactactccagctcctgagttcggtgctcctcaacctgaggttgcagactggtctgatggtgtgcaggtgccctctgtgcctatttagcagttccctcctgaaaactggagtgctcagcctgccacagaagactggtctgcggctccccactgctcagaccactgaatgcataggaacaaccactgagtgatcttaagctgttcttgcacaggctcttaagcaacatggaaataaggttgatgaaaaataaacattgggtcgggctcgctggctcacgcccataatcccagcactttgggaggctgagacaggtggatcagttgaggccacgagttcaagaccagcctgggaaacatggcgaaaccctgtctctactaaaaatatagaaattagctgggcatggtggcacatgcctgtaatcccagctacttgggagtctcaggcataagaattgcttgaacccaggaggcggaggttgcagtgagccaagatcacaatactgcactctagctcaggtgatagagcgagactctatctcaaaaaaagaaaataaacattggttgctaaaaaaaaagggaaagtccatgtggaaaatgaaaagttttgaaaaagaaaagtgatgcaaataattcagttagataataaaacataaagttatgagaattataagtttgctattgagttatgaatagacacatacctgttaaagagataaatagaaccaaatgtatatggaaagttagtgtatataaaggtagagaaaaggagatttagcaaatgtattagcacaaggatatgaataccaggaagtggagtgggaatctttgaggaccatcttggaagcttgcttctacatgatgagtctatatataggtatttactatattattatttcaacttttctattcttttgaaatttttcaggaaataaaattaataaagtagattgtataaaaagtaaatagttttgcatggtacaaaatattagtcacagtacaaatgacaaactggggaagaaaatttgaaacaataaaacagagctaatttccatagtgtgcaaagtattcttacaaatcaatagaaacccattagaaagatgagcaaagacatgagcagacagtgtacataaaaaatatacagttggtagctgggcacagtggctcacgcctataatcccagcactttgggaggctgaggcgagtggatcccctgaggtcaggagttcgagaccagcctggccaacatgataagaccccgtctctactgaaaatacaaaaattagccaggcgtggtggtgtgcgcctgtagtcccagctgctcgggaggctgaggcaggagaattgcttgaacctgggaggcagaggttgcagtgagccaagatggcactacttctctccagcctgggcaactatatatatatagttcgtttttctttcttttttatacatatatacacaattggcttttaaaattattttttctttccttttttttgagacatggtctcactctgttgcccaggctggagtgcagtggcatgatcacgattcactgcaacctctgcctcccggactcagttcatcctcccacctcagcccccaacccgagtagctgggactagaggcacgcgcccacaatggctggctaatttttttattttttgtagagacagggtctcattatgttgctcaggctagtctcaaactcctgagctctagtgatctgcctgtctcagcctcccaaagtgctgagattataggcctgagctaccacacccagcccatgtgaacttttaacaatgtacattctagatttaagtgataattgagctcaaggaaatgtagtatgtattttttttctttgcttacaaaaaaacctaatttaaaaattttttaaaataaagtttttattatatgttactaatccttttttggataatcatggaaagaatacacagttttattttttctactaatcagtttcttcagaataatgcataagaagatacatttcttgtttttcaagatatttgaaggattctgtctttattttcctcaaacaaatgggaggaatttttatatcagaaggacctagattccttaagaagtagtattgaaggtcaggcatggtgtctcacgctgtaatctcagcactttgggaggctgaggcaggaggatcacttgaggccagagttcagtatcagcttgagcaacacagtgagaccccatctctacaaaaaaacaggaaaaaaattagttgggctgtagtcctagctatttgggaggctgaagcaggaggatcctttgaccccaggagtttgaggctcagtaagctgtgatcacaccactgcactccagcctgggtgacagagcaagactgtctcttgggggaaaaaaaagtaatcatatttaaagtactagtaattacaagttctccattttttgggtgcaagcaatagagtgatcacctttatttttttctcttcccatgacaaattatcacctattttttgcttattgaagttttaagtaatgttctgagtttcattagttgccaattaaaatacagatttgcgcctggcacagtggtgtatgcctgtagtcccagctacttaggaggctgagccaggaagatcccttgaacccaggagttagagaccaacctgggcaacatagtgagacaccgtctcttaaaaacagaaacaataaaaactaatttgcttttatgtcttgtaaatatatctgaatgaattttgtgcctttttccttcttcaaattcaatttaatgtaaacttttgtttacgttgtttatcttttctaatagttactggcaattcctgtggaaaaatctgttaagctatatagaagagaatcttggagtcatcaatttgatctttcagataatttcatctctcaggtaggttttacaaagtgacactttcagtgggctataaggagcagttaatgcgtagtttgcctgaatacagttgcagttaaatattattggaatggaaaacaactcctggctgttgtatgtggtccatcttctaacagctcatcctttcttcatttgatcaataactggatactaaataggtctttgttataagaagtcagatttaacccttgcatagtattagaacaagttgttctaaaatgatcagtagttagcctttattgttaagtgagtttcactgagacttgtgatcatggactctgaaattttagaggaagaaaggttgttggtctgttttctctgtctcttacatgcgtagatatttacagttaaggaaacataagcccagtaggtcagcaatggcttactaaagttcacttcacttactagttttcttcatcttgattgtgaatgctaagaggatgtcttgaattgtctctctttctaggataataacattttttaggttttgctttgaaaattgtgccagtggctgggcacagtggctcatgcctgtaatcccagcactttgagaggctgaggcaggaggattgcttgaggccaggaatccgaaaccaacttgggcaacaaaagaagactccatctctacaaaaaatactaaaaaattagccatgtgtggtggtgcatgcctgtagccctagctacctgggaggctgaggcaggaggattgcttgagcttcagagttgaaagttgcagtgagtaatgatggtgccactgcactgcagcctaggtggcagagcaagaccctgactctaaaaataaaataaaatggtgccagtataatttttttcatgataaagtaatagctggtagtgatacttgaatgttattgaaaagtgaggttagaaaataagcaaactttgtcttgtatcgaatataattagaaataatatagaacagggatataaaaatttgaatttggttgattcccctccaaattcttgaaaaaaaatgaaaagaaaattgaatttggtaataaaatgagtatttagtttgaaattttacaaaatcattatttattaactgtttttctttacagaccctcaatatagtaacctggtctccctgtgggcaatatttagctgcaggtagtattaatggtctaatcatagtttggaatgtggaaaccaaagactgcatggaaaggtatgatttagtgtatcttttgtctcttctttgctcatctctattagttttgtatttgttttattttgaaacatttcaaatttgccatcagattgtcagaatgaaagtataattaaatttatattatttataaattattgtcaaaagtcatttattctttcctaactaaaatttacctaaagaaatgtacaatttatatttttcttgacagtatttttagaacctactttttaatttttagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtaaaagggagtatggtacaacagtttcttcaaaatgtttctgtgatcatatggatttggaagacaccacaaactgccttactttcttggaaaattacctttcatgttactatagtagatgctgagtagtaatctatagtaagaaaacttcttacttgttcaacctgatgtctcccaagtgtattttactaagaaacttttttctctccatataatgcctttccaaggaatacctttcattaaatactattttgtatcaggtctcagtttggcctgcaaactgtttctactctgaattagccttaactcttagaactacctatacacctcctctgcttagtcaaacagctttactgagcaactttaaacaggcaccttgttttataccttcttgcttttgttcattattcaccctgcctggcagatgtacctatttatattcaagtcttagtttagacttctggttacagattgcagacttaatacatgcatttatagctgtccctcctgaaacccccacaaaaactatactaaaggcattttcttaaatgcataatcccataaggttaaagaagtcagttgaagggatgattataaaaataattttgagctctgctgcagtgactcacacctgtaatcccaacactttgggaggattgcttgagcccaggagtttgagatcagcctgggcaacatggtgggaccccatctctacaaaaaattaaaaaataaaaattaggcaagtgtggtggtgtgtgcctgtagtttcatgctcctactcagaaggctgaggtgggaggatcactagagcccaggaggttgaggctacagcaagccgtgattgtgccactgcactccagcctggatgacagtgataccccatctaaaaaataaaaataaaaaagtggaggctagaaaatagaaggatgatgagaaactcacttcagcttctcaaaaagttgaattctaaaactgtagtttctggaagttgaggtgctactcagtttgcctcactgaatccccagagattcagaatttggtagcactaggtgcttctagaagtggggctgaaaacaggagaggtgatttaataagcacatagagtgttctagtctcaacatctgtgttcaaagctgggtacctgccctcccccatcttcacatgcattctggcagaatgttggagatttgtttttttagaaaagatgaaatagactgtccttggtctagggacactggttacagttgagtggtcttgggtaagggggaaatactgtactgaaaacagaggattaaatgaaagattagatacttgaatgttgaaatgatcatctcacttctagtaggttcccagaacattgtcagccattcttatgcatttcaggcaggagattggaaaaatcatctttggggaatttgtctaagagaaaagacgtaaagagagagtttcttaactccagggaagacaaaaagttgtaaaagaaaggaacagtgatcataatatactgtatgtgtaaaaagataggaataatgccaaccacttggggttattgggaggattaagtgaattatgtatagttagaacagtgtctagcacacttcataagtttggcatactttataagtgttggctattatttttattattcagccatgaatagcatttacatgatcttaataacctaaatactgtatattgattgaaccacaaggaggatatatctatctatattgggagaattggggtcggagagtagtgtacatgcaagcatggcggttggggtggttgtgaaagggtaccagatcctcatctgccatagatggaagttaataggatctgttaaacacaatgattaaaagtgaaaaaaaaaaattctactagaatatgatttacaggtatggaagaagtagcaaagaaacaactaaaagagctggaaggatttattctgtagagaagtaaattggggctgtggagaggactgttttcatagcacgccttgtaaaactgcctaactaatatatatgcatgtgtaacattggtaaaaacaaaaagtgaattaagaaaaaaaattttggctgggcacggtggctcacggctgtaatcccagcactttgggaggccgaggccggtggatcacctgaggtcaggagttcaagaccagcctggccaacatgacgaaaccccgtctctactaaaaatacaaaaattagctgggctaatttcacatctgtgaacattttatcgccttcatcataaatatgaggcacagtcctccattaaaaatttttttttttctttgaggcaaagtctccttctgttgcccaggctggagtgcaatggtggctccctgcaacctccgcctcctgggttgaagcgattctcctgcctcagcctcccaagtacctaggataacaggcacccaccaccacgccctgctaattttttgtatttttagtagagacagggtttcaccatgttagccaggctggtcttgaattcctgacctcaggtgatccacccaccgcagccccccaaagtgctagggttacagacatgggccaccgtgcctggcctccccattttttttttttgagacggagttccgctcttgttgcccaagctggagtgcaatggcgcgatctcggctcactgcaacctctgcttcccgggttcaagtgattctcctgcctcagcctcctgagtagctgggattacaggcttgtgcccccacgcctggctaatttttgcatttttagtagagacggggtttcactgtgttagccaggatggtctcgatctcctgacctcgtgatctgcccacctcggcctcccaaagtgctgggattacaggcatgagacaccatgcccggcctccccattttttttaattagaaaatccaaaaacaattttttgtcagcttgagtacacaaacttttaggactataaatggaatggttgaatatcttcttatagcacttagttattaatttactcatatcaagtatttttcaatgtatggatttagaaacactttttcatctcattttattaaacatcagttttcagagcacagttatgtttacttccatttaaaaggtttatgagggtctgggtacggtggctaacgcctacaatcccagaacttttggaggccgaggtgggtttatcacctgaggtcaggagttcaagaatagcctggccaacatggggaaaccccgtctctactgaaaatacaaaaattagccaggtgtggttgtgtaggcctgtaaacccaggtactcaggaagctgaggcaggaaaatcacttgagcctgggagatgaagtttgcagtgagccaagatcacgccactgcactccagcctgggtgacagggtgagactctgtgtcaaaaaaaaaaaaaaaaaaaaaaaaggctgggcgctgtggctcacgcctgtaatcccagcactttgggagtctgaggcgggtggatcacgaggtcaagagatcaagaccatcctggccaacatggtgaaaccccatctctactaaaaatacaaaaattagctgggcatggtggcatgcgcctgtagtcccagctacttgggagactgaggcaggagaatcgcttgaacccgggaggcggaggttgcagtgagccgagatcacgccactgcactccagcctggcgacagagcgagactccactctgtcaaaaaataaataaatgaaaataaaaagtttatgatgtaatactttttaatctgttaatggtgttctcattagacttataccaaactataaatttccattggcttaacatttgtagtttttatgcatcctataggagtaacttgggatctttgcagtgtatctgcttaccatttcactttttgaaatgatctaaaaatttatttattttgagacagggtctcactctgtcacccaggctggagtgcagtggtgagatcatggctcactgcagccctgaccttccaggttcaggtgaccctcctacctcagcctcgcaggtagctgggactatagacacatgccaccatgcctggctaattttttgtggagatgaggtttcatcatgttgtccaggctggtctcgaactcctgagctcaaggcatccacctgcttcggcttcccaaagtgctgagattacaggtgtgagccaccatgctggggctttatgtagaatttctttgccttctttgtttttctattggttctatcactttatttttataagtatcaaaacactaactttaactgagataatataaagaaaatgtatcttatgcagtattttgttcaaaataaaagtaaatgagagactgtcttacaatatgacagactttatagggactttatcatattaatatcacttcttttctagggaatgacttctgaggaataaaatcttattttatattttggcatatacagtatttgtttacatgtcagtccctatactcccatcccatccccagactacaaggcatttgaaataaggactgggtcttattgtgtaaatataaatacaattctcataaatacatttactaattattcttatctgttcagtgagtttgctgcttggtagaatttataggtgcatattaaaagtttacctttttagtaattgagtttttctaaatcattcacttttactttataatttgtattaatttgttcaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttggtaagaatttgactttgtgcatgtgattaccctgttgattaatattttagattttttattaacactattaaagtcattattgaatttgtagaatgtagctaagtggtgcttagaggaaattttatagcattaaatgactttgttaaaaaaggtttcaaatctataatccaagcttctgctatggcagactagaaaaagagaaaactaaaccccaagcaaatggaaggaaataatacagagcaaaattcaataaaattgacaacagaaaacctatagagaaagtcaatgagaccaaaagctggttctttgacaagatcaataaggccgggcacggtggctcacgtctataatcccagcactttgggaggctgaaatgggcagatcacttgaggtcaggagttcaagaccagcctggccaacatggtaaaaccctgtctctacaaaaatacaaaaattagctgggtgtggtggcacgtgcctgtaatcccagctactcaggagactgaggcaggaaactcacttgaacccaggaggtggaggttgcagtgagccgagatcgcgtcaactgcatgccagcatgggcaacagagcaagactccatctccaaagaaaagaaaagatcaataaaattaataaatatctatcgtggttgatcaataaagagaagacacaaattactaacatagagaatgaaagagaggtgggccatcactatagatctgtagatttgtgctatccaatatatagtagccactagccacatgtagctgttgagcacttgaaatgtggttagttcaaactgagatatgttatgagtgcaaccggattttttttttttttttgaggcggagtctcactctgtcacccaggctggagtgcggtggtgtgattttggctcactgcaacctccgcctcctggattcaagtgattcttgtgcctcagcctcctgagtagctgggattacaggcatgcgccaccacgcctggctaatttttgtatttttagtagagatggggtttcaccatggagtgcaaccagattttgaagacaatatgaaaaaaagaatgtaaaaatcttgggaaattttttatattgagtacatgttgaaatgataatatgtattttaaatgcactatattattaagattatggctgtttctttttactctttaaactttagaaatattagaaaatttaaaattacagctgtaactcacattatatgtctgtatggcagtgctactattaatatcaaaggcataatggcaatattatgaataactttgtgcccataaatttaacaacttaaatgaaatagacgaattttctgaaagacacaaagtaccactgctaactcaagaagtaatagataacctgaatagtattgtatctattaaagaaattgagattgtaatttaaaatcttcaaatagagtgcttattgtaacaacttacatgctacaataacacttgaacattatcaagtaaaatgaagaaattgagattgtaattgaaaatcttcaaatagagtgcttattgtaacaacttacatgctacaataacacttgaacattatcaagtaaaatgccaatgtgcagtgctatgttgtgctttttaaagtcatatagagtttatagaacagcagtcctcaaatgttttggtctcagtagcctttatactctaaaaaattttgaggacccttccgagagcatttatttatacagagttacggctatcgtcatttacatattagaaattaaaattcagaaatttaaaaatatttattcacttaaaaataacattaataaactcatgtaaacatgaatagtacttttttatgaaaaacaaaaaaaattagtgagaagagtggcattgcaatctttgtaatgtctatcatagaggatagctggattctctcatctacttttctggattaagtctattgctatacattgtttttgtttgaagtgtataaagaaaatttggcctcacataaatatgtaatttgaaaagggagaagtattttaagaaatcttttaatagcacattcaattaattgtggatattctttgatgttgcaccaagactcagaagatgatcgtttcctaaagattacttgcaaagtgtaatctgaaaacttcagtgaactcttacggctctgttatgttaagattcattggtctggctgggaatggtggctctcacctgtaatcccagcactttgggaggcccaggcaggaggattgcttgaggccaggagttcaagaccagccagggcaacatagtgagacctcctctctacaaaaaaactttaaaaattagccaggtgtggtgacgtgtgcctgtaatcccacctacttgggaggctgaggtaggaggatctcttgagcccgagaggtcgaggctgcagtgagccatgattgcaacagtgggctccaggcagggtaacagaacgagaccctgtctcagaaaaaaacaaaataaaatcaaaaaattcattggtctgacttgaatgttgaatggattttttaaaatcatgtttaattttgtaacatatgaattgataatattggttcactgaagtttatagatcctctttatactgacactttttattatctaatataaattatttgtttttgtttttaattaattatatgttgtttttaattaattaatttttgtttttagagatagcatcttgctctgtcacctaggctggagtgcagtggtatcatcacacctcactgtaaccttgaactcctgggcttaagcagttctcccactcagccttccgggtagctaggactacagatgcatgccaccatgcccatctaattttttattttttgtagagatggaatcttgctttgttgcccaggctggtcttgaaatcctggcctcaagtgatattccctccccagcctcccaaagtgctgcaattacaagcgtgagtcacagcacctggctgtaaattatatctgctagtgttgttaccaatctcatcagtagtttctaagtattagaaagttgtgaagctcataatggcaaatagaagctttccaatatcttaatttttaattgaaagctcaaatttcttgtttttattttttgagagggagtcttgctctgtcacccagcctagagtgcagtggcacgatctcggttcactgcaacctctgccctctgggtacaagtgattctcctgcctcagcctcctgagtagctgggattataggtgcccgccaccatgccaggctaatttttgtattttagtagagacggggtttcactatgtaggtcaatctggtctcggactcctgacctcaaatgatctacccaccttggcctcccaaagtgctgggattacaggcctgagccactgtgcccagctcttttttttttgagacggagtctcccgggttcaagcgattctcctgtctcagcctcccgagtagatgggattacaggcatgtgccaccatgcctggctaatttttgtattttcagtagagacagggtttcaccatgttggccaggctggtcaacgtggaactcccgaccttaagtgatctgcctgcctcggccttgcaaagtgctgggattacaggtgtgagccaccgtgcctggcctgaaagctcaaatgttatcattggcaacaaattctgccagttattttttcttaattgataggctcacttcattcatttacaagaaaatgtttgccaaagatccaattctgcataaccgtagtttatctggcatgtgttttttaagtaaaagtagtgttgtatgaaaaaaaatcacttagttcagcttacaactcaaacaattgcataagtgctttttttcaagacaaccatcacacttctcattttagcacacagaactttaaaaaaaaaatctgtgtaagcgtcaagatttaataaaattaatatttttactgcaagtgagtagtggttaacaatgcagtaacgactaatacagttaggtgccactgccttgattggtgccaaggcaccaggaattttacccaccattgcttttgcaccatcactgcatctctttaacacagtgaaagaggcaaatagcatgtcagtgtcattgaatatgaatgaaaaagttactagattccataatgctttcctttttccaaatcattggtattcgtgattcccttaattatgatcctttgtgttgtagatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtaagacttggatctacacttaacttcttagtaggttttcagcacttttttcttactatagttaatttttttggataaaacatatttttaaaaactttgattaagtagcctggagcactttggttgattacagttttgtggttggtttattttatggttagctcacagttttaatcttgtttcaaccttattgaaaatgatgttaaataaaattctgctttccaaaatgacattaaatgaacataagtaaatattactatcttgcaatatttcttggcaatactttcaaaccttattcttcatggtcattgttacatagaagattatactgactccaaaacactagtaaggaggtgctttcttagaaggcaactactagtataatatattagaaggtggcaagtactatggggggaaaagtctgacccttttcctcactccaccacccaccagaatgtaagctacacgaggataaagatttttgttttgtttactgatatgttcttaggatttggaacaaggtatgatacagtgcacattaaatatatatttcatgaatagacaaaatgaatatattggctttttgccttagatttgagttctttttttttttttttgagatggagtctcgctctgttgcccaggctggagtgcagtggcacaatctctgctcactgcaagctccgcctcccaggttcacgccattctcctgcctcagcctcccgagtagctgggactacaggtgcctgccaccatgcccagctaatttttgtatttttagtagagatgggatttcaccatgttagacaggatggtctcgatctcctgacctcgtgatccgcctgcctaggcctcccaaagtgctgggattacaggcgtgagccaccgcgcctggcctgagttcttaaaaagtttagtttttctgtgttggttatatgatgttttccattctgaggattttgcctttttaaaagtataggcctggcataaatttgaagagtataggcctggcataaatttttatgtaaagattaagggtggtgattaatattaataaaactttttattgctatcagtagtcatcaagtcataggtcttaatttttttattagtgtcaatattttatttatagttatgttaaataaaatattggcactaattttattagaaactctagggcctagtgtgagcctataatggacatcagtggaagataagttttccaagtggtatcaatttatgttgcctctgccgggcgtgatggctcacgcctataatcccagcactttgggaggccaaggtgggttggtcacttgaggataggagttggagaccagcctggccaacatggtgaaacaccctatctctactaaaaaaatacagaaattagctggacctggtggcatgcacctgtaaccacagctacacaggaggctgagggaggagaatcacttgaatccaggaggcagaggttgcggtgagccgagatcatgccactgcactccagcttgggtgacagagcaaaactgtctccaaaaaaaaaaaaaaattatgttttcttaaaatgtatgtatttattttatcatagaatagttaggaaaaaagtctgttgttatttgcatccatatttgtaagaaaactcaatttttgaaatatttcttttgaggaatttaatggtttggttgttcaaaggacaactgtaatgtgcttttaaagtaacagtcatgtaatttatttttaaatattattaaatactctatttgctaattaataagtatatatgtatcttattctcaccaaggaaataataagtaattgtagctctggtattatgactcctgtcagaaactatttagagatagatgagatgtagtaactcccaaaacctaaatcttaatacaaatttaattataatatttgttaatttgtactactgtggcttactgattctaggagcttcagtttttctcagacttatatttaatcttacctgtttgtaggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaaggtaaactcaagattattaggaagaatttggcactgttgaactgttagatacagttgttgaaattaaagacaaaaagttaataaaacaaaatttattttttgtaatatgaaatttcagaagagtttggtacaaacaccagcacacccaaaatacctcagaacatatgtctgtttttgccataatgattccctcattacatgctctaactacatagcaaaatgacatggcatagttagtaatgcaagagatgggattttttttttacattgttaagtgcttttttttttttttactattataagagtaatatacattcattgtaaagaaaaaaaaccagtatacagtatagaagtttcggaaaatgaaaactcctcccagaattctactctcagatataactgctatttacaatttgatatgtatccttccagatttctttctatttgaacctcccttattttaatttactttattgagatgtaatttatttacaataaaatgcacccatttgatgagttgacaaaggtgtatatacacagataacccctaccacaatcaaaatacagaatgttctttatcacccgaaaatgttttcttatatccctttgcagttagttcaaccctagccttggccaactattagtctagatttttgtcactacgtctttatcacccaagaatgttttcttatatccctttgcagttaattcaacctgagccttggccaactattaatctacatttttgtcatgatggattaaatttaaaatctctcttcgagaaaggaaaaaaaaacggaaaaacaaaccaaaaaatgtactagtcacccgtttgctttttctacttaatattttttggatgtttacatgttttgataagtaggtaggtaagtaaataggtagatagatgtcaagaaaaaaattatgatgggaaagcaatgggtgcagaatgtttttcttttcaaaagaaaagaaaatattttttcagctttttgttaatcaagagattgccctctcttgatcccttcttcagctgattatagtactgatacacttcatggattttactatcttctatgtgatttgaaatttgtatccttcaggctgggcatggtggctcacgcctgtaatcccggcactttgggaggccaaggcggacagatgacctgagctcaagagtttgagaccagcctgaccaacatggtgaaactgcatctctactaaaaatgcaaaaattaaccaggtgcagtggcacccacctgtagtcccagctactcgggaggctgaggcaagagacaggagaattgcttgaacctgggaggcggaggttgcagtgagcagagatcacaccactgtactccagcctgggtgacagagcaaaactccatttcaaaaaaaaagaatttgtatttaataataacttacatatatgtatgtgcaaagaaaaaaggctggaaagatatcaatatagttcattttaagggtatttcataattacttttttaaagcaacttcttatactagtgtataataggaagtaaactatttggtttttttgttgaatatcatgattgcttatatatatatatatgtaaatatcatatgaaagtttgattgtttctgtcttgttttaatttttagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtagatttttttcagtcttttatgacttgaagtaaaatggaaattacttgagcttttttgctgtttttgttactctttttgtcttggattatatacttccttttgaatccgtgtaatctttaaatgtagataattttgttgtgttcactagcagcaatgaaaatgaaaatgtttcttaatagaactatattatagagagaattccaaggtggaatttggttaattacttccatgtctaaatcttaccattttggcaagcacgaccagagaactttcagcgttgaaattccacaaaaataactcctagtaggaagggccaaaacaactctgaatgtgacactttttaaaagctgctgcctcctttttcctcccctcatgtctttcttcagtccccgtcactatgctaagactggtcttatcaaggtaaccgataatctctgtgcttttttaaaaaaataattccattgaaaataccttcttctcatgacttctgtgacatcatactttcaatatttttcctcactggcagctccctttttacttttttgttggctctatcttttagctggagtgtatcccctttttctctactactctctaggtcagggtctttcagtctttttgtctgctttgccacagtaagaaatagattcatagattctggaccaggtatggtgtggtgtggtgtggtggctcacacctgtaatctcagcactttgggaggccgaggcgggagagttgctttagcccaggagttcaatacaagtctggatagcaatagcaagcccctgtttctatttttaaaagaaaaacagaagaaaagaaatatattctatataactgttctataaatatctgcaaatgtaactgaaataaaagtctcctggacaatgtttactcttttgatatcagtttaaatttttttatttcattttttaaaatgctagttgcaaattaaaattgattccatgactcttaggtcaaaatatgcagtttgagaaaccaccctggggaattttatcataatccatggctttaaatacatctcagtgtctatgacttttaagttgatagcaccaaccctaccctctccttgtgtctccagacttacacatccagttgcctacttgaaatctatttagagtttggacagacatttcagacttaatttgctcacaataaaaactgatttttttccttccaagcttgcttcttatgtagtttccccatcttagtaaatggcttactaacaatctagtggctgaagccaaaaatctaaaaattatcctcgattcttctctttccatttcccctgcatcaactccaacagtaaaattatatcatcatgtcaattctatggaataacacattctaaatttgtctcttttcatttcttctgctaatacaacctggatgtcatctcttggactgtcatagtagcctcctaactagtcttttagcttcagttcttgccttccacagtccattctccacagagcagcctaggtgatcttttaaaaatatagatcatgctcctcttctcaaatccctctgactttccttcacttttagaatcaaagtcaaacttctgatagctgtcaaggtgatctactgatcccgtataatctgacctttgcctgcctctccaacctcatctcttaccgttgtttctcattaccatgttctggccatactgcctctttgtgttcttcgagccctccattcttcctaccttaggactttgcattagctgttccctccatccacttccgtgttccttcccctaatgtttgcatggcaggctccagcttgcagttcatgtctcagcttaaactttactttctgagaggtcacttctgactaaccagtctaacaaaccactctgacattctgtatcacattattttaactttgtgataatttttttgttctttttgtgttttttaatttgtcttctacctgaaatttgaatttaataagagtggtgactttgtttattgctgtagccccagtatctaggccaatgctggcgtgtagtaagctctctgtaaatatgtcttgagtgaataaatgcccacttataaggactttatgtgaagagtccatgtaacatcttactgtgtttctaatacctgaatgatgcctcagttggatgggttattcataaaaagtagtgctagtcagtctagtaatttaccacaaaatcaattcacagaaaataatttagactgcgttatagttggataacctttgatgcctgatttatatttacattttctcattaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggcaagataaatttgtttaaaaaaaacaagtataatataaagtgttagatattcttcaagaagaaaattatttcattgttttattcctaattaatttaagaataaattatctctattttatattttaaatttctattttaatatgttggcagaactgggagctgcaatctttaggcaaggtagccattgttttatgtataagatcttgtttttatttttatgttcttttaagacagggtctggctctgttgtccaggctggagtgcagtggcatgatctcggctcactgcaacctccacctcctgggcttaagccatcttcctacctcagcctccttagtagctgggactacaggcatgtgccaccatgcctagctaatttttgtattttttgtagagacagggttttgccatgttgcccaggctggtctcaaactcctaggcgcaagtgatccacccaccttggcctcctaaagtgctgggattacaggcgcgagccactgcacccggctaagagctctcttcatgagaattctcattagaaaacttataaagaaggaaatatatttttctgaaagtattaaatagcaaggaggtgatacaaatcaataataagttgtgtcttttccagcagatcatacagaaaacttagaattttctagagcttcactgtttactacaataactagtatgtgtgtctgttgagcacttgaaatatggctgagatgtgcttgtatgtgtaaaatactctggattttgaagacttagcatgaaaaaagatataaaaatcaatttttttatgttgattacatgttaaatgataatatttgagatatcttcgatgaaataaaatgtattattaacattaacttcatcctttttttctttaaaaataattttttttttggctgggcatggtggctcatgcctataatcccagcactctgggaggccgaggcaggaggatcacttgagcccaggagttcaagaccagagtgggcaacatagtgagatcccatctctatttaaaatttttttttttttaaggaataaattaggagtcttgctctgttgcccaggctggagtgcaatgatgcgatctcagcttactgcaacctctgccttccgggttccagcaattctcctgcttcagccttctgagtagctgggattacaggcttgcgtcaccacactcggctaatttttgtatttttaatagagacagggttttaccatgctggccaggctggtcttgaactcctgacctcatgtgatccacccgcctcgacctcctgaagtgctgggattacaggcgtgagccaccgcccccagcctaaattttttcacttaacttttttttgttgttcagatacatggtatgtagccattttttttttaatgtggcactaggaaattaaaaattacacttgtggctcacatgatatttcttttggataagtgctattttagaccaaattctagaggcttatgacagatgatttgaaagacactgaggagtaccttattttattttatttgtttttgtgtttgtggtttttttgacgcagagtctcactctgtcacccaggctggactgcagtgatgtgacctcagatcactacaacctctgtcttctgggttcaagtgattctcgtacctcagcctcccgagtatctgggactacaggcacataccaccacgcctggctaatgttgtatttttagtagagatggggttttgtcatgttggctaggctggttttgaactcctggcatcaggtgatccacctgcctcagcctctcaaagtgctgggattacaggagtgagccactgcacctggcccaggagtaccttattttaaatcacctgtcatctctgtctcatggggacttaaatatttctctttttggagattcatgttcttcatttacattgctggaaactccactttgtctttaaaatatcaaccatttctaaatgtgttttctattagtcattcaggctttaataatatgaaccattgataacttccatttgtatagatttttttctccgaagtaccaattagatccagaccctgcggaaactaatgtttgcagagtgaggggggtgtgaagccacagataagaaaagggataatcaggtaatttgccacagatttcctgagttggaagcagaataggtggaaaacaagaatgcttccctgttttacgaggtaagaattgcttacctagtagttggggacagagtagtgacaaggccaacaaaaagaagagagaggaagaagagtactaaagataaatttcgtaaagatcactttgtatcagattttggtcatttttctaaatgtttctcaagcgggagccttctgattcatgtttaattttttactaaaattggctttaaaattattatcggccgggcgcggtggctcacgcctgtaatcccagcactttgggaggctgaggcgggtggatcacaaggtcaggagattgagaccatcctggctaacatggtgaaaccccgtctctactaaaaatacaaaaaaaaattagctgggcgtggtggcgggtgcctgtagtcccagctactcgggaggctgaggcaggagaatggcttgaacctggaaggcggagcttgcagtgggccgagatcgcgccactgccctccagcctgggtacacagcaagactccatctcgaaaaaaaaaataataataataaataaataaataaatgaaattattattatcttccagcaggtggcatagttttcactgaaactcagttttttcactttatttgtgtaaattttagtcatatcaaatccaatgttttttctttttttagttaggtcttactttatatggttaatgaaattttacgtaataatcttagattatttgcttctgttttgtgttttgcttttgaaagcaaagttgaatccttggtatgtataatatatttgaaatagggttcctttaacaacatgtagctatgtctccaagtgatttttctgttggtgtttaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgggctattaaaagaagtctaaagttgactctttttaaaaagtatgttgaaattctttttatgaggccctttaagtgtatttgtcttttatcttagtccaattacttgctttccatagtcactaaattaggaatttgttcatattcactctgaagttttcagtcacttgctttacttgaaacatgttgaacaaaatagaaataattaggatgaccttaccatcatttcagccacacagggagaggaattctgattaaacatggcatttcaccttttattactgtcttttattttaataaaataacaataaatataaaagttaaagtgaaaataaaacaatatatattcaattgagaattgaaatatacaattaagctgctttttgagatgttttgcttaattatcgtaataggaggaaggactaatagaagacagagtctcgctctgttgcccaggctggattgtagtggcgtgatctcagctcactgcaagctccgcctcacgggatcacaccattctcctgcctcagcctccccagtagctgggattataggtgcgcaccatcacgcctggctgatttttttgtatttttagtagagagggggtttcaccgtgttagccaggatggtttcaatctcctgaccttgtgatctgcctgcctcggcctcccaaagtgctgggattacaggcatgagccaccacgcccagctgagtttttttttttttttttttttttatgtggagtctcactctgtcacccaggctggagtacagtggcgtgatctcagttcactacaacctccactttgagttcaagctattcttctacctcagcctccccagtagctgagattacataggcatgtgccaccatgcccagctaatttttgtatttttagtagagacagggtttcaccatgttggccaggctggtcttgaactcttgacctcaagtgatccacctcaagtgatccacccaaagtacaggcatgagccaccgtacctggtcctggactaatagtattttatattgatccgtgtgcacattaaagtttgggaagtactgctgctggcatatgtataaaatgatacattggctgggtgtggcatgggatttctttttggggtgatgaaaatgttcagaaattagtgttgatagatgcacaattctgtgaatatacaaaaaaaccactgaattatgtcttttttttttttgagacagagtctcactctgtcacccaggctggagcacagtggcccgattatgtctcacttcaggctcacttcagtgacatcctgggctcaagcgatcctcccaccttagccttccaagtagctgggactacaggcacgcaccaccacacccagctactttttgtagagacagggtttcaccatgttgcctaggctggtctcaaattcctgggcttaagggatcttcccgcctcggcctcccaaagtgttgggattacaggcatgagccactgtgcctggctgaattgtatacttaccatatgatatggctggtacattctctgtgaactcaatattatgtgaatcatatcttgacaaagctgttaaaaaggatgaggacactatataatgatatagaaaaatctgcaagatgtgttaagtgaaataaataccatttgtgtaaaagtggggaaagaataagaatatgtaattgtatttgctttacatacgcaaaagaattcctagaagaatgaaaaggaaactaacaataatagttacctcacggagagaaactcagtggatagtataggagacttttctctgtattcatttttatactttttgagcatgtaaattgagcatgtaactttgaattactagttcaaaagttaaataaattgaatttttaaacaaagcagcaattcaataaactaaatcagataaggccagaagttaagttcaagaagacttcttaatttggctacatggaggttaacggtgactctgataaaagtgataaaatgttaaattccagattggggtgggcatgggaggtaaagaaatgaaagtagaatatgtggataactcttatcaagaaatttgactattgggccaggcgaggtggctcacgcctgtaatcccaacactttgggagcccaaggcgggaggaatgctggaggccaggagtttgagaccagcctgggcaacatagtgagacccagtttcaacaaaaaaaaatttttttaattacccaggcatgatggcacacacctatagtctctgctacttgagaggctaagaggggaggatcacttgagcccaggaggttgaggttacagtgagtcatgatcacacctctgcactcctgtctaggcgacagagaacctatctcaaaaaaaaagaactttggtgtgaagaggagcaaagatttggggtggcacctaaaggaggataaaaagtctttgaagggattttttagcttaggtgactctatagcatttttgtaatcttttggcaatgaatttagtaaagaagataagattgataatttaaaagaaggagccaatgaaaggaatgaaaaaagaaaaaaaagtagtagcttttagatcacctgtctaaaataggaaaatagacatttcatcagttctggaaagggaaaaaaataggcacaaatgcagatagatttggtagccaaaaggtaacaaattcctatcttctgtttttggcttctgttttgttggcagatcatgaagcagaattcagttatttctggagacagtggttggcattgtgggatgtttgagaagaaaagacatatagtctcagaggatgcaaaattgaattagtagagaactacagaggaattggtggttatttctgtgtgttttgcctttacagttgtaatcactgaatattacattctaaatattgacatatttagtatcagaagaagtatattcattaacggttttttttttttagagccagggtatcactcatttgcccatgctggagtgcagtagtgcagtcatagctcactgcagccttgaattcctgggctcaagtgatcctggcacctcagtctcctgagtaggtagaactacaggcacaggctaccacacctggctaatttttaaaaatattttgtaaagatggggtctcaccatcttgcccagattgacctctaattcctggcctcaactgatcctcttgcatcagccttccaaagtgctaggattataggtataagccagatgccaagccacattcactatttttagtagttcttatagtgtaggttgttctcagtgatttcttgcatgtccattttcaggaatctagttagtttagtaatttgaattaaagaattcacagtctatcttaatagtaggttaaggtttgaacctatgaggatttttactattctgcctaatgcttattcaagtaagattattcattttgttagtgaatgtcattatcttagaggtatatgaaattatttatttgcaatatatgaaattagtcatctgcaatgaacaattttgcttcttcatttcatttaatattacaagtatttcatcaattgcagttttcacacccttagtaatttatccagctggctttttttttcttaacatgctttttttttttttccacacaaccctttggaacacattttttacttgctttttatttaagatttgtaaagaattttaacttgttaaaaactacgataattacagctggtaacatttaactgttatattcaataatggataaagaaataatggactgtaaattacagcttttacacttagaaggattttagaaaccgtctatactagtagctcctgacattttcaaatataagagccctttttatttatttatttagaaacagggtctccttacgttatccaggctggacttgaacaagagtccttttttaaatgttgaacagttcatgcctccaaataatagtagctctagtagctctacatttagtatcagctaataaagaatatttctttattgagacacagtctcgctatgttccctaggcttttcttgaactaacctcgagtgatcctcccaccttggcctcccaaagtgctgggattacaggcatgataacataagcttctgtagacctgaaaattttattttaatataaaattgtatttacaaatcacgttatctgcatacatgtgaaaattttagtatgtaaagtggaaactatttttgtatttggtctacagacaattcatggtgcttgtgtgcattcctagacactttataatagctcagcagccctacaggaataaaagaatgggaactaccaagttcttttggtctatttgctgtctctcttcacccccagcacttctccccaatttttacatatgagaaaactaaggtccaaaaagattaaagtaatttggtagagagtacacatctatttattggcaaaaaaaaaacaaccttatttttttgtattaaaatataggaacaaagggagttagctgataagtagattgaaagaataaatacttctcctataaagaccagcttgttgtagaataattgaattactgaggggaatcttatacagtaggcatttgaagcactgagaagatacactaaaaaatctgttgatagaaatgtatttatttgtatattatgtgataaattgataactgcagactgttttcatattttcatattttcctggctttatgctggaataataaacttgaataagaatatttttctttttttttggtacacccttgtagaacatttatttatttattatttattatttattttttggtatatagccttaaatatttttcaaagattggaagcaacacttctcagtatggcttactgtacttttcacaccagttttgcttaacatgttggcatatttagagatgattcatttcctttctgtggatagcggtacatggaagttcggggaataaaattctgcaatcacttttttagtagcctgctgttgtgtttaaagagccttacctattttggctagcaagaaattcatttttggccaggctttgtgactcacagctgtaatcccaacacatcgggaggccaaagcatggggatcacttgaggccaggagtttgaggctagcctgggcaacatagagagaccctgccaggcatggtggtacatgcctgtagtcccagctgctcgggaggctgaggtaagggtatgacttgaacccaggagttcaaggttatacagcccctgcaccccaacctgcgtgacagaaggagactttgtctctaaaataaaaaggaaataaagaaattcatcttcatatttatttgcatttttaatgcctctgtttgctctcattgtttgtgataaagatagcaaatcacatgcttctctggaaagccaatgtggcctagtggtccagagctcgagctctcgagtgacactgcctgcttgtggtatcctggctgaaatcctcgttcagtagccctggctctgtgccactgtttcctcatctctaaaaccacagtgtacccatttcacagaatttctgtgaagatgaagtgacttagtgatacctctttctttattcttttaactttaaatgcattttctaacccaactcagtggtatttatgctttctttttgttcagagatcctttaaaagaaagtacattttgtgaaaaataatttttaaaaattcatttgagagcgtgtcacatcggtgcacacctgaataccagctacttaaaagacaggggcaggaggatcactggagcccaggagtttgcagacagcctgggcaacagcaaaaccccgtctctttaaaaaaaaaagcattaatttaagtcaatataaaattttcctattttcctttaattatgaatatgaggttgggtgcagtggctcacgcctgtaatcccagcaccttgggagggcaaggcaggcagatcaccctgaggtcaggagtttgagactatcctggccaacatggtgaaaccctgtctctactaaaaatacaaaaattagccaggcctggtggcagatgcctgtaatcccagctacttgggaggctgaggcaagagaatcgcttcaacctgggaggtagaggttgcagtgagccgagattgcgccactgtactccagcctgggcaacagagggaaactctgtctcaaaaaaaaaaaaattatgaatatgagaaattactgatctgtattaatgtcatccctgccccctttgagctgaacttcagtttaccaagtattgtttcttctaaagattttttcatgacactactggttaatacataactgagagttaataaattttgctgtgttacagtctaatttgctctctaccaacagagaccttctttctttttctgtttagtttttcaaaacaagagttatttaatgtgcttgaaaactagacatttttcctagttgtgttcactgaattagcatttattatagtaccgactagatgtgctataccacacaaagataaatgaggctgtggcctggaagaggtaggcttgtaaagtcattatgctactcccaaataagtgctttaaaagagatgtgagcaaagtcccctcaaatgcagaagacagtccggtccaacacagaagaaaaagcaaaacttgctggctggggcaaggttaatctggacacgacctagttttctccagtttggcatttttatttattttttcgagacagagtctcattctgtcatccaggctagtacagtggcacaatctcatctcactgcaacctcctccttccgggttcaagtgattcttatgcctcagcctcccaagtagctgagattacaggcatgtgccaccatgcccagttaattttttgtatttttagtagagacagtgtttcgccaggttgcccaggctggtctcgatctccagagctcaggtgatctgccggccttggctcccaaagtgctgggatattacaggagtgagccaccacgcctgattattttggcatttttaaactctttctttaatataacaaaaaaaaaaaaaacaaaacaaaacaggttttgtggtcaatttgaaaacaaattgaagtaattttttttttttttgagacagaatctctctctgttgcccagactggagtgcagtggcgtgacctcagctcactgcaacttctgcctcctggcctcaagcgatcctccgtcctccgccttccgagtagctaaagctacaggtccatgctgccatgcctagcaaattttttgtattttttgtatttttttgtagagacgaggttttgctatgtagcccgagctggtcttgagctcctgagctcaagcgatctgcctacctcagcctccttatgtactgggattacaggcatgagccactgtgcccagccacttttgtctttttagtaaaccaggtttttcattgtttttttttttttaaattcctcttccaggtggtttatgcacatagtttccaggaaactccgtcgtcatcaaaacccaccaaattagcagtttaaatgtgtttgttttttccttgaattcttctatgacggggatatttaacagagaaaacatctttttagttgaagtctctaaagctaaggaaaggataaaaaaatgcgaattggtgctctgctttgatgtaaatgtggcttagaaagtaacttaataaaatcctactcagtatttcctttttctttgtgataattgcttactatgtgtaaatcaataaagtgagctgtaaaatgtttttaaacaggacattttagaaaaaaatgtttaggcaattaacatttctcacagtgtttcttctaattttgttaatgtacatatatatgtacctggactcatcttttgtgaatgcacatgctctttttcattttgcatgactagtaaagtagtgattcttgtaaatagagatttatgacagaattgccacaagattctttcaaacttgaggtattcacactgccacctcatactgtgtggtgaaaactagattttttataaaatcataaaaggagagaaggaagaaataaatgaaattgtatgttcaaaaaaattagaaccctaaaaacatttgtatttttattgtatagtcagaaaaaaaagaagggagggtatttgaatctcacaagaaaggggcctgagtagtttgaaaaagaatactagacattgtcacttacttgttttctaattactctagtgggcatttgataatactggaagatatttataaaatttttaaaccctagggtctagcttctacttagtatctcccttcaagaatgtcctgattaaaaggctatactataaattaagtggatgattattagtaagcattcaaaaagagatttcgtctttttaaatgactttatgaaaatatgaaatttgcctgtggtatttatagtgtgcagtcatggttttccagtgcttttctaataaataaatcggagtacataagttgaaagagttctatatatatataaatcattctgtgattaattaatgctttttaataaatcagctgcgagagcactactcatgatgggcgtgtttgaatgccttatatagactactcagaacaggtttagacagtctttgccccgttgacctgttaccatatttatcagagtagatatagattatagtctttctaatgatgttctgcttcactctgaccaatatctaataaacacttaacctatattaggcatttcaccatctttctgtctctcttttttggaatggagtcttgctatgttgcccaggctggtctcctggcttaagtgatacccttctgtctcagcctcctgaatatctgggattacaagtgcccactaccatgcctgatttttttctcttttttgacaactcataccgacagtactaagaattcccaaactgatggatgaaagtgaatatgcctcattggcatttttttttttttttttttttttttttttttttttttgtgacagtcttgctttattgcccaggctggagtgcagtagtgcaatttcccaggttcaagagattctcgtgctttaccctcccgagtagctgggattacaggcgttcaccaccacacccagctaatttttgtatttttagtagagatgggttttcaccacattggccaggctggtctcgagctcctggcctcaagtgatctgcctgcctcacccctcaaagtgctgggattacagacatgagccaccatatctggccaacttttttttttttttttggtgagaccgagtctcactctgtctcccaggctggagtgcagtggtgtgatctcggctcaccgcaagctccgcctcccgggttcaccccattctcctgcctcagcctcctgagtagctgggactacaggcgcccatcaccacgcctggctaattttttaaaatatttttagtagagacagggtttcactgtgttagccaggatggtctcgatttcctgacctcgtgatccacccgcctcggcctcccaaagtgctgggattacatgtcttgccatgttgcccaggctggtctgaaactactggtttcaagtgatccacccacctcagcctcccaaagttctgggattatgggtgtgacccaccgttcccagccttgtatgtcttcttttgaaaagtgtctgttcatgtcctttgcccactttttattggggatatttgttttttgctgctgatttttttttaagttccttatagactctggatatcagatctttgttggatgcatagcttgcgaacattttcttgcattctgtgggatgtcttttttttttttttttttttttttgaggcagagtctcattctgtcacccaggctacagtgcggtggtgagatgagatcatggctcactgcagcctcgactttctgggctcagtgatccacctcaggatctgcaaatgtctttccatttgtttgtgtcatctatggtttctttcaacagtgttttgtagttcttgtagagatctttcacctccttggttagatatatcctaggtattttgtgtgtgtgcatatggctattgtaaatgggattgcacaagactacaggcacatgccaccacacctggataatttttaaatttttttgtagagacaggtctccctttgttgcccaggctggtctcaaactcctgggctcaagtaatcctcctgccttggcctcccaaagtgctgggattacagatgtgagccattgcacctgacctgtttactcttggtagtttcttttgctgcgcagaagctctttggtttaattaggtcccacttgtcaatttttgtttttgttgcaattgcttttgtggacttagtcatgaaatatttaccaaggccaatatcctgaagggtatttgctagggtttcttctgggatttttatattctgaggtcttacatttaagtgtttaatccatcttgagttaatttttgcacatggtgatagttaagggtccagtttcattctgcatgtggttagccagttatctcagcaccatttattgagtagggattcctttcccagttccttgtttttgtcagctttctcaaagatcagttggttgtaggtgtgtggctttatttctgtgttccctattgtgttccactggtctgtgtttctgtttgtgcaccagtgccatgttctttttcactagccttgaagtagagtttgatgttgggtaatgtgatgcctccagctttgttgtttttgttttagatcctttggctatttgggctcttttttggttccatatgaattttagaatagttttttctaattctgtgaaaaatgacattggtaatttgataggaatagtgttgaatctatagattgctttggggagtatggtctttttctttcttctttctttctttttttttttttttggtgctgtgacttcgatgcaaaccaaggttgctgcagacacagtatggtcattttaatgatattgattcttctaatccatgagtgtggaatgtgtttccatttgtttgtgttatctgtgatttctttcaacagtgttttgtagttcttgtagagatctttcacctccttggttagatatattcctaggtattttatgtacatgtatgactattgtaaatgggattgcatacttgatttgactctcagctcgaacattattggtgtataaaaatgctactgatttttgtatattgattttgtatcctgaaactttaccaaagtcttttatctaggagccctttagcaattctatgtatagagtaatatagtcagtggagagatatttgacttcttttcctattttggtatcttacttgattgttctggctaagattttcagtactctgttaaatatgagtgaaaagagtggccaaccttgtcttattccaattcttaagggtaatgcttccagctttttcccattcatatggtgttgtctgtgggtttgccatagatggctctttttattttgagttatgttccttcaatgcctagtatgttggaggtctttattatgaaaggatgttgaattttatcgaaagctttttctgcatctattgagatgatcatgtggtttttgtttttaattctgttgatgcagtgaattgcatatattgatttgcatatgttgaaccaaccttacatcccaggagtaaaacctactggttgtggtgtattaacttcctaaagtactgttgggtttggtttgctagtgttttgttgaggatttttatatctgtgttcatcaaggatattggcctgtagtttctctttttgatgtgtctttgccagattttggtatcaggataatgctggctttatagagtgatttggagaggagttggtattttggaatattttcagtaggactggtaccagttctttgtgcatctagaattcagctgtgatttttctggtccagggctttttttggttgataggttttttatttattacgattcaattttggaactcattattggtttgttcagaatttctgttttttctgagtcagtcttgggaagttttatgtttccaggaatttatccatttcctctagattttctttgctgtgcagaagttctttagtctaattaggtcccacttgtcagttttggtttttgttgcaattgcttttgaggactttctctttctctctctcttttttttttttttttcttgaaacggagtcttaatgctgggcgcggtggctcacgcctgtaatcccagcactttgggaggcataggcgggcggatcacaaggtcaggagatcgagaccacggtgaaaccccgtctctactaaaaatacaaaacattagctgggcgtggtggtgggcacctgtagtctcagctacttgggaggctgaggcaggagaattgcgtgaacctggaaggcggagcttgcagtgagccgagatcgtgccactgcactccagcctgggcaacaaagcgagactccgtctcaaaaataaataaataaataaatagaaacaaggtcttacctaggctggagtgcagtggcatgatcatggctcactgcagcctcaacctcccaagctcaattaatcttcccatctcagtcttctgagcagctggagctacagatacacaccaccacacctggctaatctttaaaaatttttgtagcaattgggtctcattttgttgcccagggtggtgtcaaacttctgacctcaagtgattctcccacctttgcctccaaaagtattgggattacaggtgtgagcccatttcctctaaattttctggtttgtgcacatagaagtgttcataatagtctctgaggatcttttgtatttctgtggaatcagttgtagtgtcacctttgccattttctgattgtgcttatatggagcttccctcttcttttctttgttaatctagctaggagtttatcgatcttgtttatcctttcaaaaaatcaattttttttgttttattgatcctttgtatggattctttagtctcaattttgtttagttctgctgttattttagttatttcttttcttctgctagctttggggttagtgtgttctcgtttatctagtttccctagatgcaatgttagattgttaatttgagatctttctaacttgatataggtgtttagtgctataaacgttcctcttaacattgcttttgctgcatcccatatattttgatatgttgtgtctgttttcatttatttcaaagaatatttcaatttctgcttaatttcattgtttattcaaaagtcattctggagtatgttgtttactttccatgtaatttgtgtggttctgagagatcctcagtattgatttctatttttattttactatggtctcagaatatatgcttggtatgatttcaatttaaaaaaaatttttgagacttgctttacggccaagcatgtggttgaccttagagtatgttccatgtgcagcttcatcagcatttatcttggtgataacatggattccatgacaggtattaatggtacaatttttatgttttaaaagtggtagtttgctaaggaaaatatgaagagagctgatttcacttttagtggttgtcatttaataaagtgagatgtgaggttgggcagggtagctcacgcctgtaatcccaacactttgggaggcaaaggtgggaggcacactttagcccaggagttcgagtccagcctgggcaacatggcaaaaccccatcgctactgaaaatacaaaagttagccaggcatggtggcatatatctgtagtcccagctacttgggaggctgaggtgggaggattgcttgaacttgggaggttggggcttcagtgagccgtgatcacaccaccgtgctttagcctgggcaacacagtgagaccctgtctcaaaaaaaataaatcaagtgagatgtgagaaggaatttttctattcttgaaatgcatgtagggatagtctttatgcctagtcaagcctaaaacacttttttaaaaagagatatttgttatatatgattaaggcagctattataatattactattctaagttactaacttttgaaaactttttaaattttgtagtttttatgacatgttagtaaatttttatgatggaacttttctttactaacaggtgcattccttgtaaaggttctcggtttcccccaacccttccacgccctgctgttgctatattatcctttaagcttccttactgtcagattgcaacagagaaaggacaaatggaggtatgtggaagtcttaccttgacactttgaatttgataatacagcacctgtgatacacacactttaaaattatcctgatggccagtattgaatattcattactgtataattacataaataggggtagcagggagggaagaggactgcttgggatcaccaggccacctgattgccatcactgcttccagggactttgtctacaaagtaaatgggtgtgactgtcagagacccactggggaaagacttactctcaggatggggcatgtccctgagaagaagtgcctccatacattttgtgccataacacctggcttgcctgaccctagtcctagccttgtgtcatcaaaagtcatttgaaatcttgcagttagttattctaaataagaaacaagttagcttttaaaaatcttgtttaccaaattctctgagcattaattatgatagctaggaaactgttttaaatgctgtattcctccccagctgccttttttaaggataggggaaaaagttaagctgtagtatcacactagaatttaaattgtaaaataaacttatagaaaggaagagttcagaacatattttattcaaaaactggtatcttaagataaatatttaacgcttgcctcatattaaggtgatagttggccttaagcaattttatttgcttttataggagcaattttggcgttcagttatatttcacaaccaccttgattatttagctaaaaatggttatgaatatgaagagagcactaaaaatcaagcaacaaaagagcaacaggaacttttaatgaaaatgcttgcggtgagtaaaataaatatactgaaaacgttaaagttaaatgcttttctataggttgaatttcttaaaggtctgtgcattaggactaagtcccacaacctaagattcttaagtttttttttgttgttgttgttgttttttgtgcgacggagtctcgttctgtcacccaggctggagtgcagtggtgcgatctcggctcactgcaacctctgcctcccgggttcacgcaattctgcctcagcctcccgagtagctaggattacaggcacacaccaccacgcctagctaattttttttttttttttttttttttagtagagatggggtttccctatgttggcccgactggtctcgaactcctgacctcgtgatccgcccgcctcagcctcccaaagtgctgggattacaggtgtgagccaccacacccagccattcttaagttttatctggtggtgttttcccttgtaaagttctatcttctagttggtcttgcagttaaaatttttttctttttttttttttaggcggagtttcgctcttgtttctcaggctgaagtgcagttgtgcagtcttggcttactgcaacctccacttcccgggttcaagtgattctcctgcctcaaccttccgagtagctgggactacaggcgtgtgccaccatgcctggctaatttttgtatttttagtagaaacagggtttcaccacattggtcaggctggtcttgaactcctgacctcaggtaattcacctgcctcggcctccgaaagtgctgggatcacaggcatgagccaccgtgcccagcctaaaataaataaaacagtaccttgtagctaagatcatgtgcaggaataaacatctctagggctacttcccttttgcttttgcccatcagtctatgttttaacgggctctcaaggtaactgagaaccactgctctagtttctgttattattttacaaagtttgagtatatactgttttttaatctccagggctgggcaatcttaagaactttgatcgggctgttagatatgcctgccttttgtcatcctctttgagttaggcagctgtgtgtgatgaaaatttatttgtgaccagtggccaggtttggtgtctagaatatttaagtacatttatctttggagcagggtgtcttaaagttcctgtgcttgtgtccccactcaaggttggtttatggagaggagtatagtatcatttcttctttatttgtcttacactagactttatgccccagagggcagagacctgctcactgctgtatgccaggcactgacatggtggcttaacacatagtagacctcgatatttgttgacaagagtgaatggtccagacttttaattttaaaattggagaaaaaaggttcttagagaaaagtggtatatgagaccacagagcaaattgccactcttgtctccaaaaggtagtactcactactgtcacctttatgcaacatggccttaagtttggtattaagaaaactcagtttattgtagaaaaagttttattccttttataaagtgttacttgtggtccaggaactagtagcctttttatttgtacaacacatataaggaaacatatttcatgtatttgctatttagcctagaggagcttttccctgtggcagtgtttctcatatcaaaaataccaggggactcatatcaaagatgccagggcaggaggatatcttgagcccaggagttcaaggggattgttgagttcttctttagcattcctgacccccgggcaaatgcctttagttcagaatagtcactgtggaaaccagactattcctttttatttctttttttttttttgaaacgaagtctcgctctgttgcccaggctggagtgcagtggcgcgatctctgctcactgcaagctccgcctcccaggttcacgccattctcctgcctcagcctcccgagtagctgggactacagttgtctgccaccacaccagctaattttttgtatttttaatagagactgtgtttcaccgtgttagccagtatggtctcgatctcctgaccttgtgatccacctgtctcagtctcccaaagtgctaggattacaggtgtgagccactgcgcccggcttcctttttatttctaaatgccccctgaggcagtgtaccatcccgattaagaagtactgattatagataaatgatactaaaaatcttgaaaagggcatccaggtgaatatctaaagcttttgtgctgatggatcagacatggaatatctaagtaagaaaatagttctaatacactatgaattaggagacccttagtaatcttcaaaataccaacttttctcagtttgttgtttttcttttttgtattttttagagaaagggtctcactctgttacccaggctagagtacagtggcaagattgtaactcactgcagcctcaacctcctgggctctagtgaacctcctgtctcaggctcctgagtagataagactgcaggtgcatgccaccacgcccagctaatttattttttgtagttatagggtctcactgtgttgcccaggttagtctcaaactcctggcctctagcagtccctctgccttggccttccaaagtgctaggattacaggtgtgagccagcacacctggcccccttgatttttttttttttttttttttttgagacagagtctcgctttctcgcccaggctggagtgcagtggtgcaatcttggctcactgcaacctccacctcccgggttcaagcgattctcctgcctcagcttcccgagtagctgggattacaggcgcacgccaccacgcctggctaattgtgtttttagtagagacggggttttgccatattggccaggctgatctcgaactcctcacctcatgatccacccatctgggcctcccaaagcactggtattacaggcgtgagccaccgtgcccagcctcccccttgaattttttaaacaaatttcttaattttcttgcaattagtagattaaagtggtatgtaatatttcatcaaatctaagccactgtttattgcatagtgcaccattactttattcatttaagccatggagacataaaaatgctgccaaactgacccaccattaattgtaattaattgtaattccaatttcagagatgttaaaacttgtaaaaatgtgcatcttagaattagggagatagagtagctagaaaactattgtctcagttttactagtagtgtcagtatctttaaaaagttttacttgatgttatttgatctcccccccccccccctttttggattagctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctgggtaagaaataatttagttgtttgaattttcctttactgtcttgaatgttaagttggtctttgcatagctctttattgaataatattattttctcttagttacagcaatactgctacagagtggagccaaccaaggttcagaaatcaagttgaagaagatgctgaggacagtggagaagctgatgatgaagaaaaaccagaaatacataagcctggtgagatacattttcaagcccataaatcatgagaactatcatggatgtggcttttcccattttgcttaactgagggaaattgaatactcatactttttttcagacctctttgctatctggttgttgtatattgaggatgactatattttccccatttacattatattgctttattttaatctgtaggacagaactcgttttccaaaagtacaaattcctctgatgtttcagctaagtcaggtgagaaatatttataaatttgtaatatcaaggaaattttgcaagtcatctgcaaagtgacacatctacgcaaatacaccttaactcttaaggccacttttggtgtgtgtgtgtttatgtttttgtttttttaatctcagatgttgtttgtgaagctatggtcatttaacagatgtttataaaatgcctattgagtgtcaggcattttacttaatggtggatacagaagtcaaacagacatgtgtggttgatctctgttttaatgctattttagcccagctgagaagacagatgttgaagacagatctgggtatcactgaggaagcatgcaggatactggagaaacagttaaaaggaattgaaggctgggcgcagtggctcacgcctgtaatcccagcactttgggaggccggagtgggcggataacgaggtcaggagttctagactagcctggccaacacggtgaaaccccatctctactaaaaatacaaaaattagctgagggtggtggtatgtgcctgtaatcccagctactcgggaggctgaagcaggagaatcacttgaactcaggaggtggaggtagcagtgagccgagatcgtgccattgcactccagcctgggcaatggagtgagactccatctcaaaaaaaaaaaaaaggagttgaaaatggttgcgtacagggagtgggcctgggggataagagaaggttgaagtaaggcactgctggcccttttttggtggggagcataaaccttatagtaccatttgactttttaaactgtggacatatgttactttgatttaaaaaaattaacttaaaaaacatgtagaatatgaaaagagcgtatgacacatagctgtcatctagccagtggtggaggatgggtagggacttcaaggcaggcctcatggagtgtttacagcagagacctgaaggatgaataacagtcagcaaggcaaaggtgcatgggaacaggagcagaagagaagcatttgggcttaaggaacagtatgtgtgaactgaaggctgcaaaagggtggtgtgaaaagctcagagagcaaagagaaagtggtgctgaagggtttcggagtgatgggcaggagccaagtcatgcagatctgtgtaggccatattaaggattttggtcttttttttattttattttattttttttaatagagatggggtgtcactctgttgtccaggctggtctcaaactcaagcaatttcctcacctccacatcccaaagttgttggacctgcaggtgtgagccaccacacccggtcaggattttgctctttattctaaggtcactgagagactgttgtaggttttaagcagaggtatagcatggcacactgtgctgaagaagaacagataatagactactggccaggtgtgatggctcatgtctgtaacctcagcattttgagaggccaaggtggaaggatcacttgagaccagacgtttgagaccagccttggaaacaatgaaaccctatctctacaaaaagtaaataataaaaatattagccaggcatggtagtacacaccggtagtcccaggtatttgggaggctgggacaggaggatatcttgagcccaggagttcgagggtgcagtaggctatggttgcaccactgcactccagcctgggtgacagagcaagaccctgtatcaaaaaataaataggccaggcgtggtggctcacgcctgtaattccagcactttgggaggccgaggcaggtggagcacttgaggtcaggagttcaagaccagcctggccaaaatggtgaaaccacatctccactaaaaatacaaaaaaaaaaattagccgggcatggtggctcatgcctgtaatcccagctactcgggaggctgaggcaggagaattgcttgaatccaggagtggggagttgcagtaagtggagatcacgccactgcactccagcctaggtgacagagtgagacttcatctaaaataataataagaagaagtaaataaaaattaaaaaataaagagactacaagctgggcgtggtggctcacacctgtaatcccagcactttgggaggctgaggagggtggatcacgaggtcaggagattgagagcatcctgaagaacacagtgaaaccccgtctctactaaaaatacataaaaattagccgggcatggtgacaggcacctgtaatcccagctacttgggaggctgaggcaggagaatggcgtgaacccgggaggcagagcttgcagtgaggtgagatcataccaccgcactccagcctgggcgacagagcgagactccatctcaaataaataaataaacaaacaaactacagaggcagtccaaatgagattgaataagggcctgagctagggtggtgatggtgatgttagaaagaatgggcagagttggagagctatttctgaagatgatgaagagagtgtaggagttcagggcgtaaagagtgattctcagtttcttgtaatagaagaaaaacttaagcacatttgaatcttgaaggattaatttgaacattcagtgattcatgaatcagggaggcaccaaaccgcaaggggctagcactctgccaggagagacaaaaggggaaacttttataaagtattttcagaaacgagataaataaaacaatttttattggctagatggaaaggtttttttgtttgttttttttgtttggtggggggggtgcggatacagggtatcttgctttgtcactcagactggagcagagttggagtgcagtgatgcagtcctagctcgctacagccttgaactcgtatgctcaggtgatcctcctgcctcaccctactgagtagctatgactacagttgtgcatcaccatgcctggttaattttttgtgtgtactttttgtagagagaggagcttgctttgttgccgaagctggtctggaactcctgggcttaagtgaccctcctgccttagcctcccaaaattttcggattacaggcacaagtggccatgctcagctagaaatttcctgcctgcctgcctgcctgcctgcctgcctccctccctcccttccttcttccctccctccctccctcctcttccccccgccagggtgtgactgtcatccaggttagagtgcagtggcgtgattatggctcactgcagcctcaaccccccagacccaagcgatctttccacctcagcctcccaagtaactaggaccacaggcatgtgtcaccatgtctggctagttttgttttggtttgggttttttgttttgttgttttttgtttttgtagagacagggtctccctatgttacccatgctagtcttaaactgggctcaagcagtcctccctcctcagcctcccaaagtgctgggattacaggcttaagccaccatgccaggaaagctcttaattagagattagtttgttaacactggcttgagtacttgagtgaatgatggtgccatttcctaagtcaggaaacactagagaaaagcagatttagagaggaagatgatgaattactgtaaggtgagtagaatgtcgtgaagacagatatttgaatcaggagctcagggaagtattctggtcaagagatacaaagtgaaaatcattggcataagtatagcaatttaaaccatgagcatgggtaagcaagcattgggggagaatgtaaagcaaaaagaaaaatgagcttaagcctagggaatctccaacatttgagcatcaggtagaggaagaggaggaaccaactattggaacacaatgagtccacaggtccagagaggaaggaactaagtcagggaatgcagtatctcagaagtcaagagaggacaaagtatcaagaagtaaggaacagtcagctatgtgggatgccattgatagagcaaacaaggtgactgaaaggtatccaccagatttgacaatgtagagatcactgagggccttagcaagaggagattctgtagggtggtagagctggaagtgctatattgtatggaggaatgtatgggtggtgaggaaatgataatagtgtcaacagttcttggaaaaatttggctggatgaccgggcgtggtggctcatgcttgtaatcccagcactgtgggaggccaaggcagacggatcacctgaggtcaggagttcaagaccagcctggccaacatggtgaaaccctgtctctattaaaaatacaaaaattagccgggcgtggtagcaggcgcctgtaatcccagcaattcgggaggctgagacagtagaatcgcctgaacctgggaggtggactttgcagtgagccgagatcacaccattgccctccagcttgggcaacaagagcgagactctgtctcaaaaaaaaaaaaaaatggctggatggaggaggcgagagaaaatggtgactggaaggaatgtggggtagagaaggtttgttttttgtttctttttaagttgggagactttaggggccaataaatagggaaaagtcaaagatgtaggatgtcaagaaacttgataggtcaggttttctgacaaagcaggagggcatgggatgcagaacacaagtaaagggattactaaccttagctcagacgagctgccactcttccgcagtaacagaagataaaagatctgtacatactgaatatgtttcatagtggcacgttggggtggttcacatttaatagcttttattttggcttagaagtaggaaagaggatatctgttgttaatagttttgaaaagttgcaaaatacatttgttttcatttaatggggattaaaatactctgtctagtattatagatgtcagaagtcatctattttctaccattattaagcaagggtttcttttttgtgaaaggtgcagttacctttagcagccaaggacgagtaaatccctttaaggtaaactcttccaagtgatgttttatattatttaaatacatttgtatacaaagaaatatttccaaatgatgagatgactctccccagacttggaggcatgaaagactgatctgtgtggaaacagaagaaagcagcacttgggctgagagttgtcttttctacttaccttctaagtacctatggttttgaaagatacctctgtctttcttggggatgtggtatttgggaatatacgtatcattcttaatttggattgtaccaaatgtatttagttctaaagatgagatggcaatacaaacttaacagaaatttcaagaaaaaataagtctcttgggattttatttttcttctttaaacatacagtgctaacactagtttgctctttaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggtactgtttcagctaccctcatctgcagtaagcagcatgggatctgtttgtcttcagttttgttcactgtttcagatataggataggaggttctgattgtttacaattgtcttgctagggaagtgggttcaattctgtttttgcagctaggcacagtggcacatacctgtagtcccagatactcaggaggctgaggtgggaggatcacttgagcccaggagtttgagtccagtctgggaaacataagagataccccatctgaaaaaaacaaaccccaaaacagttgtgttttttgtttcagaatcactccctattctgcctcgtgagttgttacacactttgtagcagattctgacttccaagatcactatcctgctccccctgtcttttttgagacagaggctcactctgtcacccaggctggatggagtgcagtgtcaggatctcagctcactgcagcctctgtctcctgggttcaagcaattctcatgcctcagcctcccgaggagttgggattacagaggcctgacatcacgcccagctaattttggtatttttagtagagatggggtttcagcatgatggccaggctggtctcaaactcctggcctcaagtgatccacccacctcagcctcccaaagtgctggtattacaggcatgagccaccgcacccagcctatcctgcccctctccttgtttttacagatcactttttaaaaatatatatactcagaccccagaagctcagacatttatctgtatttttattaaaatcacccagatagttctgatgtatattcgtatttaatagtggctgatattgtacatggccctaatttttccttgttctgagtcctgatttttccactctgataagtatttgatcccggattagtcattggtaaaatagatctattgcttatcttttctatttaatataattgtattcatttagaaaacatggaatttaggccagccgcggtggcaggtgcctgtaatcccagctacctgggagggtgagtcaggagaaccacttgaactcggagggtggaggttgcagtgagccgagatagcgccactgcactccagcctgggcaacagagtgagactccgtctcaaaaaaaaaaaaaaaaaaaaggaaaacatggaatctgaagtgtagttttttggttttgcatgtgtttgcctatttatttacaactgagaactccagatttcacatgttagtataagaattctcaataattatagatgtttcttcacatttttcagaacgtgcttataaaacatataaaattatactagatgttattgcagtattcatgtttgtttttataggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggtcagtacatagagaaatttagcatgcagtgaccaagtaaaaagtatacagtagcagcaatacaaaattatgcaatgctgttattccttaatacaaataatacattggcattggtagtgggcattctggacacttgtgactataaggaagccacaaatattaatgtctatttataatatttattaaaatatgctttaataaattgtatatttttaaattgtggatatattttattgggacattatattttgtaattaattttttgtttgtttttaaatagtttaatggggagaaatagcaaaagatacaaaaagaagagtgataataagtagtttcatccaactaatttctgtctccaaaaacaatcactgcaacaagtttcttgtggaactttccaaaattattctatttatgtgcaaatacatatttgtctattttttgttttacacattattctgtaccttacttttttaacttaacaatagcttttgtagcttattttatattactacataaagaacttctttatactggctgggcatggtggctcacgcctataatctcagcactttgggaagccgaagcaggcggatcatctgaggatgggagttcgagaccagcctgaccaacatggagaaaccctgtctctattaaaaatacaaaattagccaggcttggtggcacatgcctgtaatcccagcaaatcggaaggctgaggcaggagaatcacttgaacccgggacgcggagattgcagtcatctgagatcacaccgctgcactccagcctgggcaacaaaagcgaaactctgtctcaaaaaaaccaaaaaaacaaaaagaacttctttatactatagcaaggctatcagaaaaagtaaatacataaatggatggatagatagaaaaataagagctttaatctttgtgtatccattgaatagacatgtcatagttcatgtagttctctacttgtggacaaaagatggttaccggtcttttgctagtacagacagtactgcaatgaataattttatatgaatagcatttctcacagatgcatatatagctataagatggattcatgtatggttcaagttaatctgcacttataattccaatgccagattgttctgcattgatgttgtatcattttatacacctttagcaatatgagtattcctatttgctcatatcctctttgtccacaaacacagtatgttacctattttcttgatctctactatgctggatttctttgtatttatttattttttctgagacggagtttcgctcttgttgcccaggctggagtgcattggcacgatcttggctcactgcaacctccgcctcccaggttcaagcgattctcctgcctcagcctcctgagtagctgggattgcaggcatacgccaccatgcctggctaattttatatcttttttttttttttaaatacttttaagctctagggtacatgtgcacaacattcaggtttgttacatatgtacacatgtgccatgttggtgtgctgtgctcatcatttacattaggtatatctcctaatgctatccctccctacttcccccaccccacaacaggcccaagtgtgtgatgttccccttcctgtgtccaagcgttctcattgttcagttctcacctatgagtgagaacatgcggtgtttggttttttgtccttgagatagtttgctgagaatgatggttcccagtttcatccatgtccctacaaaggacatgaattcatccttttttatggctgtatagtattccatggtgtatatgtgccacattttcttaatctagtctatcattgatgaacatttaggttggttccaagtctttgctattgtgaatagtgccacaataaacatacgtgtgcatgtgtttttatagcagcatgatttataatcctttgggtatatacccagtaatgggattgctgggtcaaatggtatttctagttctagatccttgaggaatcgccacaccgccttccacaatggttgaactagtttacagtcccaccaacagtgtaaaagtgttcctatttctccacatcctctccagcacctgttgtttcctgacattttaatgattgccattctaactggtgtgagatggtttctcactgtggttttgatttgcatttctctgatggccagtgatgatgagcattttttcatgtgtctgttggctgcataaatgtcttcttttgagaagtgtctgctcatatccttcgcccactttttgattgggtttgtttttttcttgtaaatttgtttgagttctttgtagattctggatattagccctttgtcagatgggtagattgcaaaattttttcccgttctgtaggttgcctgttcactctgatggtagtttcttttgctgtgcagaagctctttagtttaattagatcccatctgtcaattttggcttttgttgccattgcttttggtgttttagacatgaagtccttgcacattcctatatcctgaatggtattgcctaggttttcttctggggtttttatggttttagatctaacatttaagtctttaatccatctggaattaatttttgtataagatgtgaggaatggatccagtttcagctttctacatatggctaggcagttttcccagcaccatttattaaatagggaatcctttccccatttcttgtttttgtcatgtttgtcaaagatcagatggttgtagatgtgtggtattatttctgagggctctgttctgttccattggtctgtatctctgttttggtaccagtactgtgctgttttgtatagtttgaagtcaggtagcgtgatgcctccagctttgttcctttggcttatgagtgacttggcaatgcgggctcttttttggttccatatgaactttaaagtagttttttccaattctgtgaagaaagtcattgatagcttgatggggatggcattgaatctataaattgccttggacaggatggccgttttcacgatagtgattcttcctatccatgagcgtggaatgttcttccgtttgtttgtgtcctcttttatttcattgagcagtggtttgtagttctctttgaagaggtccttcacatcccttgtaagttggattcctaggtattttattctctttgaagcaattgtgaatgggagttcactcatgatttggctctctgtttgtctgttattggtgtataagaatgcttgcgatttttgcacattgattttgtatcctgagactttgctgaagttccctatcagcttaaggagattttgggctgagacgacggggttttctaaatatacaatcatgtcatctgcaaacaggtacaatttgacttcctcttttcctaattgaataccctttatttctttctcctgcctgattgccctggccagaacttccaacactatgttgaacagaagtggtgagagagggcatccctgtcttgtgccagttttcaaagggaatgcttccagtttttgcccattcagtatgatattggctgtgggtttgtcataaatagctcttattattttgagatacatcccatcaatacctaatttattgagagttttttagcatgaagcgttgttgaattttgtcacaggccttttctgcatctattgagataaccatgtggttttagtctttggttctgtttatatgctggattacgtttatttatttgcgaatgttgaactagccttgcatcccagagatgaagcccacttgataagttttttgaagtgctgctggatttggtttgccagtattttactgaggatttttgcatcgatgttcatcagggatattggtctaaaattctctttttttgttgtgtgtctgccaggctttggtatcaggatgatgctggcctcataaaatgagttagggaggattccctctttttctattgattggaatagtttcagaaggaatggtaacagctcctccttgtacctctggtagaatttggctgtgaatccatctggtcctggactttttatttggttggtaggctattaattattgcctcaatttcagagcctgttattggtctattcagagattgaacttcttcctcgtttagtcttgggagggtgtgtgtgtccaggaatttatccatgtcttctagattttctagtttatttgcatagaggtgtttatagtattctttgatggtagtttgtatttctgtgggatcagtggtgatatcccctttatcattttttattgcatctatttgattcttctctcttttcttctttattagtcttgctagcggtctatcagttttattgatcttttcaaaaaaccagctcctggattcattgattttttgaaggcttttttgtgtctctatctccttcagttctgctctgatctcagttatttcttgccttctgctagcttttgaatatgtttgctcttgcttctctagttcttttaattgtgatgttagggtgtcaattttagatattttctgctttctcttgtgggcatttagtgctataaatttccctctacacactgctttaaatgtgtcccagagattctggtatgctgtgtctttgttctcgttggtttcaaagaacatctttatttctgccttcatttcgttatgtacccagtagtcattcaggagcaggttgttcagtttccatgtggttgagcagttttgggtgagtttcctaatgctgagttctagtttgattgcactgtggtctgagagacagtttgttataatttctgttcttttacatttgctgaggagtgctttacttccaactatgtggtcagtgttggaataagtgcgatgtggtgctcagaagaatgtatattctgttgatttggggtggagagttccgtagatgtctgttaggtctgcttggtgcagagctgagttcaattcctggatatccttgttaactttgtctcgttgatctgtctaatgttgacagtggggtgttaaagtctcccattattattgcgtgggagtctaagtctctttgtaggtctctaaggacttggtttatgaatctgggtgctcctgtattgggtgcatatatatttaggatagttagctcttcttgttgaattgaattgatccctttaccattatgtaatggccttctttgtctcttttgatctttgttggtttaaagtctgttttatcagagactaggattgcaacccctgccttttgttgttttccatttgcttggtagatcttcctccatccctttattttgagcttatgtgtgtctctgcacatgacatgggtctcctgaatacagcacactgatgggtcttgactctttatccaatttgccattctgtgtcttttaattggagcatttagcccatttacatttaaggttaatattgttatgtgtgaatttgatcctgtcattatgatgttagctggttactttgctcattaattgatgcagtttcttcctagccttgatggtctttacaatttggcatgttttttcagtggctggtaccggttgttcctttccatgtttagtgcttctttcaggagctcttgtagggcaggcgtggtggtgacaaaatctctcagcatttgcttgtctgtaaaggattttatttctccttcacttatgaagcttagtttggctggatatgaaattctgagttgaaaattcttttctttaagaatgttgaatattggcccccactctcttctggctcatagagtttctgccgagagatcagctgttagtctgatgggcttccctttgtgggtaacctaacctttctctctgaacattttttctttcatttcaactttggtgaatctgacaattatgtgtcttggagttgctcttctcgaggagtatctttgtggcattctctgtatttcctgaatttgaatgttggcctgccttgctaggttggggaagttctcctggatagtatcctgcagagtgttttccaacttggttccattctccctgtcactttcaggtacaccaaacaaacgtagatttggtcttttcacatagtcccatatttcttggaggctttgtttgtttctttttactcttttttctctaaacttttcttctcgcttcatttcattcatttgatctttgatcactgataccctttcttccagttgattgaattggctactgaggcttgtgcattcgtcacgtagttctcgtgccatggttttcagctccatcaggtcatttgaggagttctctacactggttattctagttagccattcgtctaatcttttttcaaggtttttagctcctttgcgatgcgttcgaacttcctcctttagctcggagaggtttgatcgtctgaagccttcttctctcaactcgtcaaagtcattctccgtccagctttgttccgttgctggtgaggagctgcgttcctttggggggggagaggtgctctgatttttagaattttcagcttttttgctctgttttttccccaatctttatggtttcatctatctttggtctttgatgatggtgacgtacacatggggttttggtatggatgtcctttttgtttgttagttttccttctaacagtcaggaccctcagctgcaggtctgttggagtttgctggaggcccactccagactctgcctgggtatcagcagcggaggctgcagaacagcaaatattggtgaacagcaaatgttgctgcctggtcattcctctggaagcctcgtctcagaggggtacccggccgtgtgaggtgtcagtctgcccctactggggggtgcctcccagttaggctacttgtggatcatggacccacctgtcactgaggaggcagtctgtccattctcagatctcaaactctgtgctgggagaaccactactctcttcaaagctgtcagacagggacatttaaatctgtagaggtttctgctgcctttgttcggctatgccctgcccccagaggtggagtccacagaggcaggcaggactccttgagcttcagtgggctccacccagttcgagtttcctggctgaggctgccgccttgtagttcaatctcagactgctgtgctagcaatgagtgaggctccatgggcatgggaccctctgagccaggagtgggatataatctcctggtgtgccgtttgctaagaccattggaaaagcacagtattagggtgggggtgacccaattttccaggtgctgtgtgtcacagctttgcttggctaggaaagggaattttctgaccccttgcgcttcccgggtgaggtgatgccttgccctgcttcagctcacactcggtgtgccacaccccctgttctgcgcccactgtccgacaagccctagtgagatgaacctggtacctcagttggaagtgcagaaatcacccgtcttctgcatcgctcatgctgggagctgtaggctgaagctcttcctattcgaccatcttggaaccgcttaattttgtatctttagtagagacgaggtttctccatgttggtcaggctggtctcaaactcctgacctcaggtgatctgcccaccttggcctcccaaagtgctggaattacaggtgtgagccaccactcctggccttatttttaatatatccgttaaatttgaaaagtcacaattttggcctggcacagtggctcacgcctgtaatcccagcactttgggaggctgaggtgggcggatcacttgaggtcaagagttcgagaccagcctggccaacatggtgaaaccccatctctattaaaaatacaaaagtttgccaggtatggtggctcatgcctgtaatcccagctacttgggaggctgaggcaggagaatcgcttgaacacaggagacggaggctgcaatgagccaagattgtgccactgcactccagcctgggcaacagagtgagactccatctcagaaaaaacaaaaagaaaagaacagtcacaatttcatttttaccataatatatctcatttttctcatgctgaacagtccagggagaaaaataataataaagtatatcttattttcttaatgactttatgttaaccagtttgagggagtggctgtggttttcacatttcctgttttgttctgaatttaatttaggtcttaaacagtgaaaattttatttaagaaaattgataggccgggcatagtggctcatggttttttttccgcttaacacttttttctttttgctcttgttgcccagactgcaatgcaatggcacaatctcggctcactgcaacctctgcctctgggttcaagtgattctcctgtctcagcctcctgagtagctgtgattacaggcatgcgcaaccatgcccgactaattttgtatttttagtagagatgaggtttctccatgttggtcaggctggtcttgaactcctgacctcaggtgatccacccgccttggcctcccaaagtgcagggattacaggtgtgagccaccatgcctggcccgcctaacactttttttgagacagtcttgccctgtcaccaaggctggagtccactggtgcaatctcagctcactgcaacctccaccttctgggttcaagcaattctcatgcctcagcctcctgagtagctgggattacaggtgtgtgccaccatgcccactaattttgttattttttggtagagatggagtttgccacgttggccaggctggtctcaaactcttggcctcaagcgatttgcccatctcggcttcccaaagtgctggggttacaggtgtgagccaccacacctggccaagcctaacactttggaaggccaacatgatcagttagcttcagcccaggagattggaaccagcctgggcaatgtagggagaccccatctctaccaaaagttttaaaatcagccaggtgtgtgtggtggcacatgcctgtagtcccaactgcttgagagtctgaggcaggaggattgcttgagcccaggaatttgaggtggcagtgagctgattataccactgcactccagcctgggcgacaaagcaagaccctttctcttaaaacaacaacaaagaagattgataatttaatttttcatactatcagttggttatacaaaaaacttacttttgaaattttaaggaattaccactattgaaactaatattttgtcacagatgttgatatacttaatcagaaatgtccagttttagccaggtggctgtgcactcttgtagtcctagccactcagaaggttgagtcagaagggttgcttaagcccagaagtttgaggccagcctaggcaacatagtgagactcacgtctctttaaaaaacaaagaaagaaatgttcaattttggttttctttttaaaaatagctgtttagaagtagatgattgcaggccactaagtagacttgtgacattgccccaagtttcattaaaatgggtcttcattaatttttggaaattcaggaacctttgttataccttgatttttacttgttttgatttgttctgttatttttctggaaatcggtttacgttaagattacttaaaatttgcatattttcagaaattgggcaaatggttatggtcatactagtaattttttaataaaaatttttttaaccttaaaaagtttagactttttatttaggattcatttaggttcagcctagtgaggggcgtatagctgctgggttaaacataagagactctgggccaggcacagtggctcacgcctgtaatcccagcactttgggaggccgaggcgagtggatcatgaggtcaggagttcgagacccacctggccaatatggtgaaaccctgtctttactaaaaatacaaaaattagctgggtgtggtggcgcgtacctgtagtcccagctgtttgggaggctgaggcaggagaatcacttgaacctggaaggtggaggttgcagtaagccaatacagagccactgtactccagcataggggaaagagctagactccatctctacaaaaaaacatagactttggagtcaaattgcctggttgttggatcccaggtctgagttttactgtttgtgtaacctgggataggttatttcacatctctgagcctcccttttctcacttatggaatggagataataactgtatccatctcatagtgttattgtcatttaaatgaggtactatacataaagcttttagagtagtgcctggtagatagtaagtgatcagtaaatgttaaatatttgcattaaaccttcacttgtgtgacttaaagacaatttgtattgtgagtggaatctaatgaaatgtacaaatgtgctgtgtccgtgcttcacctaatgctgatgcaggtcagctctgagagcaagggtgaggcgatggcaaaggggcttgagaaaagtcgtgaggaattcaaatagctggtttggggaaatagaaaaagagcctaccaaggacatgtggtaggccacaagggctaagtgaggttggagaccttgagcctgtcaacattcattaaaaagttgaaagtacagagttcatggttgctgcacttggaaaatacaaacgtgagtgatccttttgaattgaccttacaaaggattttccagttcattgatcctgcagtctccaggcagtttaaagtaatatgaggccaggcacggtggcttatgcctgtaatcccagcagtttgggaagccgaggcgggcagatcacgtgaggtcaggagtttgagaccagcctgaccaacatggtgaaaccccatgcaaaaaattagccaggtgtggtggcgcatgcctgtaatcccagctacttgggaggctgaggcaggagaatcgcttgaacccaggaggcggaggttgcagtgagctgagatcgcgccattgcactccaggctgggtgacagagtgagactctgtctcaaaaaaaaaaaaaaaaaaaaagtaacatgaattaacaagtgtaactgtgtcttccttactttatataatagatgtcagagacttatggttgattactaacttaaaatcatgaggcactttaaactctgtcttaagtataaaatgttttcacataattgtgattttaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtaaggataattgtgccgagattgagatcttagtgaattcccagatttaaaaaattcttatagaaatgccttttggctgggtatggtgtcttatgcctgtaatcctagcacattgggaggtcgaggcggatcacttgagctcaggagttcgtgaccagcctgggcaacatagtgagacatcgtctctaataataataataacaacaacaaagataataacgatcatgacaactaaaaaaaaaaggaaaagcctttttctgtttttggaaattgaatacatccaccaaactttttaaagaggaaagtaagtgcggatatatggtaatatggatatgtagtaattattatgtaatggtgatgggttttttgttttgtttttgtttgaggcaggtcttgttctttcacccaggcaggagtgtcgtggtgtgatcatggctcactgccacctcgacctcctgggcacaagcaattgtcctcttttttttttttatagagacaacctctcactgtgttgcccaggctggatggttaattttttgacggtttactgttttaatctctataagttcctgtatgttttaagttaggagaataccccaagaaaagatgcatttgttaaaaatcaaaagtgtcaagctgagttcgttggctcaagcctgtaatcctagcactttgggaggccaaggcaggaggatctcttgagcccaggagtttgagaccagcctagacaacatagtgatacaccatctctacaaaaatttaaaaattagcctggcatggtggcacacacctgtagtcccagttactcaggaggttgaggtgggaagatcacttacttgagcccaggaggtcaaggctgcagtgagccgtgattgtgtcactgtactccagcatgggtgacagagtgagaccgggtctctagggggaaaaaaattaataagtaaaaatgaattcacattttttgaatactactttagggttcttgcaagcagaatttttaaaaattgtatctacttacacattaaatactacatgagactattccttttgggaaaaagactggtgttctgttccagcctttcacatggaaattaggacaggtggctggcttgcttctgataaacttctgccatgtgaaggaaggaaggcacaatctctcagttagaagtggaaggaatgtgtgtggtgtaccagttaaatcctcaggtttcacttccccaggaatggcagggcgcagcacaggcacctagtaacgtagatacttgctttggtaaattgggttttatgaaaaaggtgttgcataatgaggaagccagaaactggtttaaacacctttagcgtcatttagaacctcatttacaattttatgtttctcatttgttgttcaataaaatggcgtctaaataaataagactttacactgcaaaagaggaagagacttggcaaagtctgtgattgtgtttttgaatacttaaaaatgtaatcagtatttttaaggtaaaccctaaacatttacttaaatccagtttgttaatgtgagaaattctacagcttgaagagcccttgaaatggccagggaaataaagtaggagtggggaactattatagattaaaagagattttagagacagatgaaatgaatggaccttgtctggctcttgctgagtgaataaaaaccaaaccccaaagaatatatactcatttatataacattcctgaaatgacaacatgatcaagatggagaatagagtagtggttgccaggggttggagtcggagttggggcttggggaagaggttctgtattttgactgtggtggtaaacaaaccaacccacaataaaagtaaatacatacatacgctcaaatgagtagaagtaaaatgggattgtttcaatgtcagttccctatagttgtgattgttgggctatagttttgcaaaatgttaccactggggaaaactgggtgaaggctacacaggatctttctgtattatttcatacaactgcatgtgaaactgcaattatcttagaataaaaagtttcatttttattatttatttatttatttatttatttattttttgagacggagtcttgctctcgcccaggctggagtgcagtggcgtgatctcagctcactgcaggctccacctcccgggttcactctagtctcctgcctcagcctcccaagtagctgggactacaggcgcccgctaccatgcccggctaatttttttgtatttttagtagagacggggtttcactgtgttagccaggatggtctcagtctcctgaccccgtgatccacccacctcggcctcccaaagtgctgggattacagacatgagccaccgtgcctggccaaaagtttcatttttaaatagtactgcaattatagtattttgcaactaatatgattaatataagcaaagcttagattgagatataaaagtagtgtaaatctttaatgtgctctgcatttaagtaataaaagatttgttaacaatgagaacacttaattcaagtgctaattattctgctttatatataaaaatattacctggaaaagtaaataaatcatttacttcttatttgttattttctaaaaatctttccttttcactcctgccattttacaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtatatttggcttgatatggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccggtgacccaaattctagccttcattcactcatctgtaaaatggatataatgatagtacctactttataggttgttatgagaattgaatgaaatgaaagcccttagtttctgacacatagtaatcttttatataaatgttagttactattctgataatgatgatgctgttggttatttcatcttgctttgtcattaggtttgattctgaatactatacaaactaattttgatttcaagatcttaagtaaaggtttatttatagtacattggaaagcatgtttgtagacatgtattttgtgtttggttcctcaacttgctttgtatatattttataatactaggttgatataaaagtaaatgcagtttcgccatttcagtggcaaaaaccgcgatttcttttgtgccaacctaatgcttaaggatataatctgtgtatattgtatttcagattcatagcaacctaataacaaggatttacaaaagggtttttacttccctacttttttttggctgaaggaaggtttttgtattgacttggtttaacttacaaatcagaactttgaaaccaagaaacattatccttatttctctgctatataatagtaaacctgtttttttccagtgttcttttttttttttccagagaattgggactgaatagtatgaaagtgaaaatggaaataaattaattattaatcatcatcatatcaataatattgcctacttgagcttattgtatactatagaaaattgacatatacttaattttattctccaaaagcaaaaactcctcacaggaggttactttacagatttattttggagaacaagtgaataggcactggggttatgtgcagctctggggactgtgctatgatctaaagcctctcatatctgtgcagcaacctggggtgagtcactgtcactaacatggaacagatgccaggtagtccctttggacaaaaggatgaggcccatccatgtagaaagcatcttaatcagtgactgtcttatgggccctctttgtttcccatctgttttattatcagaatatataattttcccccaagttttcatcttgaatctctcaaacctacagaaaatttgaaatttgacagtaagcacctgtatatccttcctctagtttgtcttattgttgacattttatcatgtatgctttatagacaggatttttcctgaaccatttggaatatgcatatacttcatccctcagttcccagcatgtaccctaagaataaagattttcttctgcata

SEQ ID NO: 773 - DNA, 64278 bp, Homo sapiens
gctagtgcgcggtcagcagagtgcgggaggagctggctgcggctccactccgcgcctccccgcgggcgattacgtcgcggcgtggtcctcgcggggcgcggaagacccagacttcagcctcgccacgcctgcccggagctcgaggctcccggacccccgtccacccctgggacgtgaggagtgaggctttgggccaggctgttccccgaggcgcgtggggaagcgggcgtgacctcttctgaaaaggcggtaggctcgctccacccaggccctagagcccacccttagagctgcgcgctttagggtgagccaggcacgatgccttgccaacgtggccgcccccttcctcccaggcggaattcgctcaggcaacattggccccttgagatccagtggggtccttttcgaaaggaggctaggtgaacgcaggttttaaaaaagagaagggaggggccgggcgcggtgtctcacgcttttaatcccagcactttgggaggcagaggtgggcggattacttgacgtcaggagttcgagaccagcctggtcaacatggtgaaaccccgtctccattaaacgtacaaaaatcagctcggcgttgtggcacgctcctgtaatcctagctgctcgggaggctgaggcaggacaagcgcttgaacccgggagctgaaggctgcagtgagccgagatcatgccactgcactccagccggggcgacagagcaaagctctgtctcgaaaaatgaataaattaattaattaaataaaatacaaaagagaagggagggataccccattctccaggatgtgattattatgcattgcatgcctgtatcaaaacgtctcatgtaccctctaaatatagacacctattgtatacccacaaaaattaaaaagacttaaaaaaaaataaaagagagaaagaagggaggaagatggggagttgaagccctgggggcattatggaactactggatgcctctccggcggaaactccacgggaccgaaagagaggcccggggtctcctgccgggtgagagaagcattagagaaagatgagattgggggctgtcaggactactgatggaagggagggggtctgagaaggggcccgaccctccctaaaactgctctcgggattcccccgtcctccttccacccgccctacgcagtcaggactgagagagggcggcagatctggtcctagccaggggactgtgacggggcgtggcggggagggacacagagagctggggcgggcgggccaccgggaaagtgctgggggcatgacagtgccttggattgctgggcctcagttggagatggggctgccagatgctgttctccctcctcccgctgttctcgccctctgggcatctgcagcagctctcagtccctgctgttcaaaaccagggtttacttccttgtcacttcttgggagcggccctcggtccctgctgttcagaaccgggatttaccctcttaccacttcctgggagtggctgcggcgactggaccttggcaccgcaatgtgtgaatggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtggaaggagcgagctctccgtccccgggagtatgcaagtttgggctgcacgatcacttggaagggattgggcggagttctgtcatttggagaaagggtcctgggagcttcaggtttgtgtagggcgaggacggggcggttctgcgtccggccaggttggccctcgaggacccagccgtccccaacctcctaaactgctgtcggatgtagaagactcgcattcactgctctccacagtcggtgaagggagaacgccgaaaagggccgcattccctcctgccggtcccctccccttcccgcgctccctctgcagcacttaaaatgtaaatgtacatcgtgattagccgcggggtcgctaattacagctgaagccattcattacactgtcagcgcgcgtcgcagcccgccggctgtgcgctccctcctagccgtgaaggggtgtagggggtgggggcgggagatgcggggagtgagggaggaaggatggggtgctgtgaattagggtaatgtggcaggcctggaggaagctggagtgggagagagcgggcagcgagcggggaaaacagggtgggcggtgaaggacggggcggggtggcgaggagagaggagaaacgcgagaggcaggaaggaattggggcatgaagtagtgaggacacagggaaaggggctgtatgaggggggaaacagcgtaggggacagggcgaagggagaaaaagctgagaagagggtgggaaccccagggtggggccagagtcagaggaggggagcacagggctcaacttcagaaaggctggtaaattttaaagtagagcatcagtggtgcacaccacacaatggttagaaaagtggagtcagtgaagacgttgtgttaaaggagctgggtgccagccatacacagagtaggggggcatttatttccgtgtgtgtttatagatgtaaatgtatttttaaaatatctgcaagaaaacagcacactgacctcttgttaccgcatgaagttttcattaccttctttaagaaaaggacaattaaatatgaatacagagtcttggagcagcttgcataaatgagctactgaccctgaagcttcagcttctattagcttctttctgcctctgtgtgaccttggacaatttacttaacccatttgctttggctttgtcatctgtaaaatggggctaattatagtaatctacctcacagagtgattatgagacacagccgtcttggaaccttggctgctaagttctcaggaaatgttggctgttattatttttcatatattatttgtgaatttaaaaaaattgtaaagggattgggggaaagaaaactggtgaaaaggaaaagaaattgggaaagactcagaaataatagcagttttcactcacagtgaactggtgagtggcaagctagactcctttcaccctgggaggaggtgttggggtagctgggctagaggccaagcctagccaatacatatctgttaaggttccctgggacctttccagcagcacaccctacttcctgtggacaaatctctcatgttcacactggagggggatcgctggtacagcccctctcctctgtctcttgttgcaggaggaggatgaggagctcttaaaacccctgatcctagtcccagcctctttgggcagggtcttgggagcatgcaagtagagtcaggaattagaaagttagcagggccaggccgggcgcagtcgctcactcctgtaatcccagcactttgggaggcagaggcgggcggatcacgaggtcaggagatcgagaccatcctggctaacacagtgaaaccctgtctctactaaaaatacaaaaaattagctgggcgtggtggtgggcgcctgtagtccctgctactcgggaggctgaggcaggagaatggcctgaacccgggaggcggagcttacagtgagccgagattgtgccactgcaccccagcctgggcgacagagcgagactccgtctcaaaaacaaaacaaaacaaaaacaacaacaacaaaaaagaaaattagcagggccagagggaactcagatttagcaggcacccaccgagtgcccagcattgggtcagatgtgtttaatctccacactcttctttccaggaaggtatcatcattgtttgacagatgtgaaactgagacccagagaggttaaataacttgccttatgtaccacagctagaaagaagcaaccacagatgtttgaactcagagttctgactccctttactatctcagccgaatgtatgagaaaaataaacttttaagtgactcaaactgcccaaaggggttagctttgggagatgagggtgttccatagtggaaaagatgtgttggtgatctgttgctgcataaaaattaccccacagctcagcagcttaaaacagcaaacatttggccaggtgcagtggctccaggaagtttagactgcagtaagctgtgattgtaccactgcattccagcctgggcaacagagcgagacactgtctcaaaacaaacaaacaaaaaaaaacccaacaacaatcatttattattgtgagatcacacaatttctgagggtcagaaatccaagaacagcttgaagaggtctcatctagctcagggtctgtcatgaggctgcagtcaagatgtcagctgggcatggaggatctactcccaaacttacttcacatatctgttggtcagaggcctctgtttctccactggtctgatcatgacctggcagctggcttcccctagagcaagtgatcagaaagagacaaagaaagagagggacagagaaaataagcaggaagctgcagtgcctgttatgggccagcctcctctgaagttgcacgccatcatttccagtttattatattagttggaaggtagcccagcctacattcaaaaggaggggtttcagacttcatttcctgaagggaagggtatcaaagaactgtaggcatttcaaaaatcacaacagagccgggcgcggtggctcacgcctgtaatcccagaactttgggaggctaaggcgggtggatcacaaggtcaggagatcgagaccatcctggctaacacagtgaaacccggtctgtactaaaaatataaaaaattagccgggcatggtggtgagtgcctgtagtcccagctatttgggaggctgaggcaggagaatcgcaggaacccggaaggcagaggttgcagtgagccgagattgcgccactgcactttagcctgggtgacagaatgagactccgtctcaaaaaaaaaaaatcgcaacagaaggcgagtgtttgggaggcaaatttaggaggagacggaagaaggaatcaacatattgaagcaaacacgtggaaagaacactgaccttgaatcaggagagctaggtttatttcccggcatacagcaagcacttaatagatgtttaagtgaatgcatgattgacaatttttctgagattgttttcacagacgtaacagcagttaccaccccacatgctctcctgaggattgagtgggattatgggtatcagagctctctgtaaatgtaatagtgctggttgatgatgcctggaagtgaatgtggtctgggagacagggagagggctctgccatacaagagcctctgcccaggccaggcatctcttctgtcagactgagtcccaggccctggggtagtgctctgattccagctctccttctcagctctctatctcaccctcggtccaacctcctcaccatggctcagctctaggtattgcttttctccttcagccagtcaggacaggacccaggagacttaccattggccaagcctcttgcctgcaggccactctacctcttgtgctggctctggccccacagatggggaatgggggtttgcattgcagacccagtgagtgatgccatttgaggacaagaaccattaatcttgcatgaaattcaattgctctcctagcagataggccaagtcaccggagtcctgagaggaagaggggtgtgtggggcctagaatgaatgaggagtggtgtctgtggaaggggaaaggagaggagaggcaaaagcatccatgggacctccttctcgttctccttaagacgggatgctgccagtagttcccctatcttccttccagactctagaggcaagtgcagcgaaaagccactcacctgggcaacattagtgttcccaggagagctcctattcctgaaagacttcccaagagcctgctgtgatgcccagaatcctccattattgcttccccccttaggatcagttttgtcctctgaagataaggtccctccaaaatgggaattggtcaaaacaaaataatccggatgcttgagaacgttgggatgggaggaagatatagagctgataaagtgaggaatcattatcaattacagctgacatttagttagcacgtactatgtgccagacactatcctaagcactttacatgtacaaactcatcacatacaacaagcactatgaggtagctgctacccacttcatacgtaaattagagccagatccagagacagatggtctggctccagtgtctgctcttaaccatggcactagaccattgcaggaggaagggaaggcagggcagaaagccaccagctatcaagacctccctggctatccataatgaagggcacagcactccagggcgtgttctgctttgcatttgcctggtgtggaaggcatcagggctggtccttctccagcactgacctggggcagagatagggagcttggttgggtctgcttccctagaaatatatcatatgcccttcagggtgcactgaagtttgtctgtttttgagacggagtttcgctctgtcaccaggctggagtgcagtggtgtgatctctgctcactgcaacctccacctcctgggttcaagtgattcttctgcctcagcctcctcagtagctgggacaacaggcgcatgccaccacgcccagctaatttttgtattttcagtagagatggggtttcaccatgttggccaggatggtctccatctcttgatctcgtgatccacctgcctcggcctcccaaagtgctgggattacaggtgtgagccacttcgcccgaccgaggtttttgtttacaactcagaaaatgcttgcccatctgacacccagaagcagctaatggggtggttacgagtttggactctagagctccactgcctgtgttggaatcccaggtctgccacttaccagctgtgcccttggtcaagctatggaacgtctctgtgcctcgatttctttccctgtgaaatagaaacaatgacaatagtacttatctcttagaattggctcaggttaggccgggcgtggtggtttatgcctgtaatcccagcaattcgggaggccgaggcggacagatcacttgaggtcagaagtttgagacgggtctggccaacatggtgaaaccccatctctactaaaaatataaaaattagctgggcatgatggcgcacacctgtaatcccagctactccggaggctgaggcagcagaatcgcttaaacctgggaggcagagtttgcagtgagccgagattgggccactacactccagagcgagtgtagtgtcacctgggtgacagagcgagacagagcacaaacaaaacaaaacaaaaaaccgaaaaacaaaaaacaaaaaaatgattgtcttaggttataccccagtacttccatggagttgtcaccccagatttcagagataggctaaatcccttgtctatagattcagctactgagcattaaagcttgtagggaaacccgtggtggtggggggatggggtaaaaaaacacagggaggcagaagggggatgttgacttccatgtggcagccagcactgctgggcctcagctgttcattgacaggcaggactgcaggcccagtggttttattttgattgtgtgtgattgaacattttctgcttcatttcaatgagagttgtctgtgtcagcttttctgaatgttacatagatagaacccttcttccttcacatccggttgagtcaggctcatgacaaacaatgtaatttccttgctgtagagtcccctagggtctggagtactgggaagaagccaggaaattgttccctttttcctgggtcgcctctcttcctgacagttgttcctttcccaccttcccatggtggtgagagtggaaacagcatttttcacatgctacccttgatacctccatcccccagcctgccagcctggaacagagcccccaaatcaagctggatgaattggggttcctctcaattccaggagacacttagtcaaattccctttatggccacgaggataattacaaccagataattgtcttccttctcttgaacgaacgatgaagtaaatcaagtgtgcctgccttctactctgaagtaaatcacaaagcaccctgtatgtattctcccagaagataaattttatacatttcaacaaggaaagagaacatattttgtttgcaaaattcctgggagaactctctatctctctctgcccagaaattatgtgtacctgctgatgaatgacctgcctgatgaacctgccttgggaaagataatagagttatgattggatgtcaccagctctcatcatttctgctgtgggagaagtcacaggagcaggcagaactcttccctctgatgaagcagttgtcttcttgtaaccacagatcttcttcgttcactggggttgtgggcacacctttaagattctgccctgcgccgggcgcggtggctcacgcctgtaatcccagcactttgggaggccgaggcgggtggatcacgaggtcaggagatcaagaccatcctggctaacatggtgaaaccccgtctctactaaaagcacaaaaaattagccgggcctggtggcgggcgcctgtagtcccagttgctcaggaggctgaggcagaagaatggcgtgaacccgggaggcggagcttgcagtgagccgagatcacgccactgtactccagcctgggcgacagagccagattccgtctcaaaaaaaaaaaaaaaagaaaagaaaaagattctgccctgaagtccaagtgagctacacaggtccagtgttttcaaaaaagaagtccccaaactcatgtttttatgtgacagtttcaggtttttattttttatttttttatgtttaattgtttttagacagagtctcactctgttgcccaggctggagggcagtggcacgaccttggctcactgcaacctctccgcctcctgggttcaggcgattctcctgcctcagcctcccgagtagctgggactacaggcttatgccaccacgccctgctgatttttgtgtttttagtaaagatgcggtttcaccaggatggtctccatctcttgaccttgtgatccgcccacctcggcctcccaaagtgctgggattacaggagtgagccactgcgcccagcctattttttatttttaaatttcttttagagacaaggtctcattttgttgaccagagctggagtgcactggtgcagtcatagctcactgcagacctgaacccctgggctcaagggattcgcaggcacatgccatgtgggccagtttcaggtttttaaatgttgtcgactgtttcagttatctattgctgagtaacaaatcaccttaaaatcacaaatcaccaggccaggcgcggtggctcacgcctgcaatcccagcactttgggaggctgaggcgggcggatcacgaggtcaggagattgagaccatcctggctaacacggtgaaaccccgtctctactaaaaatacaaaaaattagccgggcgtggtggtggccggtgcctgtagtcccagctactcaggaggctgaggcaggagaatggtgtgaacccaggaggcggagcttgcagtgagtggagattgcgccattgccctccagcctgggcaacacagcgagactcccatcacacacacacacacacaaaaatcacacatccccttaattagtggctaaaatagcaatgatgtattatttatgtttttttactattatatattttttaaaaatagagatgggctgggtgcagtggctcacgcctataatcccagcactttgggaggccgaggagggtagatctcctaaggtcaggagttctagaccagcctggtcaacatagtggaccctgtctctactaaaaacacaaaattagccaggcatggtggtgggcacctgtaatcccagctactcgggaggctgaggcaggagaattgcttgaacccaggaggcggaagttccagtgagctgagatcagtgtagcctgggcagcagagcaagactccatctcacacaaaaaaaagagatggggtctcactatgttgcccaggctggtcttgaactcctgggctcaagtgatctgctcacctatgcctcccaaagggctgagattataggcatgacgcaccatgtccagccaatgatgtattatttctaatgacttcgttttggctgggttcagctgggcagttagttcttctgctccacttaatactggctgtggtcactcacatggcttcattcagctgggagcttgacagaggtcagaacactcaagatggcttcattcataagtctagtgcctctgctggggtggctggaaggctgggggtgttggctgggcctctcttttcatggactctagcctaagcttctttcttgagtggcttgatcccaaaacagtgaaaatgggagctgtcaggctttgtaaggcctagacctagatgtcacacattatcatgtcctctacattccattggtcaaaccaagatacatgtctagaccagattcaagggataaggaaataaactgtacctcttggtgaaaggcctgacatgtatatacaggaatgggaggaactgttgacagccatctctgcagacaatctaccacatgaactaactcatgtgtttttgttttttgtttttgagatggagtctcgccctgtcgcctaggttggagtgcaatggcacgatctcggctcactgcaacctccgcctcccaggttcaagcgattcttcttcctcagcctcccaaggagctgagattgcaggtgcccgccaccacgcctggctaattttttttttttttttttttttttttttttttgagacggagtctcgctctgtcgcccaggctggagtgcagtggtggagtcttggctcactgcaagctccgcctcctgggttcacgccattctcctgcctcagcctccagagtagctggaactacaggtgcctgccaccacgcctggctaatttttttttgtatttttagtagagatggggtttcatcatgttggccaggctggtctcaaacgcctgaccttgtgatctgctggcctcagcctcccaaagtgctgggattacaggcgtgagacactgcgcctggcctagctcatgcttttaaataacgtatctgtagctcagtttagcccaaggttgcaacttcctttttttttttttttgagacagagtatctctctgtcgccagcctggagtgcagtgacctgatctcagctcactgcaacttccatctcctgggttcaagcaattccctgcctcagcctcccaagtagctaggattacaggcgcccaccaccatgcctggctaatttttgtatatatatattttttagtagagacggggtttcaccatcttggccaggctagtcttgaactcctgaccttgtgatccacctgcctcagcctcccaaagtgctgggattacaggcgtgagccaccacacccagcctccttttatttttttaatttaaattttatttttttgagacagaatcttgctgtgacgcccaggctggagtgtagtggagcaatcagggctcactgcaaactctgcctcctgagttcaagcaattctcctgtctcagcctcccgagtaactgggattgcaagtgcccaccaccacaccagctaattttttgtattttttgtattttttttttttttagtagagtaggggttttaccatgttggccaggctggtctcgaactcctgacctcaggagatttgcccgcctcggcctcccaaagtgctgggattacaggtgtgagccaccgtgcccggccatgcccaactaatttttgtgttttgtttgtagagacggggttttgccatgttgaccagtctggtcacaaactcctggcctcaagtgatccacccgcctcagcctcccaaagtgttgggattacaggcatgagtaaccatgcccagcacaactttttttttttttttttaagacaaggtctcactgctgtcacccaggcaggtgtgcagtggcactatcacagctcattgcagactcaacctctcaggctcaggtgatcctcccacctcatttttagattttttttttttttttttgtagggatggggtcttactatgttgcccaggctggtctggaactcctgggctcaagcaatactcctgcctcggtctcttaaagtgttgggattacaggcgtgagccactgctctgggccaaggttgcaacttctacttgaaactttcagggaattcacctggaaatgcaggggctttttttttttttttttttttttttttttttttgagacagagtctcactttgctgcccaggctggagtgcggtggtgcgatcttggctcactgaaacctctgcctcccaggttcaagcgattctcctgcctcagcctcccaagtagctgggactataggtgtgcaccaccatgcctggctaattttgtatttttagtagagacgaggtttcaccatgttggccaggctggtctcgacctcttgacctcaggtgatcctactttgggattgtttccacccatcagcctgaatcccaaagctgcctagttcctaacctgaagggaagaaggccaggtgattggctgggtgcagtgactcacacttgtaatcccagcactttgggaggccaaggcaggcggatcacctgaggtcaggagttcgagaccagcctggccaacatggcgaaaccccccatctctactaataataataaaaaaaattagccagaaaagaagaccaggtgattaatgagatctctttattttatttttagagggagtctcactttgtcacccaggctggagtgcagtggtgcaatctcggctcactgcaacctctgcctcctgggttcaactgattcttctgccacagcctccctagtagctgggattacaggcacatgccaccacagccttttagtagagacagggtttccccatgttggccaggctggtctcaaacttctgacctcaagtgatctgccctcctcggcctcccaaagtgctgggaatacaggcgtgagcaccgcgcctggcctattttattttattttatttttttgagacagagtcttgctcagttgcccaggctggagtacagtggcatgatctcagctcactgcaacctccctggttcaagcaattcccctgcctcagcttcccaagtagctgggattacgggcacatgccgccacgcgtggctaccttttttgtatttttagtagagacagggtttcaccatgttggccagactggtcttgaactcctgacctcaagtgatctgccctcctctgcctcccaaagtgctgggattacaggcgtgacccactacgccccgcccattttattttttggagacagagtctcactctgttgcccacgctgatgtgcagtggcacaatcatagctcactgcagccttgattgcctgggctcaagggatcctcctgactcagcctcctgagtaactgggactacaaatatgagccaccatgctggctaatttttgaatttttttgtagagacaggggcttgctatgttgcccaggctggtatcgaacttttggcctcaagtgattctcccaccttggcctcctaaagctctggaattatagctgtgaggcactgtgcttggtctgaaatctcttttatttatttatttatttattatttttttgagacagagtcttgctctgttgcccaggctggagtgcagtggtacaatctcagctcaccgcaacctccgcttcctgggttcaagtgattctgctgcctcagccccctgagtagctgggattacaggcgtgtgccaccacgtccagctggcttatttttgtatttttggtagagacggggtttcaccatgttggccaggctagtctcgaactcctgacctcaggtgatctgcccaccttggcctcccaaagtgatgggattactggcgtgacccaccacacctggccctgagatctctttttttttttttttttttgagacggagtctcgctctgttgcccaggctgaagtgcagtggcaccatctcggctcactgcaagctcaacctcccgggttcacgccattctcctgcctcagcctccctagtagctgggactacaggcacccgccaccacacccagctaaatttttttgtattttcttagtagagacggtttcaccgtgttagccaggatggtctcgatctcctgaccttgtgatccgcctgcctcggcctcccaaagttctaggattacaggtgtgagccacagcgcccggcccctaagatctcttttaatatcctgtagtgctcaccagctttgactttagcctgaggagtcattgcaggattttaatcaggcctatcttgattagattagtactttagaatgttcacataggatgctaagaggcctttgttccagttagcaaccgctgcgtaacaaattatcagaaatctagttgtgtaaaacatttatttatttatttatttatttatttatttattgagacagaggttcactcttgttgcgcaggctggagtgcaatgacacgatctcggctcactgcaacctccacctcccgggttcaagcaattctcctgcctcggcttcccatgtagctgggattacaggtctgtgccagaacgcctggttaatttttttgtatttttggtagaaatggggtttcactatgttggccaggctggtctcaagctcctgacctcaggtgatccacccacctcggcctcccaagtgctgggattacaggtgtgagccaccacacctggccaaaacaattatttattatgctcacagattctgtgggtcaggaatttaggcagggcacattggagatggctttgtttcttctccataatgtctgaggtttcagcttgaatgctgaggctgaattaatggcaaaaccttatctctaaaaaaaataaaagttaaaaaaattttaaaaaatgaccacagcaatggtcccaagtgctaggattacagctgtgagccaccacactcagcctattattattattatttttttttattattattattttttaatgatttaatgctgggcatagtagctcatgcttgcaatcccagcatttgggaggccaaagtgggcagattacttgagctcagtttaagactagcctgagcaacatggtgaagccccatctctataaaaaatacaaaaaccagccaggtatggtggtgcacgcctgtaatcccagctactcaggaggctaaggtaggagaatcacttgaatccaagagacagaggttgcagttagccaagatcgtgccactgcactctagcctgggtgacagagcaagactctgtctcaaaaaaaaaaaagtaataataaagcgaagcattaattcaatgaaatcatcaatagcctttcaaagtatacccagaacttgagcactcctccctcctccggcctcattccccacacctttcccgtcatccattctgcctgagccgcaccagcttccttgcgttccctcaaatgtgatgaacacgcttctgcagggcctttgcgctggctgctccttccactaggaatgtgggtccccctggtatttccctgactgtctcccttgtagccttcagtctctgctcagatgtctcctgctcagagagcccacccgaccatcctaatataacagtcccctccttccatctcttttcctttctttggttttctttttcttcatggcatttaccatcatctggcataactgtaattgcttattgtttattatctgtctcctcccactagaatgtcagctgtccaggaggatagggaccttgttttgttcctagcttcatttccagcacccagaacgtgtctggtactcagtaagtgctcaaatcaatgtttgtggagtgaatgaaggataggcttctttgggtgagaaaagtcagtaacccatgcctaggacatgatctagaacagtggttataaagtgtggtccttcaagtgtgatccaggatctttgagggtccccaagacccttttgtgtgagaggatctgcaaggtcaaaactatttttttttttttttgagatggggtcttgctcttcttgcccaggctggagtgcaatggcacaatcttggctcaccgcaacctccacctcctgggttcaagcaattctcttgtctcagcctcccgagtagctgggactacaggcatgtaccaccatgcctggctaattttgtatttttagtagagacggggtttctccatgttggtcaggctggtcttgaactcccgacctcaggtgatccacctgcctcagcctcccaaagtgggtcaagactatttttataaatatacggaaatatcatttgcctttttcattcttattttttcatgagtgtactgtggagtttttcaaaggctgtagagcatgtgatgtttcaacagatcgaatgcagaagcagatatggtccaggcacagtggttcatgcctataatcccagcactttgggaggctgagatgggaggattgcttgagtccaggagttcaattcagtctgggcaacatagcagaacttcatctcttttatttttattttttgagatgaagtctcactccatcacccaggctggagtgcagtgtcgtgatctcggctcactgcaaactccgcctcccgggtttaagcaattcttcagtttcagcctcctgagtagctgggactacaggtgcctgccaccacccccagctaatttttatacttttagtagagacagggtttcaccttgttggtcagactggtctcgaagtcctgacctcagatgatccacccagcttggcctcccaaagtgctgggattacaggcatgagccactgcgccccagctcatctcttttattaaacaaagaaaggaaaagaaaaggaagggaggaaggggaggagaagaagggagggagaagaggagagaggcagaaaggaaaggagggaaaggaaaggagcagatatgggaatccagctgtcttctattaagccagacattaaagagatctgcaaaattataaaatgatgccactcttctcactgttttttttttaatgtaactaatttaaataaaatgttttttatgttaacgtgtaatgagtttattaatttttttgtttgtttgtttggtttttttttggagacagagtcttactctgttgcctacgctagattgcagtggcatgatctcagctcactgcaacctccacctccttggttcaagcgattctcctgccttagcctcccgagtaactgggcttagaggggtgcaccaccacacccagctgatttttgtatttttagtagagatagggtttcaccatgttgcccaggctggtctcaagctcctgacctcaagtgatccgcctgcctcggcctcccaaaatgctgagattatgggccacctcacctggctgagtttattaattttaaaaaatgaattaataataaatgttttccgtgggtgtggtggctcacgcttgtaatcctagcactttgggaggctgaggcaggcagatgcttgaggccaggagttaaagagcagcctgggcgacaaagtaagacctcgtctctacaaaaaaatacaaaaattaaccgagtgtgatggttcacgcctgtggtccaagctactaggaaggctgaagtgggaggattgcttgaacccagaagatcaaggctgcagtgagccgtgatcatgtcactgtactccagccagcctgggcaacagagcaagaccctgtctcaaaaaaaaaaaaaaaaaaaaaaaaaaaaaagaaagaaaagaaaaagaaaaaaaaacctccacaaaaacaaaacaaaaatgaatgaattaataataaatatttctgcggggtggtggctcacacctgtagtcctagcactttgggaggctgaggcaggaggtctgattgaagccaggagttcaagatcagccaggcagcatagtgaaaccccctctctataaaaaataaaaaaattggccaggcacagtggttcatgcctgtaatcccagaactttgggagactgaggtaggtggattgcttgagcccaggggttcaagaccagcctgggcaacatggtgaaaccctgtctctataaaaaatgcaaaaattagctgggtgtggtggaacatgcctatagttcccagctacttggaaggctgaagcctgagaatcactttaactctggaggcagaggttgcagtgagccgagatcacgccactgcactccaacctgggtgacagagcaagaccctgtctcaaaaaaaaaaaaaaaaaattgccaggcacggtgatctgggtctgtagtactgggtactcgggaggctgaggtgggaggattgtttgagcccaggagttcaagaccagcctgggcaacatgataagatcccatctctgcaaaaaatcagaaattagctggatatggtggcatgcgcctgtgttcccagctacttggaaggctgaagtgggagaatcgcttgaacctgggaggcagaggttgcagtgagctcagatcatgctattccagcctgggcaatagagtgagactctgtctaaaaaatatatataaaagaggtgaggattgaaaggaggctgagagactcggacccagggaagagttgatgtatgcaaaggagtccaacaacacgatgcctgtgcactcattgaggaataatctcagtgcagcaatctctcggttcagagatgaccaaaaatgctccaggaacagtcatgcttaatattgactgtttgttgttttatttttattttttgactgtcctagattgtttattaggtatgaattttataaactttagttataccagtggtaacggtggagctggagagtattgtgccttctccaagcttcaggggaagaaccaccaatagtgtggtggaacttatggccctttccaaggccatggctctttcagcctgcaggtgtcagcccatgcatttccctgtgcttgtggactggtttggtgatccactgggtgtcaagatttcttctgatagctttatggaatggatcaatgaggataacatcaaaaaatgtttatgtggaatcttcatcaacccagtaagaattcaggactcttagagccccacagtggcatccagcttgctgctctgcaaaggactgaaggctttgagcaaactttacaaatatatatatataatattatatataacatagataacatataatattatatataacatagataacatataatattatatataacatagataacatataatattatatataacatagataacatataatattatatataacatagataacatatattatatataacatagataacatataatattatatataacatagataacatataatattatatataacatagataacatataatattatatataacatagataacatataatattatatataacatagataacatataatattatatataacatagataacatataatattatatataacatagataacatataatatatataacatagataacatataatatatataacatatataacatataatatatataacatataacataatattatatatcatataacatatataacatatataatattatatataacatataatattatatataacatatataatatatataacatatataatatatataacatataatgtatataacatatataacatatataaatatataacatatataacatatataacatatataatatatataacatatataatattatataacatatataatattatatataacatatataatatatataacatatataatattatatataacatataatattatatataacatatataatatatataacatatataatatatataacatatataatatatataacatatataatattatatataacatatataatatatataacatatataatatataacacattatatatgttatataatattatataacatatataatatataacacattatatatgttatatatattatatataacatatataatatgtatattttatatatatctttctcccccacaagaacacatattcaaagagtaagttgcatgtaataataatagaatacagcatccagatccttgaaataaaaaaatgaaaaatataacactggtgaatattagcttcagtttctaaaattgaaagccaagcagggaaagtaaattttttttcttattaaagtatgaaggtcacaaaattaacaactcacaaaagagaggctgatgtatagccaattagcgcacaagagacagatggataaaccagacacaaactgttaaagggcctggcaatcacatcctctgagtgattacagacctaggcaagggccatgggaggccacgtaacgaccagagttatgactaatggatcttgagtcagaatgggagagctagttttatattttctaaataccatttctgctcacgttagctagaggtggcttcttcacatttaataaccaagaactctgatttatcaaacaatctttagcacatggtgggtacttactgccttgggaatggctgaaatattccaggcgtaggagttaaagaatgacttgggtgaacagagggataacagttttttgtgtttctattgggagatgcttgaaggatgaataaaagaaacaaggagaagttgatagcactgaggaaaaagggtaattgatagatcaaaacccctgaggagataagaagtgatgagaatcagagcacagttgtggggctggcctgagcctgtgaggagggagtggagacatctcttcctctgagacaggtaggaaggaggaagggatacaggagtacattagtaaatgcatctccctgaagaggctgaggttgcctgcagagagtgaacagaatgggcaatactggggaagaattatccctagcgggctttttgcaggttccacattgaaggacagtaggtgataggagtttattaagaggatgcatagggtacaatgtggaatacaataatgaatcattattcatttattttgtttgttttaaagccctgagcttaattttctatattaattcattcaaaatattaattgtctgtatcacatgacaggcattgttgtgggtgctggggatatggcagtgaacagcacaaaagttgtttctgcttgtggaggtcacatttcagtgagacgaaaacaacaaagtgtgtgtgtgcatccctgccccccctcccccaccgtggcactgagtcacccggggagctgaactctcctttgcctctacagccagcacatgaaatgcagctcaaagccacttgaaagcactcacttggtaacaggctgctccctagtgtggcagacaccactggtgccctactcagcatccattctccttttcttccttactaatacaaccctgattttattggcagaggcaatgtgcccagctaaaaggtattttccagccttccatgccaaataggagtgactgtatgacagtttaggccaatgggagataaacagaaatggttggatagggctttttggagctaattaaatggggatgcagactcggctggcatgcccattgtccctttgcccttccttcttccagcttcttgcaatgcagccatgatggctggagttgagaagccctctcaaaactcttgagggcagctgggcacagtggctcacacctgtaatcccagtgctttgggaggccgtggcgagctgattgcttgagctcaggagtctgagaccatcctgggcaaaatggtgaaacccggtctctacaaaaaatacaaaaattagccgagcttgatggcatgagcatgtagtcccagctacttggggtgttgaggtggaagaatcgcttgatgcctgggaggtggaggttgcagtgagccgagatcacgccactgcactccagcctggatgacagagtgagactctgtctccccgcgcccccaccgcccccccaaaaaaaacttctcaggaaaaggccaagagaatttcagagacctctaccctgtatcttaaagtcactgagccaagtcacttatttggatttctcattatgtgagaacaagcagaggtatcttgtttaaggcattgctatttaatatttgcattttctgttatatgcagccaagcttaagccatacttgagatgcaaagaatcagccgtgtttgttacctgtggcagccatgagaatggcttctcaaatctctgactgcaggaagtataattaaccaaggactccagctgctgcctctgaaatgcatcactgcatttatgccaaggccagattttccatggactgctcccggctaatgactgagcatggatgggatactaaggcagtctcattcttgggagaagggtgaaagatgggtgactttaagtgaggatgccgcagtggacttgctgaaaactttccttagagctgcactgcagtttaagaggtgtccattaacttctttccttccctctcttctgcactcaagagtcagacttctatcatgctctgatgtctctcccaacctttcttagctccctcctcattctctctctctttttaaaatagagatgggcactttgggaagccgagttgggtggatcacttgaagcctggagttcaagaccagcctggccaacatggcaaaaccccatctctactaaaaatacaaaaattagctgggcatggtggggctcgcctgtaatcccagcaactcgggaggctggggaacgagaatcgcttgaacccaaaaggcggaggttgcagtgagctgagatcacgccagtgcactctagcctggatgagagagtgagactttgtctcaaaataaataaaataaaataaaataaataaaatagagattggatcttgctatggctaaatagagattggatcttgcccaggctaatatggaactcctgcctcaagcaatcctgcctcagcctgtcagtgttgggaatacaagtatgagccaccatgcccagcccctcctcattttctctaacagttggtttcctaataaatttcttgcatatttaattttattctgggatcccaccttctctgaggacctggactaacacatccccaaatctgtttatgcctgttgcaggtgctactgtaattacataatttaactaagccataactaaaccatagaaatatggacacagaaggaaagtgagttgttatttctatgaaaaccaagtagactgctttagaaagttttgaaaagggtatttgcttaaaagaaaaaaaaaagctgttcacaaaaagacaaacgaggtctttttacaaaaagacaaataagggtgtggtggctcattcctgtaatcctaagactttgggaggctgaagcgggcagatcatttaagctaaggagttcaagaccagcctgggcaacatggcgaaaccccatctccacaaaaatacaaaaatttgctgggtgtggtggagtgagcatgtagtcccagctactcaggaggctggggtgtgaggatcgcttgagcccaggagatttcagctgcagtgagccgtgattgtgctactgcactccagcctgggcaacagtgcaagggactggagggagggagaaatgggagttgtttaatggatatggagtttcagttttgcaggatgaaaaagttgtggagatctgttgtaaaacaatgtgaatatacttaatactactgaatcatacacttaaaaatggttaagatggtacgtttggcacacctgtactctcagcactttggaaggataaggcaggagctcaggagtttgagaccagcctgggcaacctgcagtgagccatgataatgcctctacactccagcctgggcaacaagagcaagaccctgtctttaaaataaaataaaataaaataaaataaaaataggctgggcgcggtggctcatgcctgtaatcccagcactttgggaggccgaggcaggcagatcacctgaggtcaggagtttgagaccagcctgcccaacatggtgaaaccccatctctactgaaaatacaaaaatttgccaggtgtggtggtgggtgcctgtaatcccagctacttgggaggctgaggctggagaatcgcttgaacccgggaggtggaggttgcagtgagccaagatggcgccactgcactccagcctaggcgacagagcaagactgcatctcaaaaaacaaaaacaggccgggtgcggtggctcacgcctgtaatcccggcactttgggaggcctaggcaggcagatcacgaggtcaggagatcgacactatcttggctaacatggtgaaaccccatctccactaaaaatacaaaaatttagccaggcgtggtggtgtgcgcctgcagtcccaactactcgggaggctgtggcaggagaatggcgtgaacccgggaggcggagcttgcagttagccgagattgcgccactgtactccagcctgggcgacagagtgagactccatctcaaacaaacaaacaaaaaacaaaaattagctgggtgtggtggcacgtgcctgtaatcccatctactcaggaggctgaggtaggagaatcgcttgaactcaggaggtagaggttgcactgagccgagattacaccactgcactccagcagcctgggcgacagagcgagactccatctcaaaaaaaaaaaaaaaaaaaaaaaagtaaaacataaaaacttacaaagtagctgtttggtttggaaagactaccggaaaaggttggggaaacgctatagtaacccgagtctgcactcacactggatcttgagtgtagatccagtagaaggaaaaggaaggcagggcaaagggatgttccagggatcaggaggaagctgataaagagaccatttgaggattgagaaatggtgttcttcaaggccattctcagtcttgctttgcaagcatcctaaagcacttaggcactttataggatgtggaaatctagacaatttgtcatgggtattgttatgcaagaaaagaaatacgccaggaggctgaggcagggggattacttgaacctaggagtttgacacggcagtgagctatgattgcaccactgcactccagcctggatgacagaacaagaccccatctcaagaaaaaaaaaaaaaaaaagggccagatgtggtggctcatgcttgtaatcccagcactttgggaggccgaggcgggtggatcacctgaggttgggagtttgagaccagcctgaccaacatggagaaaccctgtctctactaaaaacacaaaattagccgggcatagtgccgcatgcctgtaatcccagtcactcaggaggctgaggcaggagaatcgcttgaacctgggaggcggagactccagcctgggcgacaagagcgaaactccgtctcaaaaaaaaaaaaaaagacaagtgcagtggctcatgtctgtaatttcagcactttgggaggccaaggccgtagaattgcttgagcccagtagttcaagacgctggagtgagaccccctctctataaaaaataaaaacttggtcaggcatggtggcggcacccctaggctcagctactcaggatgctgaggtgggaggattgcttgagcctgggagttcgaggctccagtgagccatggtcctgccactccagcctgggcaacagagggagaccctctcaaaaaaaaaaaaaaagaaagaaatacggaattccaatcagcaaacccgtactcaaagaaaaagccttggcgttacatcaaaagattggcgagttagtatatatttctatgttttaccttaaagcaaaatgtacaaatacatataacttttttttaggccagtcaagtgaggcagtgggagtggagaaggaaacaaagaaatctgtaactagttataatcaaatacttgtaaacaccactgcactcggaccagcccacatatcttttttgttgttgttgttgaaacagagtctcgctctgtcacccaggctggagttcagtggcttgttctttgctcactgcaagctccacctcccgggttctcctgcctcagcctcccaagtagctgggactacaggcgcctgccaccacgcccggctaattttttgtatttttagtaagagacgggggtttcactgtgtgagccaggatggtctcaatctcctgacctcgtgatccgcctgcctcggactcacatatcatttttaatgatccttttaaacttactgtttttttttttgtttaattgaccaacttctggtctcaattgcatcaaataagaaagcttctactgaaataatagtaagtgtgaattgctttattgtgtaattactatacatctgggtgaaaagtctcgagtgtcaagtgtcagtccagtagaagaaaggcagggaggagggacgttccaggaatcaggaggaagtcaataataaacagagactaagtgaggggttggagaccggtgttcttcaaggtggaaggacatgcatgggggtattgagagggctggaacaagaggaggctgtagtcaagaagcaagagaggaaactgtgattcagtgggtgaaacagtttttggtgatgacaaacctctgttgaggccaggggagcaggtgggtgactgaaggagagacaaaggtcaccagagttgaggaggaatcacaaaccccgggtattgggtgagtcatcctatgaactcagaagtctactagactggcagcaagattgggcttggagaggaaattgggggcaggtgtccaagcagtagtgtggtagaagcagcttgtatagggtcaggaaaaccaactgttaaattttcaattttgtgggcttgttgttacacattgtcattattaaaatgtaattataaaggccaggtgcagttgttcatgcctgtaatcctggcactttgagaggccaaggcaagcagatctcttgagcccacaagtttgagaccagcctgggcaacatagtgaagcccaacctctacaacaacaacaacaaccaaaacaaaacaaaaaaaaaaaaacaaaattagccgaatgtggtggtgggcactgtaatcccagctactcaggaggttgaggtgggaggatcgctttagcctgggaggcggaggttgcagtgaactgagatcacgtcactgccctccaacttgggtaacaaagtgagaccctgtctcaaaaaaaaaaaaagtaattatataaacttacaattaagtaaagtatattaaaacaaaggtaatgaaaattcaaaactcattactttctaataactttcctacatcttactactattcatgctcttggagttaatttctgcttcttgcatctgtatggtggaaatactgtataatggtgtgctatggtgcatctctgcccagctctgcattcagtggcatcgtgttattaactcaaaatcagctccggtggaaatatttacgccatggaaattagccaacactacagatacagagcttgagttactgagttttttttttttttgagacagagtttcgctctgtcgtccaagttggagtgcagtggcgcaatctcagctcactgaaacctccacctcctgggttcaagtgattctcctgcctcagcttcctgagtagctgggactataggcgtgcatcaccatgcccggctaatttttttgtatttttagtagagacggggtttcaccgtgttagccaggatggtctgtatctcctgacctcatgatccacctgcctcggcctcccatagtgctgggattacaggcatgagcccctgtgcccggcccactgagttattgttttgtgaaatacctatactcattcatcaactgcaatcatagatatgagttcagcaaaaaacgacagcattctgtgagaatcaattggttatatggaatttacaataaagggagttgtatattatgtgtaagttctgtgttaagcatcctttctatcagtaaaatttatagtaaatatatttgcacattatatatatatacacatatatatgtaaatacacacacacacacacacatacacacacacatttttccctaaagagctggttgttaaacatttacaaacacatcactcagctaaggactcctttcccggagactggcattggggtgatggtaagcaataccatcatggtggggctgattctccttcctgcccctgagctcacatctcacggggagtcaggaaccgaggtaacaatacagcactgggtggcagggagggaaggaactgagaccaagtagaggtagggaggtgttcaaagcaagtgagatttatgtagacactcaaaggatgagtaggaatcagccagccaaaggaaaaacatgagcaaaggcccagctgtcgtcagaaacaatgggaggcaggctgggtgcggtggctcatgcctgtaatcgcagcactttgggaactgaggcagatggatcaccaaaggtcaggagttcaagacaagcctggtcaacatggcaaaatgctgtctctactattaacacaaaaattagccaggcatggtagtgcacgcctgtaattccatctacttgggaggctgaggcacgagattcacttgaacccaggaggcagaggctgcagtgagccaagatcatatcactgcactccagtctgggcaacagagcgagcctccatctcaaaaacaaaaacaaaaacaaaaacaaaccaaaaacaaaacaaaacaaaaaacccacaacaggttatgatgtgcctgagggcagtggccatgggttgctcctcctggagcacctggagagtggagaaagagcagcctgtactggaaagggttttctgaaccctcgatctaagaagagtaaacatttctggacaaagggacaaagatgggagtcaggtgatgggaagagagggtattctaggcagaaggaaccgcatgagcaaaagcaaggaggtgaaagagaatctgaatacatagatctgcaggcagttctgggtggctggagtgcctgtcggggagagtgtgcaaaagacaaggctggagaagtggccgtggctgaggccaggagggctgagagccaagcccaggagagggtgtgagttcttaggagctgtggggagccttaggaggggcctgagtagggagtgacatgattaagatccccgcggctgcttgaaggagaatggcttcagtgggtgtcaggtagggaaagactggagaatgtgatacttttgggaagatactgcagtcacgtaggtgagagatgatgaaataaggtagtggatgtggagaaggaaaaaaggaaaattgattccaaagatatgggggagcggaattgaaaggacttaacttcaaggagtctggcatgggtgattgagggctgatgcagtcgttttcgaagagcactgatccgttattttgtagaatgtccctccactggagtttgtctgatgttttctcatgattagactgagtttggccgggcatggtggctcacgcctttaatcccaacactgtgggaggccgaggtgggcagatcacttgaggtcagaagttcgagaccagcctggccaacgtggtgaaaccccatctctactaaaaatacaaaaattatctgggcatggtggtgggctcctataatcccaggtacttgggaggctgaggcaggagaatcacttgaacccaggaggtggaggttgcagtgagccaagattataccactgcactccagtctgatgacaaagtgagactctgtcaaaaaaaaaaaaaaaaagattgaggttacacattttatgcacaaatatcacacagatcagtgaatcctactaggaggtacatgatatacccatgtcttattactgatgatagagtcatctttgggggcagggtcacagaaggaggtacacttatagggaaaagacctagcgttctggtttgggatggggctggagtgcagaagagaatccagatcagagacacggctttgggaacactcagcaccacggaggtagctgaggacttgggagggggggcaaggttgccagggcagagggtgtcagaaggaagagaaacagtggaagtggaagcaagactggctttgcattgtatccaagtggtcaggtgggcgaggatgggaatgcgtcctgtggatttggtatccagaggcttggccagtgctggggttagtgctcaccagggccaggcccaggctgggacttgtggagggcattttttctttctgggcagttaattggagcagatttggatgggcactcctggccgtgtgtgtttttttgtttttgtttttgttgttgttgtttgtttttttaagacagggtcttactctgttgcccaggcttgagtgcagtgcacgatcatggctcactgcacccttgacctccctggctcaagtgatcctcccccttcagcctcccgagtagctgggactacaggtgtgcaccaccacacccagctaatttttgtatttttagtagagatggggtttgccatgttgcccaggctggtctcgaactcctgggctcaagtgatccaccaacctaggcctcccaaagtcctgggattacaggtgtgagccactgagcccagctcactacttctgatttaactcaacccatgagaagtgggcagtgttctggattctgtgttaagaactcctggctaagctgcaagaggtgacaatgaaattggcttgtgtgcaggccagcaggctgcctagcccccagcacttccagctgtggacagagccacctagctggtggagaactaactctgtgggcgtgggtgcccccaggtgttcaattggaggccctgctgttggaagggaagcagtgaagggtggccatttgtaaatctttggagaaatttctattcagatcctttgtgcatttttaagtggattatttgtctttttattattgagttgtaagaattcttcgtatattctaaatgcaagtctttttttagatatattgcaagaggtagaaggtggggtccttattccctagactcaggctgccccagggatccacatatatatattttgagacagggtctcactctatcacccaggctggagtgcggtggtgtcatcacagctcactgcagtcttgactgctggggctcaagcgatcctcccacctcagcttcccagtagctgggagtactggcatgtggcaccatgccagaatgatttttttttttttttgtagagatggggtttcaccatgttgcccaggctcatcctgaattcttgggctcaagtgatctgcttgcctcaacctcccaaagtgctgggctttcaggcatgagccacatcacctggcctccccccaatttttaaaaatgacattactttactgagttctagttcacatacaataaattgcacctatcttaagttttcagtttgatgagttctgttttttttttttttttttgagccaagtcttgctctgtcacctaggctagagtgcagtggtacgaccttggctcaccacaacctctgcctcctggggtcaaacaattctcttgcctcagccttccaaatagctgggattacaggtgtctgccaccacagccagctaatttttgtatttgtagtagacatagggtttcaccatgttggtcaagctgctctcgaactcctgacctcaggtgatccacctgcctcagcctcccaaagtgctgggattacaggcatgagccaccatgcccagctgagttctgataatttcatacagttgtaactatcaccctaaacaagatctagaatttttttttttttgagacggagtctcgctctgtcacccaggctggagtgcagtggcacgatctcagctcactgcgacctctgcctcccaggttcaagtggtccctctcagtctcccaagtagctgggagtacaggtgcacgtcaccacacctggctaatttttgtattttcagtagagatggggtttcaccatgttagccaggctggtctcaaactcctagcctcaagcaatcagcctgcctcggcctcccacaatgttgggattacaggcatgagccaccgcacccagccaagatcaagaatatttctatcaccccccactctccccacaacttttatttttgcccctttccattcaatccacacacctccccaaccagcaaccactattctgacttccatcacattaattttcctgttcttgaactttatataagtggaatcatatagtttgcatttttttggtctggcttattttgctcaacataatgttttgagatttatccatgtgctgtatcagcagtttattcattttaattgttaagtcatattccattgtatgaatatgcaatgatttctctattcattctgttgttgatggttgtttccagtttttagctactaggaataaaatcataataaatattcttggccattttgtgaatatgttttcatttctcttgggtatatacctaggagtagaattgcagggtcaaatgataacttgtttaaaaatgtttaaattttggccgggcgtggtggctcactcctgtaatcccagccctttgggaggctgaggcgggcggatcacgagatcaggagatcgagaccatcttggctaacacggagaaaccccgtctctactaaaaatacaaaaaattagccgggcgtggtggtgggcgcctgtagtcccagctactcaggaggctgaggcaggagaatggcgtgaacccgggaggcagaggttgcagtgagctgagatagcgccactgtactccagcctgggcgacagagcgagactccatctcaaaaaaaaaaaagtttaaattttttagcaactgccaaactgttttcccaagtggctgcactatcttactttctaccagcagtgtatgaaagttctgatttccctacatccctgaaaatatttattattatctatcttttaaattatagtaatcctagtacatatagagtggtatctcattgtggttttgatttgcatttccctgatgactaataatgttgaacatgttttcacatgattattggccatttgtaaatcttctttggagaaatttcttttcagatcttttgtacatttttaagtgggttatttgtctttttattattgagttgtaagaattcttcatatattctgggcgcaagtctcttttcatatatatgatttgcaagtatcttcttgcaatctgtggattgtcttggggagcttccagtctgtttgggcgagaagggacaaacacagggacagggcagtgtggagcagtgtaaggaggagaagcactgttcagggaggtctagggtgagctctctgagcctcagggttgctcactgctggatgagctgatctgacatttctgtggctctgtagcaagtatgtgtgtccctgtatgctcggtgctgtgcaatcaagcacacatgctaagtgtcagggaggtggcatctcacaagaccaggagcatgggggagactgggggaagcaggaagttctttctcttctttctttctcttctttctttctttttttctctttctctctctttctttctttctttctttctttctttctttctttctttctttctttctttctttctttctttctttctttctttctttctttctttctttctttctttctttctttctttctttctttctttctttctttctttctttctttctttctttctttctttctttctttctttctttcttttttggcagggtctcactttgttgcccaggctggagtgcagtggttgaagaacatggtttactgtagcctcaatatctcaggcttaatgtggtccttccacctcagcctcccaactaaccaagactacaggagcatgctaccatgtcaagctaatttaaaaaactttttttttttctttgagatgaagtctcactcttgtcccccaggctggagtgcaatggcacaatctcggctcactgcaacctctgctttccgggttcaagcgatttccctgcttcagcctcccaagtagctgggattacaggcgcccgccaccacacccggctaatttttgtatctttagtagagacggggttttaccatgttggccaggctagtctcgaactcctgacctcaggtgatccacccaccttggcttcccaaagtgttgggattacaggcatgagccaccgcgccagtcaggggaggctctttgttaagaaagaagactccatattgtaaacttccacaggactaacagcatggatgataacgtgattaacaggattatcatggaggtgacataagatggctcaggagccaggctgatgggtttaggtcctggctgtggtagatgtcacaacacagtgcccttcccatacccctttagccactcctgatgtttttttactataagcccctgggattttctgcctgagggtgctctctgctcagaaggcactccggcaggctggaggtgccaggaacagctctcaactaatgaagaaatcatcagtgtcatcactccttcagtgggatgagtaccttgtcttcttcactctcccagagatgcccaatacagtcaagccccatttgtccacagtggtaatctgctgattattgcaccctatattgcttttcttcatttgtttgtttcactccccctctctcctactagtgctccacggaatcatctctcaaatggaccatttatatgaacatccttatctcagtgtctgcctctggggatacccagcctaaagatagtggttcttttatttcttagatctatccatccaatttccttgggcagatcactttacctctctgaatttcacttggctcatctatagaatatggatagtatcacttctttctttctttctttttttttttttttgagaccgagtctcgctctgtcgcccaggctggagtgcagtggcgggatctcggctcactgcaagctccgcctcctgggttcatgccattctcctgcctcagcctcccagcagctgggactacaggcacacgctctcatgctcggctaattttttgtattttcagtagagaccgggtttcaccgtattagccaggatggtctcgatctcttgaccttgtgattcacccgccttggcctcccaaagtgctgggattagaggtgtgagccactgcgcccggcccaatagcacttatttcttaggatggtcatgcagtttagcatttcactcagacattaaaagttcagtaaatacttctatttttattcgtttactggcctgtaacataaatattctcccagagactcttggatggacatgcctcattcaggcatagctaggcagggaaagataagcagcctggagctggccctgtgggacattgattgattgggttcctgttcccagttacttgctccctctgcaatgggattaaatgtccccaccatttgtcatgtgacttatctggcatcctgtatgggtagcatacctccctgacccccatgaattaattttgggcttacccatgtgacttgctttgagtaatggcatatgagcagatgtgacattctccacatctgcaaagaagcttgaaatgtgttactgcatggtttggcacaggctctctcacccctgccctccactacaacaaagacatgtctccagtgcctgccacgcagtttgagctagcacctttaaatactttatttatttatttttttgagaggaagtcttggtctgtcgcctaggctggagtgcagtggcgtcatctaggctcactgcaacctccacctcctgggttcaagggattcttgtgcctcagcctcctgagtagctgggattacaggtgcacaccaccatggctggctatttctgtatttttagcagagatgaagtttcaccatgttggccaggctggtctcgaactcctgacctcaagtgattcgcctgccttggcctcccaaagtgctgggattataggcgtgacccaccgtgcctggcttaaatactttatttttaatttttaaaaattgttttatccatctatttacagatcattaaatacttactgtgtaccaggcagtcccatatgttacatgtgtctgcatgtattaattcatttcatccttgcaggaaccctaagacacgggtcccattatcaccatccttattttacatatgtggaaaactaaggttcagtgaggattagtaccttctcaaattcacactgcagggaaggggcaaggtctgccttctaggttgatattcttaaccactgctgtatgcttcttctcatggtaggtaaccagcaaatgcctattaagtaaacgtttgtttaagtgatcattgttcccttccatttacctgaataggaaaggtacaatctactgggacaaaggtgggcttctgactttggacctgctcactcttcctacgttagttgtttatcaaataggagacccttctgattcttctgagtggagaaaaattgtccgtggtcatcagacgggaaccccaatatttcccttgtaggacctacatgaaccacaagatatctcctataaattccatgtggtttccagacatcttccttgtggatcccagtgtggacctcagatctctctcctaaaggcctatgtgaacccctatatctttcctgaggcccacatggactcccaacattttccctgtagcagccacacttgataacttcgacaggttcccagttgtcatctcattggctgctctccacagctctgtaaatcagccttggcttgcattatagcagggagagacagcatgtgggtcaaccagggacaggactgacacagaacccagttgtcctgccccgaagcccaggacccttccttcctggttggcctggtggcaggatgatgcttcctgctcagcccttcccaggcaccgaggctctctccctccttttcccctctgccacactagttcttgtctgccttttttcactgccacccccttttcatgccagctgtgggagtgaggccccactcctggcaggatggagccagacaatgggcccttattctaggcaaagaatccctgcagtgtctcccacccactgaggcccccttccaggcctaggatggtgtgggtggggggtggagggtgggtgtatggtgtaggggaaggagcaattggctggcaggacagacagtggccctggccctgcctgtagagatcccacggaggtttactatgtaaacaccaatcacaataaaatcctgtcttcactcccagcccatctctccaagtgggtctctctcaaccctccaaagctctgggtttttaaacatttacccttgcctctactctctcttggtattcatctctgcatatcactgtctctttcattcctttttctgagtctctttctttttctaagcctctcctctctctctctctctctctctgctcctttgcgtaatttgtctctatttcttgcctctttcttgcttcattatgctcccttacctatcttatctttccatgtcttttttctctccaggccttgagctctcatctcagtctctctctccgtgtgtctctgtctctgtttgcagctcttctttctcgtcctcctatgtcgtctttccgtggatctgtgtccttgcctctctgaatatcatctccgatcttccgtcctctgttctctctttccccctgcgcctgcagatctgaaggaccttccgcagtcaccacactctcctgctttcagctctttctcactcctttctggcacgtcccagaggctcctggcataggtataggaggttattctccccagtttacagatatggaagctgaggctctggctgctggtgccaggctcccatctctgggtctcttccttccacctacacgccaggctcttgtccctgaggtgcccgtcaaccacctgatccggccggggcccgggaactagcacctcggacagctcctggaagatgccggggcggccgggtcgtccttctcgcgagctcaggaggagcagccttaggagcagagcggaagtctcgcgagagtgactgctgcaggcagtggcggcgcgggcgcgcgcagagacggcctcgggcgcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcaggtgagtctgggcatgaaggctgggaggagagctttgaagggaagctgggcgcggggcgagaggtgtgggggtcgctggctgcagctttgttcctcctacacttcacctttggatgcaggaagaaggccgaactgctggagaggtgggagtggaggtgacctttactgtttggggctgggggagagcgctcagggcgcacccaggccccccgagccccccaagcccccccattcccatctgtggctcccgcagagggaactgggcctttgggtgacgtcagaccctggatctggagcctgagctttgggccctccatcccccccgccagccccacctggcgttccctggaaaccggccttctggagatggcgtgcgcagccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtggtgagttgggggcgccggatttggctcatttcaacgctggccggaggtcacgaggatggaggtgaggtgtttgtgaaccgatccttgtcctccgcctcggggagctcctggtctgtgggttgggggaaccaagtagagactcggactgagcattcactgtcacaggcggcttaaacaagtaatgtcccagcttcccgatggggagatcagtgagggcctggcagactttcccagggacacagagagaaagggaggcgacagctagcgaataggagacttccagaggtgatgggatttgggtgggaggagaggcaagagagggcattccaggagaatgtatgggcaaaggcacagggatgaaaacgagcacagctgttgggggctgagcctgggagctcagccatgtgactgcccatggggtggtggagtctggagaaatttgcaacctgtcccctacatgttctgcctcacggagcagggctctgaaagagggagatggttcttgcaggggcatgattggcagagagattttgtttggggctacacaggtcttgctaacttaggtttgttctgggcttggtgagccttagggcaaagtctctagagctgagagggggctgtctctggtgaatgggcccctgaaagagggtcttaggtttagcaaaccccttggagagttagtggggtcccaggaggggagttctagagagagaccttgggctctgtggctgtttctttaaccgtttcctgagtggccacctccaagcaagttccccaagtcacctcccctctctgggcatctctttctagcacctttctctagagatgaaataataggactaagtagtgacctcccttgaggatgctccttgttctagtttagagcatcccccctttcttctccctcttccttttcctttcctcccctatccctctgcctccctgtccctatccccaccccttgccccccacagcatttcctttacaggctgcacttccttccctgctgccagccaggagtttcggaaggtttcctggaggaagtgtgatacagcaggtttgacagcagctttgggcttaatctgattgggggagggcgttaattgcctccctcccacccattgggaaagtgtccaagtcttaagcaagtatatggattgactgtgctctgtgctgggtccctcctggaaactccatccaggagggagtgaggagattatgggagaagacgtgaacacttagtgcccaatgactgactcaaaatgtatgcagcgggatgcagagcagcgatttttggaaaggcttcccagaaggggtgggatgtgagaaggtagcaggacttagaggagctgatagtgctgccaatttaggggcactggaagcagagggggcggctagagatgatctcctgcatgaggctgggagtgtaggaggcaggtcaacctgtgagcagccaaaggtggtgggagggaggtttgtagctgactggcacaaagccttgaatgccaggcaaagatctgtaggaggctactgaatagtcatcagtaggacagggacagcatggccaggagactgctgttttctgaggattattcatagttctgggatttcagggcagaagatggggctaggagtgggatgaggggattggaggtagagcaggagggggaaacttccatcttagcaggttggctctgggcagcaaaaaggaatcaccatttctgtgccagggatgaggggcccatactggtgagcagggagccctggagttagccccaggactctggcctgatctgaagccaggcttgaccctcgtctgctgccagaggcctcagtctccccactgtgggggcttctgtcctagcttcacaataaggaatggaatacattatagttagggtttcatgaacaaaattcaggtagtaactgctatcttattgataattaaggtgtttccctaggcctacatctttggagggatatgtagcccttatccccattataaaagattatcagttgagcagattgctaattcttctgttttgtagtctaagaactttggtttggccggcgcggtggctcatgcctgtaatcccagcacttggggaggccgaggcgggtggatcacctgaggtcaggagttcgagaccagcctggccaacatggtgaaaccgtgtctctagtaaaaatacaaaaattagccaggcatggtggtgcacgcctgtaatcccagttactagggaagctgaggcaggagaatagttcgaacttgggtggaggaggttgtagttagctgagatcgtgccactgcactccagcctgggcaacagagtgaaactccatctcaaaaaaaaaaaaaaaaagaactttggtttgcagaggccagtgattgctgtcttcccctccaaccccccaccccccatttcaaaggcttcccagaaacaagggcagagaagcctggagccttccatttctgtgaccctagtcttttaccaccctctcaagccccagattctctctgccctaacctttatatacaaacaaggcagctttgccctctgctctggtttctgctctgaattattcatactttgctgcactgacttctctggaactgtaagcagacttttgggagattgtctgggaccagggacaggggttaggctggagcccggttagggagaagactcctcctttgaggcccctatgttctagttgttttctcctctccctctgcttccttgttttcctggaggtctttagtgctggaccacagtctcccactccatgtcccattgtctcaggggaggtagtgcctctttcagtcaccattttaaccaactacatctgaatgtggtcctcattggcatgtggccacctctgaaatcttaaactctagtatttctctctgaccacagtctaactaatgctttatgtgctctgacctcaaggagacctctagttctcagacacctccattttctccatctcatgaattgcctcttccgtgttctttctgaactccatgccctcaaccactttgccactttgcctgtgtgtcacccgagctgccaggaagggtctccagtctcagccatcccttcatcacttatagaaacccctctcctcattcccatcagttcccctttctattccatgggaggagtattccaaactggactactctccccaggccctttgctcatgtagagggtggttggggtgtgtgtgggggaggtggaaccacccccatgttttcccgaggcggagcttgcagtgagccgagatcgcaccactgccctccagcctgggcgacagagcgagactccatctcaaaacaaaaacaaaaacaaaaacaaaccaaacaaaaacaaaaataaaaaaacacaaaagttagccaggcatggtggtgcgcacctgtagtcccagctactcgggaggctgaggcaggggaattgcttgaacccaggagacggaggttgcagtgggccgagatcgcgccactgcactccagcctgctgacagagagagacgctgtctcaaaaataaataaataaaataaaacacttcctgattgccatatcaacttgtcacctgactgcttcatggccatggatattgttgacccagtcgaccagtcattaaaaagattgagatagatctgtattcattaacatgaaaaactttcacgagatattgttgagtggaaaaaaacaggttataaaacaggatgtgtggaatgatctcatttttgtcatatatgattctatatacgttaaaaatgaaagccaacaaaatccaccaaacctaaagatcagactgttaaaggggtggcatctgagaaagtggattttgggaagacttttctactttatgcacttagattttttttttaattgcatatatttttacagatagctaaaaagcaacatattaattaactaattagtttagagatgaggtctcactatgttgtccaggctgtagtgcagtgactattcacaggtgcaatcatagctcattgtagcatccaactcctgggctcacaatcctcccacctcagcctcctgagtagctgggactacaggcacatgccaccgggctaggcatatttaaaaaacctttaaggccatttttttttttgagagggagtcttgttctgtcccccaggctggagtgcagtggcacaatctcggctcactgcaagctctgcctcctgggttcatgccattctcctgcctcagcatcccgagtagctgggactacgggcccgccaccaagcctggctaattttttgtattttttaagtagagacgaggtttcaccgtgttagccaggatggtctcaatttcctgacctcgtgatccgcccacctcggcctcccagagtgctaggattacaggcgtgagccatcgcacccagcctttttttttttttttttttgaagagaagaagaataaaatccttcagtggctcccgtgacactgaggacaaagtccaaatactgcccatggtcttcaaggccaggatgacctagccccatttacctttcaactccattttgcctttcctttgctcccttcactttgagattcatccttcctctgcctctttcgttccttaagtatgccgtgctattgctcttctgactttcacacctgctttcctgattctctttccctggccaactccctattccttgttaaaaattcagctccaggccgggcgcggtggctcacgcctgtaatcccagcactttgggaggctgaggcgggcggatcacgaggtcaggagatcgatactagccgagaccatcctggctaacacggtgaaaccccgtctctactaaaagtacaaaaacaaaattagccgggggtggtggcgggtgtctgtagtcccagctactcgggaggctgaggcgggagaatggcgtgaacccgggaggcggagcttgcaagtgagccgagatcgcgtcactgcactccagcctgggcgacacagcgagactccaaaaaaaaaaaaaaaaaaaaaagattcagatccaatatctatgaagccatccttgactcctgtaagacagaccagggaggtgttctgtgttaccacagctttctgagtctgctctcccagagtgctcaggctgtgtcagaattgctccttgatttagctgggtcctgtacgcttatctcctccctctcaccttcatcttgtctcctctatcacagagaaaattgggctaggtgcagtggctcatatctgtaatcccagcactttgggaggctgaggcgggtggatctcttgagtccaggagttcaagacaaacctaggcggccaggcaccctggctcatggctgtaatcccagcactttgggaggttgaggtgggtggatcacgaggtcaggagttggacaccagcctggccaacgtggtgaaaccccgtctctattaaagatacaaaaaatttgccaggtgcgatggcacgtgcctgtaattccagctactcgggatgctgaggcaggagaatcgcttgaacccaggaggcggaggttgcagtgagctgagatcatgccattgcactccagcctgggcaacagggcaagactcggtctcaaaaaaaaaaaaaaaaaaaaaaaaaaaaagagactaacctgggcaacatggtgaaaccccatctctaccaataaacaaaacaaaaaattagctaggcatggtggcacgcatctgtagtcccagctacttgggtggctgaggtggaaggatggattgagtgtaggaggttgaggctgcagtgagctgtgattgcaccaccgcactccaggctgggcaatagagtgagaccctgtctcaaataaaaaataaaacaaaattgaatgcctgtgaaaataaaataataaaacagaaaattgaagcagacatccaagatgctctcactgcccatctaagacctcaaacctgcctgcatctgcttggatcctgttcggcttcccacctgttaggatcaaggcttgtccacctccttgcactggtgcccctgtgtctccctcttcacgggctttgtctatcaggtaacatctgtctctactgtaattgcaacctttctatgtatcctacacatctctggcttatttccacctaaaatgacccccagctgcagccctccctgggccctctccctacccccatatcctacccaggtggtaccctatctctattctctctgtatattgtcagccaggcttctttatcactgctgtcaccaccaaaacgattcttgctggattcacagctgactcgatgctgttagtgtcatgaacgcgttagtcccggtagtgccatcctttcacatgggagccctcagtggcattatcacatttgtccaatctctgcccctggctatggagactccacgctctctgggctttcctcgtgtctcatcagctgctccttctcattcttccccaactatcctattctgcttgccttttttttttctgcttaactttcttgactttttatttttttgaataggtagtgcatttatatatgatttacagttcacaaagatgttccaaattttgtcagttctaagatgaacattttgatatttctgaaaacattttcatgtctgtgttttaaaatttctggcatcttacagttacaaattggcatttttatttttattttttggagattgagtctggctctgtcactcaggctagagtgcagtgtggcacgatctcagctcactgcaacctctgcctcctgggctcaagcgattctcctgcctcagcctcctgtgtagctgggattacaggcgcacgccgtcacacccggcttatttttagtagagacagagtttcactgtgttggccaggctggtctcgaactcctgacctcaagtgatccgtccatctcggcctctcaaagtgctgggattacaggcgtgagccatggtgcccagcctgcaaattggcaatgttttttcttacttttggtcaataaaataatggtctgtcttaaaactgatgatgtcatcaattatatggaaatggtataaagttatatagtaaatattctgcttcccacctactctatatccattcagttcctttgttccccagagagccacaattaccatatttttttcttgatatccttccagagattctttgtgcatatattgtcaaatacagatatgtatatttccccccactttttattttgaaaaatttcaaagctacaaaaaagtttaaagaatagggcaatgggctgggcacagtgacctcatgcctgtaatctcagcacgttgggaagccagggcgggtagatcgcttgagcccaggggtttgagaacagcttgggcaatgtagcgagacctcgtctctacaaaaaataaaaaaattagctgggcatggtggcgcacacctgtattcccagctacttgggaagctgaggtgggaggattgcttgagcccaggagttcgaggctgcagtgagctatgattgcaccgctgcactccagcctgggtgacaaagtgagaccctatctaaaataaataaataaataaaataatgcagtgaacaactgtatacccttctcccatcaattattaacattttgcaacatttgctttatcttttatttttactttttttttttttgagatggagtttcgctcttgttgcccaggctgcagagcaatggcgtgatctccgctcaccgcaacctccgcttccggggttcaagcgattctcctgcgtcagcctcctgagtagctgggattacaggcatgcaccaccatgcccggctaattttgtatttttaatagagacagggtttctccatgttggtcaggctggtcttgaactcccgacctcaggtgatccgcccgcctcggtctcccaaagtgctggtattacaggcgtgagccaccacgtctggcctatttttactttttagagacaggatcttgcgttattgctcactgaaggctcgaacacctgggcacaagtgatcatcttgccttagctcctcatgtagctgagactacaggcacacaccaccatgcttgtttctgctttatgtatatgtataaaattttttcgcagaaccgtttgaaaggacgttacagaccagacactgcttctaaagaccagcgtgtgtcttctaagaacaaaggtgttctacaggccggcatggtggctcacgcctgtaatcccagcactttgggaggccaaggcgggtggatctcttaagcccagaacttcaagatcagcctaggcaacatggcgaaaccttctctctgcaaaaaatacaaaaattagctgggcatgatggcacacacctgtagtcccagctactcaggagactgagactggaggatctcttgagcctgggaggttgagactgcagtgagctgtgattgtgctgctgcactcctccagcctgggtgacagagtgagaccctgtctcaaaaaaaaaaaaagaaagagagaaagaaacaaaaacatgcacacatacaatacccaagaaatttaatagtgaatagtagtatctactatgcagcctatattcaagtttctctagttgtcctaaaaatgtcctttatagctgtgattttaaaatccaggacctggttgggcgcggtggctcacgcctgtaatcccagtactttggaaggcggagttgggcggatcacgaagtcaagagatggagaccatcctgcccaacatggtgaaacccagtctctactaaaaatacaaaaattagctgggtgtggtggcgtgcgcctgtagtcccagctacttgggaggctgaggcaggagaatcgcttaaatctgggaggcagagcttgcagtgagccgagatcgtgccactgcactccagcctgggtgacagagtgaggctcttgtctcaaaaaaaaaaaaatccaagatccgggcctgtaatcccagcactttgggaggccaatgcaggcagatcacctgaggtcgggagtttgagaccagcctgaccaacatggagaaacgccatctctactaaaactacaaaattagctgggcgtggtggtgcatgcctgtaatcccagctactccaggctgaggcaggagaatcgcttgaacttgggaggcggaggttgcggcgagccacgattgcaccattgcactccatcctaggcaataagagcgaaactccgtttcaaaaaaaaaaaaaaaaattctgccaggcttccccattgcatttggttgcatgcctcttttgtctccattaatttagataaattccccctgccaatttctgtctttcatgacattaacatttgtctcgtagaatttcccacaatctgaatttgtcggattgttttttcataattattttcagattaaacctttttttggcaacagtattcatacatgaccttgagtccttctgtgcacagcatagcaggaggcacatgatgttctttctttctttctttttttgagacggagtctcactctgtcgcccaggctggagtgcagtggcgcgatctcgtcttactgcaacctccgcctcccgggttcaagcaattctcctgcctcagcctcccgagtagttgggactacaagcacgtgctaccatgcctggttattttttgtattttttggtggagacaaggtttcaccatgttggccaggctggtctggaactcctgacctcaagtgatccgcctcggcctccctttttttttttttttttttttgctttgtttttttgagatggagtctagctctgtcacccgggctggagtagagtggcgtgctctcggctcactgaaacctccgcctcccgggttcaagctattctcctgccccagcctctggagtagctgggattacaggcgcccgccaccacacccagttaattttttgtatttttagtatagacagggtttcactgtgttggccaggctggtctcgaactcctgaccttgtgatcctcctgcctcggcctcccaaagtgctaggattacagatgtgagccactgagccaggccctccctctcttttaaaaaataaaataataatgtcactttggactcatggattaataataaaaaaaatctatgtgggccgggcactgtggctcatacctgtaatcccagcactttgggaggctgaggtgggtggatggcttgaggccaggagttcaagactagcctggccaacatggtgaaaccctgtctctactaaaaatacaacaattggccgggcactgtggctcatgcctgtaatcccagcactttgggaggccaaggcaggtggatcacgaggtcaagagatcgagactatcctggctaacacggtgaaaccccgtttctactaaaaaaatacaaaaaaattcgccaggtgtggtggcgggcacctgtagtcccagctactggggaggctgaggcaggagagaggcagagcttgcagtgagccgagatcacgccgctgcactctggcctgggtgacagagcgagactccatctcaaaaaaaaaaaaaaacaattagctgggtgtggtggcgggtgcctgtaatcccagctactcgggaggctgaagcaaaagaatcacttgaacccaggaggcggaggttgcagtgagctgagatcatgctgctgcactccagcctgggcaacagagcgcgactctgtctcaagaaaaaaaagagagaaaaaaatccacgtggttattacttttgatagtctaattgtcccaaatttggttggtggtagccctttcagactggttcttgtgtccttttgacttgcctccattagttattgagtactttcttctttatgataccacaagatgttccaggctaaccttgtatttccttttcctggcttgggaccagccatatatatttttaaaattctgtgttcatactgatacctccgctttgaatccaacaccacaaggctctttcttacctttccgcggtctgaattgtatctcctacagtgagaaaccaccttccccaaataatcagcacactgattcatttgccctctcctgtagtatacgggcaaagctttagagtcgtcacagcagtaccagcagtaagagtaaacttgctaaaattcatgacttgtttgcagtttctttttctttttttgagacagggtcttgctctgccgcccgggctggagtgcagtggcgcaatcacacttcattgcagcctcgacttcctgagctcaagtgatcctcccacctcagcctcatgagaagctgggactacaggcgcacatcaccatgtcccgctaatgtttttttttgttttgtttttgtttttttgagacggagtcttgctctgtcgccgggctggagggcagtggcacgatctcggctcactgcaacctctgcctcccaggttcaatcaattctcctgcttcaacctcccgagtagctggaactacaggcacatgccaccacgcccaggtaatttttgtatttttagtagagaacagggtttcaccatattggccaggatggtcttgatctcttgacctggtgatctacccgcctcggcttcccaaagtgctgggattacaggcgtgagctaccatgcctggccatgtttgtattttttgtagagacgggggtcttgctgtgttacccaggctggtctcgaactcctgggcccaagcgatccatctgccttggtgtctcaaagtgctggaattccagtcatgaaccactgcacccggcctgtttgcagttatttttgcccttgaggtttatctttctaggagaacataggagaacccagaattactgtgatcaaaagttacttgggctcttttttttttcttgtctgtgagattgttatcaatttaaagtatagttagcttgatttgtttttgtttcagttttagagtttgcttttctttttggtttaagtttttgaaatatggaagtcattttatgtgtacaagtatattaaaaaaacttattaataagtatataaagaatggaagtctctctactcatcgtagcccttccgttatgtaggtgactatttcattactttctggttgattcttcctgtgtttcttttgcaaaaataagcaaattcatatgtgcattcttacttcccctttcttacataaggggtagcatatgatttacactttttgtgctctgcttttttttttttacttaatatatcctggaaagcattccacagcagtttactgagctcatctttattcttttttttttttttttgagacatggtttcactctgtcacccaggctggagtgcagcagcgaaatcttggctcactgcaacctccgcctcctgggttcaagcgattctcccacctcagcctcctgagtagttgggattacaggcttatgccatcatgcctggctaatttttgtatttttttggtagagatggggtttcaccatgttggccaggctggtctcaaactcctgacctcaagtgatcctcctgccttcgcctctgaaagtgctgggattacaggtgtgagtcaccatggctggcatcttttttacatctgtgtaatactctattgtatgatgcacctcgtatattcaaatagtcacatttaggttgctttaagcattttgctaatgcaaatagtgtcatgtcgaataacgtgtgtgtttgtcatttcttatatctgggtaaatgactaacaggagcaggattattaggttaaaaggaaaatatattcttattatcttctcttccttttttttaatatgaaaagtataacatacagactgttgtacatcttgctttttttaactactcatctttttggagacttttgcatatcagtacccagagaactgcttcctctttttaaaatttttaacagctgcaaagcatttttaaaaatagctgcggaacagtccattgtatgactaccattggtttaatcagtcccctattgatggtttctaatcctttgttattcaaaacagtgccgcaattaatgcacctgtgtatgggtatcatttcctgattgtctctatcatacccttctcttctctttttgtggtagatgttactgggtttttgtatctgtatttgatcccatatcacaaaagagtccgaagattgtaattgcccgatcttttaatcaggtccagaagaatttgactggaatgctagaagtttgtgtgtgtgtgtgtgtgtgtgtgtgtgtgtgtgtgtgtgtgctttttttcctttgagacagtcttgctctgttgcccaggctggagtgcagtggtgcaatcatggctcactgcagcctctacctcctggactcaagcaatcctcccacttcagcctcctgaggaactgggactacaggcacgcaccatcgtgcctgcctaattttttattttttgtagagatggagtctcactgtgttggccagactggtcttgaactactgggctcaagtgatcctcctgcctcggactcccaaaatgctgggattacaggtgtgagccactatgcccagcctgaagtttttattttaaagcaaacttctcatggaagtctaacacacaggagattgcacaagttgtaactgtatgcttggagaatgttcacaaaatccatacctttgtgtatccagaaccccgaccaagaacagatgccgggcccccagtcgctgccccatcaagggtaatactatcttgacttctaacaccatagatttagtttttcctgttccaaaactttaagcaaatttctgcccagcttttaaatgttgcattgccttagcacttggttgtggaccattttctgctgttgactatataaatgtccaccaaagtcactgttctaacaaggtgattgctgcttggtttccttggccttaacttgccagtgattacttagcatgggtcagccaggcctcctgctgaactcccaggagcagagcatgtttgtaccctccagattcctataagacgccctgtccaggtgtcccccagcgtctctaccctgtatgtccctagcacagctgctcgtcctcccctggaacctccgcctcatctcacacaggcttgtcatgatgggtctccaccatccactcggggttaagtgggcagggagtcttccaattgctccctttcccctactccttaaaaccaagaccccttcaaacttgtctcctaagggtctcaggaagcacatcctgcccaccttgcctttccagcctcatctgctgccccctcatttgcactctgctttggccatagtggctttctttcccttatgatgggtggctcatgcctataatcccagtgctttgggagtccaaagcgggaagattgcttgaggccaggaatttgagaccagctgtgcaacacagcaagacctcctctctacaaaatattaaaaaattagcatggtagtctgtccctgtagtctagctactcaagaggctgaggcaggaggatggcttgagcccaggagtgccactttactccagcctgggtgacagagtgagaccctgtctaagaaaaaaaaaaatgtgaagctccttcctagtaaggaactgtccctgtacgatgctttcccatctgcctagaaggctgttttgcccggggaactcctcttcatgcttcaggtttttactaccacttgtatttaatttccctgaggctgggtgcagtggctcatgcctgtaatcctaccactttgggaggctgaagcaggtggattgcttgagcctaggaattcaaattagcctgggcgatatggcgaaacttaatctctacaaaaaaatataaaaattagctgggcctggtggtgcatgcctgtagttccagctactcaggaggctgcgcttggaggatcacctgagcctggggaggctgaggctgccgtgagctgggattataccactgcactccagcctgggcaacagagagagaccctgtctcaaaaaaagttttttaattaaaaaaatttaatttccctgcctctccagaccagattagatcaccaggacatgatgtgtatgttttcacggtggctgtgcttgccttttgtatgatttactgcagaggtgattgactgtttcatggggagagcagggaccacatctgtctcactcattcttccagcaccatataagtgtcctaataaatgaacaaaggcaaaaggagcaaagggaggctagcctgtgaccaaggccgaggctcagtctgtaattcaaggtcaaggaatagaatgtcacttggctttccctgtatgggatcccctcccaggttcctttcctacccttggatggggttttcagagagtagattttgtgccttgaagcagagggcgggagcagctggtaagatgcagctggtggaagggtggctctgggaggaggggagctgcctccattgcattcacggcactgtgggagtatgtgctgggtcctgtcctggggagcttgcagcccagatgaggagtagagagggactgggttgggtgtggccctgatctcatccttctctggcttttctttccttgcagttcaggacaaagaggtgtgggcaggccactgggccagctggtaacatcatggcaggtaaggagaggggcaggctgtgtgggtaggacatgacagtgagcatagcgtggatggccctcttcctggttcccttatctcccctagtctttggaggccaggttctttccatcttactgtccccaagctttccccactctctccactgaggcctgtctgagaacttcaacatgacattgtctagccctctgtcagatctttggtcctatggaccaggaattgagcaccttgatgtccttgtcttactgtccatctgcctgattagctgcatgagtggctcagccctcctcccctctgtctctattgctttctaatactctgaggccttttttatctggttcagaaggctcagaggtgtagaatgccagagctggagggaactttagggaccgtgtagcccagcccccactccagcaaataaactgaggtctagagaggggcgatgatttgccccagagcacaaatgctgagtggaggctggaacccacgtctgtagattctcacacatccgcttcttctgcctggagctgcccccactgagagggtggtaccttgaggccctgagacagtgtcactcagaattaaaaaataataaatgctgtctgtcaaggtgacattgttttttattctgagtgacactgtctcagggcctttggctactttgggatcatcacagctgacccggggaggtagggacggctgggtggggaaagcagagtggccggtggccacaggggccaatggggcagcacagccaggggaaggatgggcgtcttggattgtcgggtggaagactggaggtgatgttgtgcaatgtgtctcatccacagagaaagtgaacaacttcccaccattgcccaaattcatcccgctgaagccatgtttctaccaagacttcgaggcagatattcctccccagcatgtcagcatgaccaagcgcctctactacctctggatgtgtgagtgccatgggatgggggtgggccagggtggctggaggaggcaggaagactgggcgtgctgggcagcggggtggggtgcccacaggcctgactgtccttcagtcccacttgtggcatatgcatggaccataagtcttcccctgccaggctcccagaggcttcttccatgggccacctccccgactgggcctcagtttccctcaacctcccccatctaggcctctcttcccttccttcccctccaccctcctttcacagagcatctggacaggggtccctctctgcagtgtaatccctgtcttcttgcttcccctttcccttccactggagtaactttccagggaacctctggggactgtcaggacctcaggattctggatttggagaggaatccttccctcaaagccttatttgtcttgctttctctggaagattgctcaaagagaggaggattcagctgggagttgggagctgtgggatcaagtttgcctggtcactgtgcttgccaagcagcaggttcctcatttgtaggaagaaagtattggcttggcgattgctgtggttccatgcagctctgtgttgggtggtctatacctgtaagagtctaatgtcaggcacagtggttcacacctgtgatcccggcactttgggaggctgagccaggaggatcacttgaggtaaggagtttaagaccagcctaggcaacacagcaagacccctgtctctacagaaaataaaaaaattaggcctgtgtggtggctcacacttgtagtcccagctattcaggaggccaaggcaggaggatccaatgagcctaggagtttgagaccagtatgggcaacatagcaataccccatctctttaaaaaaactagctgggaatagtggcacatgcctgtagtcctagctactcaggggactaaggtgggaggatcacttgagcccaggagttcaaggctgcagtgagctatgatcatgctactgcactccaccctgggtgacagagtaagagcctgcctctaaaaaaataattaaataatctagaattctttatttagaaaaccttagcatcaatgttctaaggttttaaggctgagagtgtaaaggcctcatttctggtgatctgtagcagggggtgggaaaggtgtcttcttggggggatgggacttggctgtgctgaggctagttagaaggtacctcttaggcatgtgagggggaggcaagctggctatcctgtgctgggtgtgagccccaggatcccaagatacccgcaatgtaactgcagttgggttctgctatatgtgacactgccctgagtgaggcctgcacttagctgcctacctgggcagatgcttgcatgtgccgacaaggtggtaaaatatactgtctttgcagcaggtccctcatggcatggtaggaagaggatggggcagacagactcagtttcaaggcctggcttggcctttgagtgaagaagggatctcccaccatgtaacctgagagaaggggggatgggacaggtgtgggtaagtctgtagatgttgggaagcaaatgaagaagttacctctgatggcttccattttttccatcaaatatgatgtagtgtggagagtgggctcacaacgaggccatgtttgtcgacggatagtgaggacactctccaaagaaacccggcccctaagatttctgggccacacacaaggttcatttgacattggctgatgtgaatttacagtcttcctcatggggtccccttttttcttagcaacattcagctcaggtacagatgagaattatgttcatctagggtgagtgtggccagaaggcagggcaggggagggaataagaaaatgagtaatgaattatggaatctaagctggataaggagaagagtgaagacagaaagaagctgatggctagagagagagaggggctgagctcatgggtatccattccagagaggaagcagaataattgcagcagaggtgtttgagcaagggagctggggcaggttggactggggagagatgtgaaccaatataataggttagtgtcttttctatataaagagcaaataaaatcagttttaacaccaagcctccaggagattttggggcaatgaacagggatagaggaaatacagctgaaatgtacaggaagaaatgcccacccatgaggggccctgagatgggtgacacggtggtcaggccaggcttgtaggtcactgtgtctgacctgggctctgggaactcaacttctgggaacatctcatccagaagctggatttaagggctataaatatctccttaagtcctcactaggcacccgcaggtgctttactcccaaggaaatgtatataacccttgaggtgcttaagggttctattcagaagacaggaccacagatgcctggctgtttgaggccacggttgagccctccttcctttgtttattcagcaggtctttgtggacttagctttgttttcaaggaagggagtgccctgatgttagataatgatgtgctgcacagacccgcatgtgtgttagtaccagcatcacttttatctgtaaatctttgaggtccctgctggccgtgactcagtgacactgtgcctcctagttcagctagatgaggtggggacagaggggggggggcctgggtcctgttcttggggaacttttagtctggttgatgggctgggatttatatctggggaaccttgagagcagcccaggtctgtagaaggtcagagggatgggagatgatgaggttgcagtagcaaaggaagacttcttcaaggagctggcatgagtgttatctaagaaatagattagatagctgggcactgtgactcacacctataatccggcactgtgggaggccaaggcgggtggatcacctgaggtcaggagttcgagaccagcctggccaacttggcgaaaaaccatctctgctaaaaatacaaaaattagctgggcgtgatggcaggcacctgtaatcccagctactcaggaggctgaagcaggagaatcgcttgaacctgagaagtggaggttgcagtgagctgagatcgcgccactgcactccagcctgggcgacagagtgaaattccatctcaaaaaaaaaaaaaaaaaaaaagaaatagattagataaagactgagattccagccgccaatgcctgccccatttaagtgcaaggtagatggcacaatggctagaagagatgtttccacaaggccttttatttttccctttccatgcccatatctcgaaagagaaagtgtaaggtcggtttcccatgtcttgggcttggtgattgctgtgagtctgggagggtcaggggctgaagccattcttgacaaggacaagagcatttctaccaccctgaggctttggggcccttcaaaggggcttgctgggcagaagctctgggttctggaggctgtgctctccagatttctcaggagtgggtgctggggttgaggggtgggggttggttcgagctcccagcttgcgttcttacagtctttactcctctgcgtgtgtatgtgtgtctcctgtgtctctgtatgtatttgttggtacgggttgtgggtcttttgtgtgggtgtgaatctgtgaatgtgtctgcatctctctgtgcttgtctgcgctgttggcctggcttgattgtgggtctctgttgcgttactggtgtgtgtgtgcccatgtccgggtgctcatgtgtctctctatgggcctgggtgtctgtctctatgtgtgcatgtgctcctgggcctgcagtgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagtaagtggttggtgctatccgcagtgcctagccgtctctgcccatctcccctgtctcttctccatatcttttctcacttctttttttttttttttaccctcccccaaactcactttcccttgctcacctttggctcagattgctaggtagggcctgggctttctgggggtgccaagttgaggtgagagggctgagagttagtttctttcctcctcactctacccttgggtgggggaaatatagacagaccaggcctattttttcttctgtcatccccttcctcaggcagctgcatgttaaattttgcctgtggggctgcctgtcttggtggagctgcccatcctagtacctgtggggctagccgacttggtgccaaggacaccatctatccatgtgccaatgggaccagccagccatgtaccattgacactgttcatgtgcaatgaggtcatccaactgtgtgccaaagggaacacccatccacatatcagtggggcttgctgtcttggtgccagtgggtgtctacctagtgccaaatggcattttcaatctttgtgccaatgtgactattcatcaatgtaccaaggctatctgtcttggtgccagtagaatatccatctcaatgctaatggggccttaaatctctttgtgccaatcaggccatccatctaagtgccaattagctactgttttggtgccaatagggtgtccattctagttccaatgagactttctatctctgagcctatgagaccatccatccatgtaccagtggagctagctgtcttggtgtcattgtccatccccttgacaatgagactatttattcctgcctcagtggagccatctatttctatgccaatgaggccgtccatccatgtaccagtgggtggtctgttcatgggaaatccctccctgtgtaatgttgcaacacacaggtctaccacgtggaaacttgcaaagatgtatgggtagaactaaccccttctgacctctcaattaaggcctttaaatgtcttctgtccattatgcacttaaacttggaagggcttgggggccttgaaggcagggaagccctggccctctgcccaggtgacgggagccacctcctctgccgcaggactgacagctccttcagtttcatggcattcttctttaccttcatggctcagttggtcatcagcatcatccaggccgtgggcatcccaggctggggcgtctggtaagaggcaggggtgtggcctggggctggcaggggtggcgttgtgggtgtatcttttgcttacctttgtgtgctaagctgtctagcctatggggcctgagtgatgggttgttgggagagtgagaggattcgggatagtgtagtagtacaaccatagcatcagagggaaggagaacctggcagtggtttcttgggggctgaggggtgtcagggattataggaaaacctgggggaagaaagtgttgtatctgaagagcacctctgagccacagggatggggtcttcttgagccactggcacaggttctttgggtatcagtaagatggtccctctgcatccagtgatatgtttcctccctgtggcaatgagacggtcccttcctctagcggggggctcctgggcacctcttatcctgcccgcagccccacactggcctcttcctgcagcggctggattgctaccatctccttcttcggaacgaacattggctcggcggtggtgatgctaattcccactgtcatgttcacagtgatggccgtcttttccttcatcgccctcagcatggtacgtggtcccctcaagggtgagaaggtggctttgggaaggggccatgttctgaaacaagccctcctccaagttgcaagaggatcccgaggtcttccaagggactcactctggaatggcctgcaggactctcctacagaggcattcatggggagggagcactgttttttttttacagatgggtcccatctatttcctggatgggctgccttttctctttgattaacccttctttacgctctttttcctacaggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgt

SEQ ID NO: 774 - DNA, 5735 bp, Homo sapiens
tctccaaggaaagtttgccccgagcccttcccggcccggcgtagggttctccggaaaccatcactcacatctagcacttggaggcctccagggacagcggtgacccaccatctgggtaggaggctgaaaacactagaggaggaatatcccaaatctgtgccttggcgggtgttacccagaaagggtgacgggtttcaccatgcaaaaaggaaaaattggaggaaggccaggttaagcaaaaatagacatgtttttagattgcagagctgagaggcttggctgtgcctatgtgcgctgcaagtctccaagaacaacatgtgtagagttttacgaacaaagatagagtcagagacatgggcaggaggcagagacagagagagagagacagacagacacagagagagatagaggcagagaaagcaacagaggcaaagagattggaacacagagaaagagatggggacagagacacagagaaaggaacagagatgggaagacagggacagagacagagaatgaacagagatagagagatagggacggagagagacagagagagggacagggatggagagaaagagatagggccagggccacagagggactgagacaggcccaggaggagactagggatggggccagggctgcgtgcgggcggggcacggtgcagacaaaggcgcggccgcgcggtcggggtggcctggccggggacaaaggcctgcccggggggcgggggcagcgatggcgacggccgcggcgggcgcgggcgaactacaagtcccagcagctcccgctgcggccctcggccggcccctctcgctccccgggagcgcctggcggggccgctgggccgagggggccgccggcggggctggcgggcggggggcttcctgcgggcccggggggagccggcggccggcgcgggcgcggcgggccgggcaggggcgaggggcgccgggtgagtgtccctgcgagcgggctggggccggggcggggggctgggtggggggcgggcgggcgggggagctccaggcgcggggcgcagcccggggcgacctctaatcgtcccccgccctgcgcgccgccggccctggcccaggcgagcgggggtcgcgggagcgatggggaggggactctgcggccagctccggcctagcgcacccatcccgccgctggggcccggggggaaagggccaggaggttgggagccttcaatcgggcggggtggggggcgcccgccagctctggggtctggagctcaggacgccccctccctaggaggcgatccaggaccccctcccctcctgattcgaggtattgttcccacctcccgcctggggtctggagttcaggaggccctgtcctcaaaagggggacctaggggttccctcttcccccaggaccctaggaagggtcccagcgattgttcccttgcccctccagtcttggggtctgcagttctggaagctcctttccctggaggtgatccaggggtccacctgccctcacccctgggaactcaggaaagacttaagtgatttctcctcccaccttccagttaagagatgggaattcagggggctccttcccctggaggcaatctaagggttcctctgcccctgatgcaggaggggtcccaggtcttgtttcccccactctccaactatggggtctgggttgaggaccgccgtccaggaactcggctctgtttgcctgcacactcccagctatggggttgtggctcagtgtattcctttccccagaaggggagccacaggtccccccacagcttctcccaggagcagatcattcattgttgacacctcaacacccagccatggggtggggagctcaaggcatcctcccggcaggtcatcctgggctcccattgctccccagaagtggttccagcttttgtccctctacctcccagtctgcccctagccacaagctggcaattcagttcaggatccttcctgcaggaagggctacaagtgtgctgacactacccgccatgtcccagccatgggaggagatgactcaggcgttcccccattaacttcagagggtccccaggtattatttttgcctatcctccagctagaagttaaaatgcaggaccttctagccaatagggaaaacaggtatactggccgggcatggtggctcatgcctgtaatcaccatactttgggaggctgaggtgggaggatcatttgagcccaggagtttgagtccagcctgggcaacataccaagaccccatctcaaacataaataaataaataaaacaggtatactaacaactgtccccaccatcctgcctatggggttcatgagtctccctacccatccctcctcaccaggaggggtcccaaatatcactctaccatgctcactatctggctgtaggaaagggcatttccgatctgtctaagagagaggatttgacactgactcccacctggagctgtgagctctggaattcaggttttcttttccccagagggcaagccagagtcttcttgtctttccccagtgacttgggagggatacctgatgttatttgttccatattcttatcccccagacatgggttctagagctcagaatgctgctgctggaggggggcctccctaccagaactcgccccctaaattaatctgccgcctccaagtatgggacaagaattcaggccatgtgctcaggagcacagaaacgctgacacccacactgttccccatgtggggacgcccagcaagggggtaggaagctaggactgtctcctccacaggaccccagcttcccacaagaggagcccaggttggagagaggtgcagagccatggagttggggactagaaacctctagtgctgggtctcatgacctccgtccaggtttggggctgagaggggagggtcctaccatgtcccacctggttccctcaactccctgccctggctggggtaagtcagaaatctccttgcagtcagagacaagggaaggatccacgtgtatgctcagaagtgagtggggtttggccaggcacagtggctcatgcctgtaatcccagcactttctgaggccaaggccagaggtttgcttgagtccaggagtttgataccagcctgggcaacatagcgacaccccatctcaaaaaagagagacagagggagagagaaaggaaagaaggaaggaaagaaggaagaagagagagaaggaaggaaaagaaggaaggaaggaaagaaagaaagaaagagagagagagagaaagaaagaaagaaagaaagaaagaaagaaagaaagaaagaattgaagttagctgagtgtggtggtgcatctgtaattccagctacttgagaggccgaggtgggaggatcgcttgagcccgggagttccagtctgcagtgagctatgtatgatcacatcactgcactctagcctgggtgacagagtgagaccccatctcaaaaaaataaaaataaagaagtggggctgggcgcggtggctcacgcctgtaatcccagcactttgggaggctgaggcatgcagatcacctgaggtcaggagtttgagaccagcctgtctaacatgctgaaatcccatctctactaaaaatacaaaaattagccaggcatggtggtggacacctgtaatcccagctactcaggaggctgaggcaggagagttgtttgaacctgggaggcggaggttgcagtgagccgagatggtacctttgcactccagccttggcaacagaacgagaccccatctcaaaaaaaaaaaaaaaaaaaaaaagaagtgggttctgggggcacaatcgggtcccgtctctcatccctaaccagactccaaaagacacccccgctcccacagaacccacctaccctctaccctctatccttgcccttgcaggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccggg

SEQ ID NO: 775 - DNA, 24806 bp, Homo sapiens
aagaacggtttcttcataagagggccttcagcgacagccaagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaataggggtaagttctgtgaaaagggatttaggtttaaaagaaagggcacaccctttatcatcacttactaccagatcgtgctaaaatgttcactctgtgtatcaaaaagaatggttaggtgtgtaattcagttcagatggtcgattgctgatatttaaaaagtgacattcttgttttttttcccccaaggatttttgatcattgagagaaagttgcaggattttccaacttcagcactattgacattttggattagataatttttgttaggggaagacgaaatgctgttctgtgaattgtgggatgtttagcgggatgtctgtcttttacccactagatgctggtagcatctctcagttgtgacaattaaaaatgtctccggatattgccagcttactgtatttggaacaggtagtacgttgggagggacaaaaactctacccctccacccttgttttagagtaaggttgtagagggacaagggagaccagtgcattttctacatgaatctgtagatgaagaagtatgacagaacattagaaataggcttcaaatgatgactgcatattcactaatttgggaaacagatttgctgcttggccatgtcatacttttgggacagtaaatttttttttgtatgagtaaattgagaagccagagtggaataattgagaagttgttgatgttttggtggttgaaataaagggattttgaatgagattttaatagctctgccacataatcaggaattccattgtgaaaaataagctgaatgtaaagcattttattttaaatttatgtgcctaatttatatggtacttcctagtacttggagacaagctaataaaattaatatacgttgcttttaatagtttatggtttcttaaaaaaagtgcttggagaagaaaaccactaacaaaagtaatatgtgtgcctcttaatcgctgataaactttggagaagttatttttgttggtagcaaattaatggcaatacatgtacttacatttaaaaagctacagtgatttttttctgattgtaaaactggctttccaagatctcaaatgtagctgattttgtaagtatatggaagagtttgtatatggactttttttcaccccttttcttttcttttccttttttttttttttttttgagatggagtctccctctgtcgcccaggctggagtgcagtggcgcgatcttggctcactgcaagctctgcctcccgggttcacgccattctcctgcctcagcttcccgagtagctgggactacaggcgcccgccaccacacctggctaattttttgtattttttagtagagacgggatttcaccgtgttagccaggatggtctcgatctcctgccctcgtgatccgcccgcctcggcctcccaaagtggtgggatggcaggcgtgagccactgcactcggccttttcaccgcttaacaagaaaaactgttgcctgttttcagagtcagatagacctgagtttgagtgctgttccacccctactacatctgtaaacttgggctgcttgtttgatttccctaagcttcagttttatatatataaagtgggaacgtatttctccttggattatttagggatttttaaaaagtgaagctctttatgtaggcctagcacagtgcgggtaacatgccacttcttcatctaatgatagttgtcatatcattggtctgcctcctaattggtaatcatgccatataaattcagctagaaacacttataagaatattctaatgaagaaatatagaagatcattgtgttaggagatctaatgggatagtttgtttgaaaacaatttctttagccgactggtgtttgttagctaactgtagttttaagttttaaaaacattttatgagattaaattatagtggttacttgtgaggccagttattctaaataataagacttaaggaaaaaaacacgctgaattctagttatatatagcagaagtagacttaccagcttaagtatctggtttatttttacatttggtttggctgcacagtatcaagaaaattctgatttacccaataaaggggttgcccatactaacattttttaaaatagttcagcttaaaatgatgatcataatattaacaaatattttttgaatgcttactgtgtgtcagacactgatacaagtgttttgtatgttttaatttatttaattcttcctacacctctatgacttaggatctgtgtgaggataccgaggaacagaatgttaatttgatccaggtcactcagctgttaagcaagagttaagatgtaaagcctggcatttttgtgtgtgcgatggctcacgcctgtaatcccagcattttgggaggccgaggcgggtggataacgaggtcaggagatcgagaccatcctagctaacacggtgaaacccccccccccccgccccacgtctctactaaaaatacaaaaaaattagccaggtgtggtggcgggcgcctgtagtcccagctactcgggaagctgaggcaggagaatgggtgaacccgggaggcggagcttgcagtgagccgagattgcgccactgcactccagcctgggccacaaagtgagactccctctcaaaaaaaatacacctgtcatttttgccttcaggagcctactctcttaagcacttactatactatactgtcttttcagcttacaatatttgtaaattaattggagccaggtgcttgaaagggaattagtaaaattttgttactgtgttgcgtcattgacaatgctgagtggtttttattgtaaatataaagttaaatataatgctcataaaacataaatacttcttggttgataacttgtgacatcaaaaaaagtacttcagcattcacagagcagatgcatgtaaactaaattaacatgtgagattatgcatacccacttaagtttgaataaccagacatttacaggcttgaatttacctttcagtgctgtggaaagcgacacatttttaagaggttcgaatgcatgcacaaagatagtggcagattctttattcttcagtgtgcaaaaacattcaagttaaccaacacacagctttactcttgggatcttcagtgtattaaaatttgaatgtgaggttttaaaaatgggtttccagctagttaaatgaagtttgacttaaatatttgcacactcctgccttgcttactgcagggcatggtttgaaaagcactcttctatagaaggtggaaaatgtattaggtataaaaataacttcttctgatgtaattttaggaagactcaatgaatgacaggaattagtgttttgcttttcaattgacttagtcttttgtgtaagtatttataaggtgaccaaaagaaagtatctagtaagtatttataaggtcattaaagcaacctatagtattttggggtaaatgttagtgttttggaccaaattctgttttaagaatttactgactaaccactaaccaaattgactttatgatcagattggaaacttgagtttactagattatttgaggggaatgacattatcttggccatctttgtactcccagcactcagcatactgtctaatatagtaattatttgttatcaaatgcacttgaaatgattatttttgtcttgatagatagtttatcatttatttctgatttttttttaatttcctgagttctttaatttgcctaaagtttaagaaaactgatattatgcctaatatttgtgttagagtaactgaatttgtcattttagggtaaaatatttggagtaccttttaatgcactgccccattctgctgtaccagaatatggacacattccaaggtaagcagagtttgaaatgaagaaggccgggtgcagtggcatatgcctgtaaccccagcattttgagaggccgaggtgggcaaatcacttgagtccaggagcttaagaccagcctgggcaacatggtgagaccttgtcgcaaaagatagaaaaattagcttggcggagcacacttgtagtcccagctactcaggggcctggggtgggaggattgcttgagcccaggaggtggaggctgcagtgagccttctagccagggaaatgaagaagaagagagtaagcatttcaaactggttttagagagtttaaaagaaatagttgattaaaacataattgtttcaaaccagcaaatgatttaatctctcataatgttaaaaatatttttttaacttttacatattttaaatttataatttgtactcattcccaggattgaattttaaagtccagtaatgagtaaatgttagaaatcacaaaaaatttttgttctgttaagtcagttttcagttctatgtgaattcttttgccacaactcagattaagtaatatactgacttaccaattcagtaataattttgacttttttttgtttgttaaaaaaatattggccaggcacagtagctcatgcctataatcccagcattttgagggccgaggcaggaggatcgcttgagcccaggattttgagaccagtctgggcaacaaagcaagactccatgtataaaaaaaattttaaagaaaaatcagctgggcaaggtggtgtgcacctgtagtcccagctacctctgaagctgaggcagaggattgtttgaccctaggagtttgaggctgcagtgagctatgctcattgccactgcactccagcattggcaacagagtgagaccatgtctcttgaaaacaaatattggataaaagaatatttaagctaagatattagagtgtttgtgaaaatgtatcacttagcttttctatgccacttactatttataaataaccttttattctttttttttttttttttttttttgagacaagagtttcactcttgtcgcccaggctggagtgcaatggcgtgagctcggctcaccgcaaccttcacctcctgggttcaagtgattctcctgcctcagcctccggagtagctgggattacaggtgtccaccaccacacttagctaatttttgtattttagtagagatggggtttcaccatgttggccaggctggtctcaaactcctgacctcaggtgatctacctgcttcagcctcccaaagtgctaggattacaggcgtgagccactgtgctggcctattctaactgcatcagaacttactaggaaagtttatgttttaagaatataatttagccgggcgccggggctcacgcctgtaatcccagcactttgggaggccgaggcgggcagattacgaggtcaggagatccagaccttcctggctaacacagtgaaaccccgtctctactaaaaatacaaaacattagctgagtgtggtagcacgcacctgtagttccagctactcgggaggctgaggcaggggaatggcatgccaggaggcggagcttgcagtgagccaaaattgtaccactgcactccagcctgggcgacagagtgagactccgtctcaaaaaaaaaaaaaaaaaagaaaaaaaaagaatgtaatctaaaaatgcatatggtgaaacttatccttaattcatttcccctccatctaaagtagggttcatttgggctactatagaccaataatctaggttttaattgacatgtcatccaaaagcaattatcgaacacctggttgccttaggacagtttccccccattcatcctataggtgtagattcactgtcttcttaggtaaccgcttaaccattttgctctttaaatgacctatgaaaggcttgattttcttataatgaacacctataatgattttcaacaggccgggcacaggagctcatgcctgttatgccagcacttagggaggcccaggtggtggattgcttgagcccaggagttcaagacaagcctgggcaacatggtgaaatcttgtctctacaaaaaatagaaaaattagctgggcgtagtgatgtgtgcctatagtcccagctagtcgggaggctgaggtgggaggatcacttgcgcccaggaggcaaaggttgcagtgagcagtgatcgcaccactccagcctgggtgacagagcgagaccctgtctcaaaataaaaactaaaagaaaaaaaaaagcagattttcggcgtctggaattgcaaagtcatattcccaggaatcatgactatatcttcattgtaatttcatgacctactttttatttaattaaaaagactgttttgtcagttaccttctgtaaataaggctgacattcagccactgtgcaccaatacagctgtatcaattgttggtagccgatattcattctaatttgtgggtcccagctgttcaatatctaggtatctaaagccaacattgagatttatttgaacattgttcaaaataaagaaattgagcacattccccttaatatgaaaaggcttgtaaggactgggatatatcctacttttctgagggataatgttggggtgaggaaaaaaaaacctcgccctgtttttgggtgatgtaggagatgagaaaatcacccatgaagagatagtagataaaagaaggtggccttggacagagccctgggttgttccagcatgtagaggtttcacataagaggagtgagaaaaggaatttgagaaggagcaggcagggagatagcaggaaaactaaaagagtagtgaaaaagtatttttgagatgaacagggaagggatcaggtgtgtcaaatggtgatagatcgagcaatacgaggacaacacactgaccatggatttggcaaggcagaggctgttagtgagcttgaagagagctatttctttggagtaatgaggtatgagaatgattggataggggtgagtagagactgagatatgaagaagtagaggcagaaaaaaaagacaagtcttacgctctgaagggaagcagaaatgaagtaggattgagaaagataaaatttagtgtgcacattggagttgttagaagtaaaaagatgggccttggagaagaatttgggaagccagtagacaactaaaagtaacatttcatctcaaagactacagagatttgtggctttagagcctctgaaaggtacgtagtgcttggcctgctcatgtatgttagcagaggaataggatgtgatatgtatgtctagccacctgaaaaaatctctctttcagctttcttgtcgatgcttgcacatctttagaagaccatattcataccgaagggctttttcggaaatcaggatctgtgattcgcctaaaagcactaaaggtgagcatattgttgaactattaatttttcatttgagccattttctgatttggtttttaaaactgaaatatttagaactattaatatgaatagttgacagaaattgaatttgcatttttttcatggcagaagattttttttttccaaaagaaatggtatattatttctatcatgctttaaaaatttaatagggtacttttaaattcatggtccttatttctatcaagtattatgtaaaatgaaaaaaatgtgttaagttatattgttgttagccttctagaaggagtgatagagctgagtgtggtggcacatgcttgtagtcccagctacttgggaggctaaggcaggaagattgcttgagcctgggagtttgaagccagcccaggccacatagtctgtgccacatttctataaaaataaaaataaattcaaaaatcattaaaaataaagtagtgacatatattaaaataagagttaagagaaatttattaaagaaaagtgtaattagagtataacaaaagatactttatttgcaataaactcttaagttgccaaaatactcaagattattatatttatttcagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttaggtaagtggtaattaaaactcttggcaaataatagttgaatttttcaactaacgttttatgcttgtagatatgtacaatttcatttggaatggaaatttttctttaaaaattccatatttcattactatgaggagtatactccaatttaagaaacagcataccaaatgatttaatatttccttatcttaaagtcatcatcatgaatgccttaatggttcattggtgtttataagattcattgtccactgaaagcctttgtttactgggtttttaaaatatttctgttttgcttttcaaaatttccctctccctgctgtcagtgagcctgcttattctagacatacttgctgccttctgatacttccaactttttatgtgtaggtctgaaaatcagataaagatgttcaatttgtgtggaaaagcaaagtatgaactctaagattagcatggtttttagaatacatatttaaatatagagaggctatatatttctggttctttcttgtgttcaagccaatcatgtagatgaagggtaactattttgacttgtgtatgactgataataaggtcttcaaaatgtactacatacgttattttaactcttctgtattttcacgtttggctccatctaataaagcgtttattcacttaagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaagaaaaaaagaaaagaaattggtatattagtatctaaacatttttggggaagagtggaggaaggataataattgtcttacttgtgaacattttcatttagggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggaggtaagtggcggtcccattttatggaggtacagtgatttgctttaatcgaaagtacatttcacataaagaagcatgaactgtggtatgtgcctttttggtgcttaaagcacagctggaaagataggacgtatgcgtgtaaaaagttaaagcgatagtacaatctaatgttaagtgctacatctttagcacaaacataaaatgtgttaaaaggagaaaagttccctggattgtaattatcagggacttgtcaaagaggagccaaactgaaccttcttgaataatggatagaatttagtgggattgggtggaggatcagaatacttgtatcctattctagatgagaaggatgctatgaagaaaggtttgtgtagggaagaagtaacctatgtctaatgtagatagtgcagtatgacttgagtgaagtgttcagcataaggataaaggatggtattatggtaaacttaatgccaggctaaagaattagaatattaacctgggtgttggtgaatcattgaagatttatgatgtgaggcatgatatgatttaaaaattttagaaaattacctgatttgaagaattgagacttggaagtagggagaatggtcagcaatgtgtgtcagtagtccaggcatcagattattgtttgaacttgttagtgacatggattagttaggagtacgaactaaataatgaaggaaatattatcaaggaagaatcagaaagaccaaaagaccatcataagatggtagagttggtaataaaacttgcaatctccttgatcaagaagtcagaggccattattcttccaattactttaggaaatttattatcttttgaatatcagaaccaaatgttactaactatcccaatccctttttcatcttttggtttatttgttattgcatacttgtgtttcttctttacctcctttgtagataggataatactgatgacttatgtatgattttcctagggctactgtagcaaagtactacaaactaggtggcttaaatcaacagaaatttgtctcaccgttctggaggctagaagtctgaaatcaaggtgttggcagaatgcctgaaacctgcaggggagaatcctttcttgcctcttcctggctcctggtagtggctgtcagtccttagcattccttggcttgcagccgcgtcactccaatccctgcctatgtcatcctatgatgttgctctgtgtcagaacttccctcttacagggcacattggattagggcccacccaaatgacctcattttaactcgagtacatctgtaaagacacgaattccaagtatggtcaccttcataggaactgggggttaggacttaaacataggttttttggagaacacaatgcaacccataaaacttcctatccccaatggagatatttctcagatgcagatcatctttattgccctctttcccagtcctgtagtttcagttatcaccagtcctgtagtttcagttatcacatctaaatagataaccaccacatctgtaccaccgttatcttgaaaatgtcagttccactttactaatggcttgctagggagacctcatcacatctgcttttcattggtgctttaagcttaacgttttgaaatgaccatctttatcctctttatcctggttctgtgtgaattccattttcttctaacagcaccactattccctagatactcaggctttaaccatgggttctacctcttcctctaccatctataatcagacagttttcatgtcgtataagattctatctccgtagtgtttattgcattgttactgtaagaatcttcttggccgggcgcgatggctcacgcctgtaattccagcactttgggaggccaaggtgggcggatcatgaggtcaggagatcgagaccatcctagctaacacagtgaaaccccgtctctactaagaatataaaaaattagctgggcgtggtggcgggcgcctgtagtcccagctacttgggaggctgaggcaggagaatggtgtgaacctgggaggcggaggttgtagttggctgagatcgggccactgcactccagcctgggcaacatagcgagactccgtctcaaaaataaaaattaaaaaaagaatcttcttggtctttatgcctcctccttgaatctaccctacatattgctattaaggctcacttttttttttttttttgagacggagtctgtctttgtcacccaggctggggtgcagtgatgctaccttggttcactgcaatctccacctcctgggttcaagcgattctcttgcctcagtctcccaagtagctgggattacaggtgcacgctaccacgcctggctaatttttgtatatttagtagaaagggggtttcactgtgttggccaggctggtctctaactcctgacatcaagtaatctgcttgccttggcctcccaaaatgctaggattacaggtgtgagccactgcacctggccaaggcttacattttaaatgtataactctactcaagtatctcacacacatacccttcagaaattttaattggtaatagggatatttatagcttggcattaaaggtctttcataggattgctctagcatacctgtctactatttcctgtctttgagcaactttagtcaaactatgttatttattttccagacacttttattcatttgcttacactatttattgatataatgtttttacttccatctctactgatcttttaaatacttttattcgtgcctccatttccatggttcttgcctcagttcagaccttcatcttttgccttaacatgtaatgatttctttttccctacccttactgtacattatatgtatttgtattacatttctttctgtattgtgtcttttttattttagggatatggaagtataagtggggaatggaataaaaatatatcctttagtatttttcctattttgaaataattcctcttaaataacttaaaatttataagccgatgtaaagttacatgttgaaagaagactgcaaatattaatatgaattattggtgaaagacaagtaaatgtgaagttgtaattgcttatgccttgcatttcagattttgttagtggagcactaaataaatttaaacctaacagaacaccttctattacacctcaagaagaaagaattggtaggtatttattatatgcatttatttaaattaaaatttgtatagtattctataaaatacaattacaataataattacctaacttagtaatcaaatttagtttaatcaaatcaaatattatttttaatagtcatactgtactatacacactatgttgtgacattgctaattacataggctataatgaacccaaaattgtaggcaaaaatttttttagtctcctgtctttaatcttcttaatcatgcttttctgtttgtaatttagatgctattaagcgtgtgaaaatagttcaacctcatttttatcttaggactagaagttcattattgtatatttcaattttttattctaatttgcttgtggctgaaattattcagccagtaagagtcaacatgatcttctgttttctagagtgaagaaatgaactggttaatactcacttatgatgaaaagcaaaaataatatttagattagtttttgtttcaactccttgattgtaatttcttccttacattaatattctttaatgtatatcatatgcatcttttagtctgttagatttaagtaactgctgtctcttaagagtcttgcctctgcgacttccttattttcatttaagtaattgcagagtgttttagttaaacaacatctacttaactgatgatgtaaatatattctcattttttgtttagctctaagtaatagctttataagaagaaattatgtaaagcttttatatgttgtcaactctgcagtagaaacaagttggttttgttttgatattttttcagcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcaggtagcaaatagaatttatataaatggattgtaaagattaaaatgagtgcctattctgggcacagtgcaatttcatattaataataccacccttaggaactagaactttattctgttttatccaacctatgaatttttataaaaccccctgccttttaaaatagacactgtttcaatatagtgtgtgtgtgtgtgtgtgtgtgtgtgtgtgtgttatgacaacatctattgaaagttgtgataacccagagtagtagtttgggcttctggtgatagcattgatgcttaggttttatgtgattagacatcctgaatcctgctatagttacatctgggtctatagctgtggctttattgctgtcatttgttgaattgaggttgccagatgtttgatcatgtctgattcccaagtgggagcgttactattgcaggttatggtttgaaaatgagggtatttttaaagttttagactcaagtaccttttgtaaaagctttagaactttgttgacgctgttccttgtgccatggcttccagatcccttaccagcccagccattttcttccatattaactacaagttctaatgtggccaaccagagccttcagagagtaatagagtatgatcatgctaatccggagattagtctgggtcttagattcaattggctcttttagcatatacagaattcaagttggctcatattaaccttacgatcaaccaaaaatgaaatgaaactctaagcccagggtcctccatctcatttatcttacatttagtcaaaatgtgagtgatctctgattattttagattttttattttgttggtttcagacaatgttaagtttcatttttgattcattatctgagttatatgagttccttcccaaagcctgtctcttttttctgttgtccaaaagggttcttatttgttttattgagaagttgaacagaatagcaacttgaggttttccagaaaaaaacacttcttcacaggttctctagggctcattgaaatgtgatgatagtaactctgaagcttatgtctgtagcttttgcagtgttcacaggttggagacttaaacttttttaagtaacatagttcagttgtttttttttttgaatatatcctttgcagtttggaggactttttccaaatggcaaatgggagttgtagttctacctgcctttgcttattagcattacattttccccaaggaatgaacatactgattccttcttctcctcctccaagctcccaaaacagaggttaaacagtcttgtgctatttttagtttgagcttgcctaatcaatgaatttttttataaaaaaatttaaaagttcaacaatagtaatcgtattatttttacaccacttttctttgaccctactttctcagccacaattcaacaaattccatttgcaaaattgaaaatagattgatttctaagtttagattataacaaatatgatgcttttaaaaatatataaaggcaacattagtctgtagtccatagagtatctattcataattgtctcttttttttttttttgagacagagttttgctcttgttgcccaggctagagtgcaatggcacaatctcggctcactgcagccaccacctctcaggttcaagcgattttcctgcctcagcctcccaggtagctgggattataggtggccaccaccacacctggctaattttcttttgcatttttagtagagacggggtttcaccacgttggccaggctggtcttgaactcccgacattagctgatcaacctgccttggtcttccaaagtgctgggattacaggtgtgagccaccatgcctggccataattttcttacagatgtgataaatttgcattgttccatatattctgactgtgcctcctgcgaccattgacacattttttatttttattttttgagacggagtctcgctctgtctcccaggctggagtacagtggcatgatcttggctcactacaacatccacctccgatgttcaagtgattcttgtgcctcagcctcctgagtagttgggattacaggcatgcaccaccacacccagctaatttttgtatttttagtagagatgggatttcaccatgttggccaggctggtttgaactcctggcctcaagcaatccgcccacctcagcctcccaaaatactgggattacagacgtgagtcacggtgcctggccggacacatttttaaagtgactagactgcagccctagaataaagctacttatgtcactttagatgtataatattggcttccaaaattttctttagctaaatgcacccaaaagtttctaaggtggttgtattttttccgttttcataattgaaaaaatgtgaatgtctctgggaaactttgtgaattctttattaataactcagatgaattgagagggttcatgtttgttgaatgtgtcctgggcgtgattcaaacataaatgtatatggagcctttgttcataactattttacttctttcgtaattgtttactatagttgatttcataatataaatggtgttaaataattgagcttctgttgtaccagtaattatttgcatggaacacagcagcagccaagggattaggaatgtgttatagaataattagtttttgtttacttgccaaaaatattgaacaaattacattccggagtcaggtgggtagcagttggccagcaggtatatctcaaatactcagattccaacttgtttgccaatagcttattttttataataccattaattggtattatgtactagatactgactaaatattttatatagataacagtaatattcatcatagaagtccgttttcagagcctaaagccatttagtaagtgatggagcaaactcaagcctgtctccaaatcttgttctttttccagtctgcaatggtgcctatccctgccttgtattattaacagagtttaaagaaaagctctaatataaaagtaatgcttaagctgacctttaattggcaagtcaaaagtaaaaaatgaatgctttttcttagctgagttgggttatttgacacttgaagtttctaaccagaaattaagtgatttcggttgttgcttgggatagaaattaaggctttgaatctaattgctgctattactattttatactttaaaaggaaaatagatatgtgtggtatattacatgtggttatttttgtagttcacatcgatacaagctcagaagggtcatctcagagttcactctctcctgtactcattggtggaaaccatttgatcactgcaggtgtgccaaggcgaagtaaaagaattgcaggcaaaaaagtttgcaggtactttatccaggacattttgttttcatcggataaatatttggtgtacacataattaataaaatgttttgtctttctgtcaagcatcatatttgagtcataattttttaaaatcccttctgcctttatagtcttattaatcaattgccttttcaatacccaccagagaaaaattactaatttgagtccgctttgcttgcttaaaatcctattttatgttgatggtgtaattttaaaatttcctgttagaggctgggcacggtggcttatgcctgtaatcctagcacttagggaggctgaggtgggtggagcacttgagctcaggagttcaagaccagcctgggcaacatggcaaaacctcatctctactaaaaagtacaaaaattagccaggcatggtgccacatgcctgtagtcccagctacctgggaggctgaggtgagaggatcatctgagcccagggatgtcaaggctacagtgagcagtgattatgccattatactccagcctgggccgcagagtgagaccctgtctcaaaaaataaaaaacaaagaaaaaaattcctgttaggttaaaaagctagcctattctaacaattctgagttataactgactgactaacttttaagattagcagatcattttttatgcaaatgcagtgtgttcatgtatggtatcttaaagttgaactgtttttaaagaattattaatccatccaattattatcaatatgatttgctgtggactttatttcaaatttcgtatttcaagtatttctctggtgtttatactataaactgacatttttaattccacttcttctagagtggaatcaggaaaagcaggctgcttttctcctaaaatcagccataaagaaaaggttcgaagatctctgcgtttgaaattcaatctagggaaaaatggcagagaagtagtaagtttcttaccattttattgatctttatattagcataacgctataaacttgatactaaaaaacactcatagccctaccttccttccagtgactgtctcattctgttctttttatccaaaactcttatacttgagttgatatcaaatttccttgcattggagtacccaaagcttagtccttggacttctcttttttctctccactcactcaaggtgatcatcagttttaaacattatatacaggttgagtagcacttatccagaatgcttgagaccagaagtatttcagattccccatttttgggggggattttggaatatttacattatttttactagttcagcatccctaatctgaaagtctggaatgctccagtgagcattttctttgaacatcatgtcaaatacttaaaagctttggatttttggagcatccagaactttggcttttcagatttggaatgcccaacctgtatttacttaaaacttccaagtttatgttctctagtcccaaatgctcttctgaatgactccgctgtctcttaacatctgcttttttgactctcctacttggatatctaatccaataggcatttcaaatgtaacctgtcccaagcagatggatttctttgctgctgctatgccctgcaccaaacaacacttttacctgtggttttccctatctcagttatggcaaatcgttcttccagtcacttaagccaaaaaccatggtcaaatccttgattcctcactttctctgagacaccatgtctaatccattagagaatcttgtctaacttctgcttttagagtatctccaaactgaccagttctcactattactacttttcccactttctctaagttctgtcatctctcagctggattactctagtaaactcctgttaatagttcttccttctcctacccttgctgcagttctgtagttgaaatttatcttttaaaatctgttaggttatgtagttttctgctcagaactctccagtgactcctcgtttcactctgaataaaagccagagttctcatgttgacctgcaaaggcctcacgtgatctgttctcaggctgcatttctgagctctcctccagtcccccttgctcactctgctccagtctcagagactgcactggcattctgctctttctgtagtgttcttcccccttaaatcttcatggctctcacctttgttttgttttactcacaaattatctcctcatcaccctattttaaactaaacctccattcttcaccactccatatcctttttactctgttttacttttctccgtagcacttttcaccttgtatattgtatttatgcaatataatttactgtttatcttaagtctaaatttccccatctaaatagaatgtaaattacataaggataagattttggtctaggtaccccactgccccaactatttgtgaacaggccctagcacagagtcagagcacacacagaaattattttaattaatatgtgagactgttttaaaaatagatcataaaatatcaactaatagcaaaatcaaatgattacagttttcattagcaggcaagaatgtttgtcattgttaagaattgtttctcaattatatatccctttttaaatcagctaaagattttgataactacaaaaaattattctgtctttatattttgaattaactaggcttatttcttaactaaaacttttttttttctgtacagaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgacttatttgccatgtgcttgggtattatttcaaaacaaggttaaatacaaaggattaagcactgaactgctttattttaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgacgttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatgggttcttctcactgtcttataaatgtaaataaagatctaatattaatttggtta

SEQ ID NO: 776 - DNA, 3523 bp, Homo sapiens
tctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggtacgtggcgcgagggccccaggcgccgggccaccactgccgccaccgccgccgccgcctccctggtgcagggagcgagaatcggcgccgagcaggagccagcgcagcctccccgcgcgggggctggagacggtgtcgggcagctcggggctaaccctgagcggctcggctgcccgcgggcgccagaggccatattggaggagcggcggccgcggcgggaggagccatgttggcggctgtttatcccgctctcctcgggctcgccgcccccgccccgtgccccctcccccatcgcgagggccccttccctcccctccctgcgggcgggcaattcaaacccgaaagggcgggaaggcggcgctcggggttggcgggcgggggaaagcgctgccgccaaaaaaccgccgccgtgaggggcggggcttgtgcggtatggccccgccccctcgcccacgttccccgcgcacgagacgcgcgctgtcgccgcccacgagttccccgggctgcgcgcgcctccctctcccgccctcgacggctgccatagcaacggcgctgggctccgcctccggagggggtttgtttgcgccatctgcagctgttgctcctgcctgtcgcggtggtgcgggctccgctgccctccccggctgcgctccggtccagccctcgcttctcggggtcggcgagccggagctcctgcgcgcgcttcgttcttatacgaacgtcgggctcactcatttatgtcctagaaaagttgtgtggacgactgctttaattttcatttttagcactctaaagtttgggaagtaattaagaaccacctcaaaatctgcagttttttgttcttgtttcttataggctgaaggggatgctaagggagataaagcaaaggtgaaggacgaagtaagtcattctctcttcaagggtcaaagccttggactagcagaggccactggactcggtgattaaccgtaacctgtgtcctgaatttacactcctataatctagagcaaattgataccaaactttcaaagcgacttacctgtcctatttctaactttctcgttgtctttaatagccacagagaagatccgcgaggttgtctgctgtaagtgtatgcttttgaattttcgtgcttgtccctgaaactaaaaaacatcaaaaaacaattccctttgcttccatgaattatggttagtgcctggttttgaatcattgcctctacttgggactcttgcccctttgggttttgctggttctgaaattctgatgcctgtagccaaagtgggacatttgagtgggcttctggaaatccaacattctagaagaaagccaaccacaaaaacttttgaggaggaggagaaacttctctacccttggtacttttggttggttgtgggtggttttcttcagtccattgtactgatgttcactttttcctctcttcctgccaaaaaaagaaacctgctcctccaaagccagagcccaagcctaaaaaggcccctgcaaaggtaagtgctaacattggaactgatcattttcacagaatgaggactgtccttagtgccttaacttaattagcataatggtgcctccattaatggaggttataaactgtgtggatagcttacctcgtccgtgtcattcataacgttggtttcctgatcaagaattctgttgttagtttataggaaaatctgcatttaaatattaaataccccagggtttaaactaatttattcttctgttacttaggaaattctaagtactaaagattatagcaaattacagataatttagcctagttttgatcagttgttcttgtcaaatgggtgagggtttgtgttttatcttgagtaaacaatcctaccttgtgcagaactttgcagaccataccttggtaatacgaaatggggagaaacagttctattttttcccctttttcagaagggagagaaggtacccaaagggaaaaagggaaaagctgatgctggcaaggaggggaataaccctgcagaaaatggagatgccaaaacagaccaggtataactgctgtttcaccctttgttagatttgttcattcagttagttgctgatatcaaaaatttaattgcccttttcttgtatcactccaaatgtaccatttggtccagtgtgcttgtggctttcctgttaacttaaatcctggattcttgaaatctctactgtcagctgaagggcattgtgttttatactacatgaagttttcaagctaggagtaacctcaggtctcttattctggtgttcttcctacctcaattttacagtgaggcccagaggagaggtgacttagcaaagttacctagtaagtcattctcagaagaaatactgagtctcagtacctgaaacctgaactttggcctgggagcaaagtgatgctgtaggtggaatgtgaacacagatagttttgaaatctacgcattgcattaatttgtctgttttcttttaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcattgttgtttttgggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatcgttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaa

SEQ ID NO: 777 - DNA, 15298 bp, Homo sapiens
ggaagaaaccgaggcccagggattacacagccagtagagagaggacagagcatggagctcctggagaggcagtggataattcttcccgacagaggagctgactgttgaaccccttctttgaaggagagtccgtgctgccaaatcgaagaagagaaacgccctggctggaaagcagagagaacagcaggtacaaagcatggatggggaaggaaggttctggctgtgaaaggatgagaaatttggacatgtaccctcctgccctttggttcggagtaaacatgagcagggaagggagagaagtctttcctgtctttttcctcctcctcttcctcggttcactttccaggggcacctgaggatggcaacggtaccgagggtctgtcctccttcctttctctccctggtcaccctgacccaggcccgccatgagggaggtcatgctatggctaccatctgcaaaggtgtagagggtgatacaggatattgtgggaatgtgaaagaaggggttatctgggagggcttccctgaggaggaagtatacagggcacaaaagagcatttcttctcccaaggcttcactccagggtttcttgttggtaacaagcttcacatgttatgtccccagcacttcattctcaccctctgaggcagatgtcatcctcactccccattctgccactcaggaaatgggctggaggaggaggagtgactttcccaaggtcacacagctggggctgagctcaggcctctctcctccttctcttcggctccccctcctcctaggcagcccagcacccgctgtcagctgctctgaagtgagtggctatttttattctggtgcgaggggatctcaagcagcagagccatgtaggttagaggctctaggacacccggcctcagcagtccaggggaaacttcctgcagccaccagaccctgctaagcttgcctgggggctctcatttcttgcagactgacttgctctgggctcctatgcctccagaagcttctttattggagctcagaacagagcatagagccagattaagccctggtcatggtcctgatcctccaacttgaacccgactcttggtattgactaagcctctactccagctcttgactgagctctgacatcaccttagaatgaaccctgactctagtcacatactgatctaagcctgaattaggctgatcccaacttgagaccttagttctgggcccagatcaagcccttatccttctctaagactgagccttagtcacagactgaattctagccccagcccagactaaccttttagactgactctggcagaagagtcagactaaccttttaaccctgactctggcagaagactgagccctaatcttggtcaaagactgagtcctgagcctaatcattgactgaactctgaccacagactgaattctgaccctggatcatgcaattctggtcacacactgagccctaaacggaagactgtgccctgaatctggtcacagactgagccctgaacttagtcattgacagagacatgaccctggtcacagactgagcctggctcctggtcacagactaaagactaagcccaatcatggactgagccctgtatctagccctaggctacagactactcaactaagggctgacctagaccctgtctgagcctgaccccatcacagactaatccccaaccttggccccacttgaggaagactgctggcctaaattacatgctgccacataagaggcatggattatgggcagagatctgtcttgggagatcttgggcttctcatgctgctgatgccacagtgttccttcctggtactgttatggtcacagtctccaccactggttccactggctggttggtcaaccctcagcagcccaagctgtggcctttaggggccacagcatccaggctaatgcaatgagagtggtttggtggcatctgtccagcaaacaaccagggcccatggggtactggggtttggctctgtcagcagcaagaacgactccgtggggcctctggcttcagttactctgaggcccttgctggggtaggggttggagtagaaggaaatagtggggtatgtcccattattttcgtaaataaagtttactgtttgtgtttaggtaatccatgcccattacacaaaacacagaaggaaaacatttacctataatttcatccaccaagaaataatcgttctgacttattggtttgtttccttatagatattttttggtgggggcgggggtctaggcatatatatttatatatacatgttgtatataatatgcatatatatttatatacatgttgtatataatatgcatatatatttatatacatgtatatttacatatacgtgttatatattttatatagctatatctattttttgagatggagtctcactctgtcgtccaggctggagtgcagtggcatgatctcagctcactgaaacctccacctctggtccaagcaattctcctgcctcagcctcccgagtagctgggattacagacatgcaccaccatgcccagctaattttgtatttttagtagagacagggttttgccttgttgaccaggctggtcttgaactcctggactcaagtgatccacatgccttggcctcccaagtgctgggattacaggcgtgagccaccaagactgggcctatacatgttttatagaattggttggttactgtgttgctgccacaatgtccagcaacacagtagggttagggttagggttaggatcctgttaaggttgcagcccatctccttcttaacaggaactggaatatggtggaccccaccctcagcttcaggaatgggtcccagttggttaagccagtaagcaattcccatttccccaggcacatgattagatcacgaatgaactagcaagatacaaggaaatttttgctcagggcttttgggaaaggaagcttattttctctcctgaggaggctgccaaaaaagatgatcttccttccattagatgtaaatgaagaggccaatggctctagttactgctggcagccatctttacaccatgtagaaaattggcctactgataaactgacattatggaaagcagaatggagagacaccaggctttggtgacttcattaactggatcaaacttcacctgaagccccacctgccattggactttttttttcttctttttgaaatggagtctcaatctgtcgcccaggctggagtacagtggcacgatcttggctcactgcaacctccgccacccaggttcaagcgattctcctgcctcagcctcccgagtagctggagttacaggtgcccaccgctgcgtttggctaatttttgtatttttagtagagacggggtttcgccatgttggccaggctggtttcaaactcctgaccttaggtgatctgcccgcctcagcctcccaaattgctgggattacaggcgtcagccactgtgcctgtcctggacttttaaaattatttgagccaacagagtccctttatttatttatttatttagagactgagtgtcgctctggcacccaggctggagtgcagtggcgcaatcttggctcactgaaacttccacctcccgggctcaagcaattctcttcctcagcctcctaagtagttgggattacaggtgtgcaccatcatgcccagctagtttttgtgtttttagtagagagggggtttcaccatgatggccaggctggtctccatctcctgacctcaagtgatctgcctatctcggcctcccaaagtgctgggattacaggcatgagccactgggcccagcccctttatttttattattttttgacacagggtcttactcacattgcccaggctagagtgcagtggtacgatcttggctcactgtattattttttattttttataggagatggggtctcactctgtctcccaggttagagtgcagtggcatgatcatagctcactgtagtcttgaactcctgggctcaagcagtcctcccacctcagcctctggggtagctgggactacaggcactgccatgcctggctagattttaaatatctttttttagagatgggttctcactatgttgtccaggatagtttggaactcttggcctcaagttatcctcctgcctcagcctcctgagtagctgggtttatagacacaagccaccacaaccagctccctttattgtttaagccagtttaaattggggtttctatgacttgcagcccacagcatcacaactcccaattgatattaccagattactgtttttgttgcttttttcttgctatttaataccataaccacgaacattctccatgtcattccatctatgctgcatctttttttttttttttgagatagagtctcactcgcccaggctggagtgcagtggtgcgatctcagctcactgcaacctctgcctcctgggttcaggcaattctcttgccttagcctcccaagtagctgagattacaggcagccatcaccatgcccagctaatttttatatttttagtagagatggggcttcaccatattggccaggctgctctcaaactcctgacctcaggtgatccgcccacctcggcctcccaaagtgccgggattacaggcgtgagccacccacgcccagcctgctgcatcatttttaacaattgcatggttttccatcctatggaggtacactcattaatttaactcatcccctgctgtgacatgcttaggttatatccccagttcttcaccacgataaatggtattctaataaacaagcttgacctaacaatcctctctctgatgattactttggggctaattctgaaaaatggaattactgggtcaaaaaaagtttttagagttttgattttgcccttcagaaagccagggtgaattcatacttccccagcagtgaacagagtgttagagatagcttactgtgtgaatagtctggacaagactaatcatattgactacatactcatattatatatatatatatatatatatatatatatatatatatatatatatatttttttttttttttttttttttttttttttttttgagacggagtcttgctctatcacccaggctggagtgcagtggcacaatcttggctcactgcagcctctgcctcccgggttcaagtgattctcctgcttcagcctcccaagtagctgggattataggcatgcaccaccatgcctggctaatttttgtatttttagtagagacgaggtttcaccatgttggccaggtggcctcgaacttctgactcaagtgatctccctgcctcagcctcccaaagtgctgggattattggtatgagccaccatgcccggccaagcctattatttttatatctttacaatcaagttagtaaaggggaagttagcagggtgcaaacaaaagactcagtgcagacttaacttctctagaaggcacagtaggctcagtgtttagggcccactatacttttagggggtccatgaaagtgtttttttttttttttgagacggagtctcgctctgtcacccatgctggatggagtgcagtggcgtgatctcggctcactgcaagctccgcctcccgggttcacgccattctcctgcctcagcctcccgagtagctgggactacaggtgcccgccaccacgcctggctaatttttcgtatttttagtagagacgggggggtttcactgtgttagccaggatggtctcaatctcctgaccttgtcatccgcccgcctcggtctcccaaagtgctgggattacaggcgtgagccaccgcgcctggtcgaaaatgtttttaatattctttaaaattagaaggatacactgggaagttaaggttaaaaaaaaaaggaaacatatactaataataatgaatccagcctagattatagttatctttttaccaaagcaattgaaaatcaaatatatataatatttatgtatattatgtatatttaatggaggcatgtgtccatatcccagctactcaggaggctaaggcaggagcattgtttgaggccaggagttgaacactagctgggacaacacagaaagaccctgtctctaaaaaaaaaaagaaaaaagaggccaggcacagtggctcatgcctgtaaccccagcattttgggaggcggaggcgggcggatcacttgaggttgagaccagcctaacatggtgaaatcctgtctctactaaaaataaaaaaaattatccgggcatgatggcacgctcctgtaatcccagctacacaggaggctgagacacgagaatcgattgaacctaggaggtggagattgcagtgagccaagattgtgccactgcactccagcctgggcgacagagcaagactccgtctcaaaataaaaataaaaattaaaaaaagaaaaaagaaagaaaaccctaggatccatgaaagtcataatgcagccttggctcggtattgagaaggagtccctagattcaatgggaaaagaggacagtgacgaacttgctgtgtctgtggaagaaagcatgaagaagagaactggcatcctaatctggtgatctggtgatccgttctcctttttttttttttttttaattgtaggcattttatctgcaaatgcatattacctccttagaaaaagaattccaggattttacctcctgtgtgttttcgtcttgcttctttgtgatccatgatgccagctgaggttgtgagtacaatgaaacccaactggcaggatgggagcagattattctgccatttttctagatttttgagttgcacatcaaatcaggggctgattactccacacttgtttaacctgcctgtgaggttcacagcagttttcctagctctgtgatcatcaatgacttcaacttcaccagtgtaactatgcttcatcaccacagttagaaaccagacgacgacattataagaacctggtgtttgcctctcttttggcattgttgatgctcttgagagcatcagccgggacattcatgcacaccattatggcagcacatggcagaaagagctatctgcttatgtatgagattgagaggtgaagccagctggacttcctgggtggagtggggacttggagaaattttctgtctagccagaggattataaatgcaccaatcagcgctctgtgtctagctgaagaattgtaaatgcaccaatcagcactctgtaaaaatgcaccaatcagtgctctgtgtctagatagaggattgtaaatgcaccaatcagcactctgtaaaatggaccaatcagcactctgtaaaatggaccaatcagcaggatgtgggcggggacaaataagggactaaaagctggccgccactgccacccttcatccccagccagcagccggcaacctgcttgggtgcccttcggtgctgtggaagctttgtcctttcgctcttcccaataaatcttgctgctgctcactctttgggtcctcaccacctttaagagctgcaacagcctgtaatcccagcaccttgggaggccaaggtgggcggattacgaggtcaggagatcaagaccaccctggctaacacggtgaaaccccatctctactaaaaatacaaaaaattagttgggcatggtggtgggcatctgtagtcccagttactcgggaggctgaggcaagagaatggcgtgaacccaggaggcagagcttgcagtgacctgagattgtgccactgcacttcaacctgggggcgacagagcgagactccgtctcaaaaaaaaaaaaaaaaaaaaagaaagaaagaaaagaaaaatagaaaaaagagagttgtatcactcaccgtgaaagtccgtggcttcattcttgaagtcagtgagaccactaacccactggaaggaagaaactccagacacatttgaaggaacaaactctggacacaccatccttaagagctgtaacactcacagtgaaggtccgcggcttcattcttgaagtcagtgagaccaccaacccactggaaggaagaaactccggactctcaagatgagtgcagagacatgttgggttcaagtcccaaatccacagttcactcatttcacctttctgagcctgtttcctaacctgcaaaatggagttcacggggtctttatgaggtaaggaaggaactgataatgaaagctaacactgtcctagtaggtacttttttttttttttttttttgagtcagagtctcattctgtcgcctggctggagtgcagtggcgcgatctcgggtcactgcaacctccgcctcccaggttcaagtgattctcctgcgtcagcctcccgagtagctaggattacaggcatgcaccaccacacctgggtaatttttttgtatttttagtagagacggggtttcaccatgttggccaggatggtcttgatctcttgacttcgtgatctgcccgcctcagtcttttttttttttttttttttttgagacagtctcactgtgtcgcccaggccggagtgcagtggtgcgatctcggctcactgcaacctccacctcccgggttgaagcgattctcctgcctcagcctctggagtaactgggactacaggtgcccgccactatgtgcccagctaaatttttttttttttttttgagacagaattttgctcttgttccccaggctggagtgcagtggcgccatcttggttcactgcaacctccgcctccgggttcaagcaaattttcctgcttcagcctcccgagtagctgggattacagacatgagaatcatgcctggctaagttttgtatttttagtagaggtggggggtttcaccatgttggtcaggctggtctcgaactcctgacctcaggtgatccacccaccttggcctcccaaagtgctgggattacaggcatgagccaccatgcccgtcctgtattaggtactgttctaatgagctttatatgtgttaacccctttatcctgccaatcccaacagggtacacaatattgcatcaccacaatgtgtgctctgggaagtaaaaaccttgattggaatttttgtccaaagaaataaaaaggccaggtggagtggctcacacctgtaattctagcactttgggaggctgaggcaggaggatcacttgagaccaggagtttgagaccagcctggtcagcagcaagaccccgtaatctactgaataaacaaacagcgcaaacagggattccctagggttcggttttcctatctctttttttctacaaccaaattggtttattacaggaatgcaaggtttaacatatgaaaatcagttcacatattttaccacatttaataaaataaaggagaaaaaccacatgatcatctcaatagatgcaggaaaacatttgacaaagttcaacatccattcatgataaaagctctaagaaaaatagaaatagaaaactttcttttacaaaaggcaccagtaacaaacctacagcaaacatgatcgtttaaagatgatatctggaaaaagacaattatcagttccagtcaacattgtaccagaggccccagaccgtaaaattaagacagtgcaacgaaacaaaaccaaggtataaggaccagaaaggaagaaaaccacttttatttccagatgatataatatgcatatgtagaaaataaaaaaaaatatccagttaaactattagagtaagaaaattcagtaaggtcactggctgcaaggttaatatacaaaaatcaattgtcttcctatatgctactaccaagcaacttgaaaatgaatatgtaaaaacaatagagtttgtaatgctataaaaaattaaatacctaggagtaaatctaatgaaagatatgcaagatatttattctaaaaaccacaaaatattattgaaggaaattaaagaagacctatagaaatggagggacttactatgttcgtggaagaaaagtcacaataatgtaaagctgtagagtctccccacattgatttccccagtgggaatctgaaatcctgatagaaatttggaaggtttttctgtggaggttgacgagctggccctaaattgtacctggaagtgtgaaaggccaagtatagtcaagacaaccttcaagaagaacaaagctagactgcgatggcttactgaggctgtgggatcacacatggccctcaccacaggaaaatgtaggccacaggccaggcatggtcgctcatgcctgtaatcccagtactttgggaggccaaggcaggaggatcacttgagcccaggagtttgcgaccagcttggtcaacatggtgaaacctcgtctctactaaaaagacaaaaaattagccgggtgtggtggccgacgcctgtaatcccagctacttaggaggctgaggcaagagaatcgcttgaacctgggaggcagaggttgcagtgagtccggatcatgccactggacatgagagtgtccagcctggacaatgagagtgaaactccgtctcaaaaaaaaaaaaaaaaaatcagctgggcatgatggtgcatgcctgtagtcccagctactcaggaggctgaggtgggaggattgcttgagcctgggaggttcaggctgtgattgagccactgcactccagcctgggcaacagagcaagactctgtctcaaaaaaaaaaaaaaaatagccagcccagcagctcacacctgtaatcccaggactttgggaggccaaggcgggtggatgacttgaggttaggagttcgagaccagcctggccaagatgatgaaacccccatatttactaaaaatacaaaattagctgggcgtggtggtgggcacctgtaatcccagctacttgggaggctgaggcagaagaatcgcttgaacctgggaggtggaggttgcagtgagctgagatcgtgccactgcactccagcctggctgacagagcaagactctgtctcaaaaaaacaaacaaacaaaaaaacaaaaaaaaatgggccaggcgcagtggctcacacctgttatcccagcactttgggaggctgagacgggcggatcatgagatcaggagatcaagaacatcctggctaacacagtgaaaccccatctctactaaaaatacaaaaaaattagctgggcgtggtggcgcgtgcctgtagtcccagctactcgggaggctgaggcaggagaattgcttgaacccgggaggcggaggttgcagtgagccgagatcaggccactgaactccagcctgggcaacagagcgagactccgtctcaaaaaaaaaaagaaagaaagaaagaacaaagctagaggaccaacacacaaccagatgtcaagtctgactataaagctatagttaataagacagcgtagttagacaaacccactgaaggactagaatagggtatgatattcagaagtagactcccatatatttatatggttacctatttatttatttatttatttttgagacagtctctgtcgcccaggctggagtgcagtggtaggatgtcggctcattgcaaactctgcctcccaggttgaagtgattctcctgcctcagcctcccaagtagctaggattacaggcgcccacaccacgcccagctaatttttgtatttttagtagcgatggggtttcaccatgttggccaggctggcctcgaacttctgacctcaagtgatctacccacctcggcctcccaaagtgctgggattacaggtgtgagccaccacgcccggccgtggttgcctatttatatataacagaggtaacgcggcagagtagcaatgaaaaagacaagatttttaattgaattggatagccacattaaaaaaaaaagtaaatcctgactccataaatttaacccagctgatttaagaccctgttgtggcctatcagctgtaaccctccttgcattttcccacctttgaatagcaaattcctttcctcaccccaggtcagaaagtctgctcagcagtagctgtggatggtaagaagacacgctggtaggtctcagtggctcccagaagccgcaccccctccaccgaacctcactcctcatctcccacgctccaaagcgaggagtcctcagaaagccagtttcccttatttattcttctttctttctttcctttttttttcttggatgtcctaccagtttccctatcttaaagtcgcaggttcggctcagaaactccagtgtccctcagcgtctcgccggcaccctctgccggcgtgaggtggcgctgcctggccgcatcctgggggagcgtccacatcctcggtcgacaaaaggagcgtcgacactctcggacctgggaaagtgacggcccaaacgccagggaggagccaggacctcgccctgagctagcgggaggtaacggcggggagtcctggggcggagaccgagcgctgggggcgtggtctccagcgggactgggcctctagcgggagtgggggcgggggcgggggcggggccagcctgggggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagaggtgagtacgccggcctccagccccggcactatcgttccccaaccctgcggccccatgggagcaccgtccgtcccggccccaagaccacctcgaaccgcgagtctccctgctttccccctggcgccgggaccatccctcctgttccctagccccagatggccccagcatccaccgtggaagcctgagacaccgactttggggcctggaactccgaacccttccccagctccccctacccggtccgacagcggacacccagacacactgacgcagtctcctaactcttctcgtggcctatgactcccaatcctgtcccaacttcccatcccccatcacttcatgttttcctggaattcccccccgacccggttccagggctggaggctccagaaagtctcttttccttctcctggggggaaagaagactttctgggtgcctcctcccatatgcaggatccggggaagggggccaactcggaggggcaaccgagttgggaacttggttgccaacatttactctgcagcagcctcccatcctcccccaaccaggaaattcccgttcggagtccctgtcttgctatgtgactttgaccatcacagcccgcctctgagctttttgtcagctctgtctgacaaaagggtgtagaatggttgggtgccggtggtgcacgcctgtaatcccagcactttgggaggccaaggcaggaggattgcttgagcccaggagttcaagaccagcttgggggacatagtgagaccctgtctctaagaaaagggctgagggtaggatggaggagggctggagtgggtggtcctggggtctagactcctgctggatggtggcatctcctcagggaaggcagggaggagccctcccatcctcccatgtcagggaagcaaccacatggtctgtggggctgggccgcaggtggcaggcagggtgaggtctgcctgtgtagagtagggaccagatggtaggtgtctccaatgggggcccccagggccattctgaggtgtttccttctgctctgcctccactgtgagatttcagggatcaaaggccaagcccaggtctctactgcttaagaggagcagggtgatcatttcccctgggcattgggagtcagtccacagccagtaggatgtacaggccccaaggctggcaggcacactgtgggtctctggccttgctcttttcccctggtgtctctaggcctgagtctccccacctgtatacacagttcccccttctgcccacaagggtccagcatttccttcagaccttgggaactgctgatccggggataactcacagcccgacccaactcagggataaggaagtatggctttggggatgtgactggaataaacgtgaaggactcctgacctatcccattttatccccctccagacctgcgggggatgacagctgaaccgcctaaaggaggtgagtttgaaggaagaggtccctagctctgttccccctgagcctcttggggagtgggcaacatggtcccaatgactggggcggggaggggggaaggatccctaggctgagagtctagcctaggctgagagtctagcctgcacctgacttgctttatgacctcactgggcttcagtgtctcgtctgtacctcgagtagactgaggtcatggtctctgatgctctggttcctccccaggtgaaggctttcgtcacgcaggacattccattctagtatccttctgttctgggggaggggaaatgggatgggcacctgggagaatctccacgtaacttcagaaaggggtggcagatggttttcaactgacaagttgaattgattggtagtggctcccagaggattctgaggtggtctccatgttgggtgggcaagagagattgactagtgatgactgccacagaatggagaggagggccctttacttctttgaaccctaattttctcacgtataagcggagaccctggcccctcccgggcacagagtaagctctgagcaaaggaggcaatgctgttcccatcagtaaggctgcggaaaccaccacctccctctgcccaccaccccgctccttaacaccacctccagtcacaacctggtgatgaaacacctccctggggccgaccctgagctcgtgctgctgggccgccgctacgaggaactagaggtgaggccgtgggaggtgggctgggggcgaggccagaggcgaggcccagcctgctgaccccgcccctcctccgcctcagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaactgag

SEQ ID NO: 778 - DNA, 3023 bp, Homo sapiens
gctgcggcgcgcgggcgccctcggagccgcgtgctgggggtcgtaggggcccaccgcgctcagccagacgttcagacgctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacggtgagtaacctggccctgggtcccgggagacatcccgaggtaggatgggcccttggcctcctacggataggcgggtgagagtacaaatctctgggcgtggaatttggggaagttatgaatggggggagggtcgggttccgatttgagccaaagcccccaggtaccttgtacattttaacagggctcctagagagggcggggagacgaagcaaggccaagttccaaagggaggataggcccagctggcttcagcgtccacacggcatagtccttcatgaatgttggtaagcgcggtagcttgtgaattagggtgagtggcagaagctcgggcttcacgggtgggtggggaggcagtggaactgaccactgccggctgtcaggtaggccttgggcacctggttctgcagacagttttctgaactaagaagtgaagctagcctgcccacacacggggtatccactagccccttaggagcagagagggcaccgtagcaagcagctggcggcactgtgcctctcttgcgctccctgggcagagagggagaggctgagtgatgaggctcacttcatactgggtgagcagaatgaagactgtgaagtcacagaggaagtggaatgctacaactggctgccggggcagaggaaaggtgtcacccaggcaggttcagggctttctggctataaaagggagcctctgggatcagcaggtcatatctggtgcccatggttgactgaggagtcgggtgaggccaccctaccacaagggtccccctccccatcctacacaggaatgaaaacagtcccatgtacactttctggaagcctaaataccacccacaccatgtggaaggaaagcaggagagagactgagtggcacatcctttcgccctcttttctctcgaacctcctcccaggccgaccacccttgctgtgtccaagccaagctctgtgggctttctgttcctcctgagtagctgattttcagaatttggggtaccagggctctggggaatgtgagctagagagcagataagtctggaagatgaccactgactcctactctcctacttctccagatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacagaggaaggtatttctaattccttgggcta

SEQ ID NO: 779 - DNA, 7718 bp, Homo sapiens
gcactttcgcgccgtatccctccgccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggcaagtaggggtgcgtgaggtggggggccgtggtgtgggggtggtccgccagggtggaccggctggcaacctgccccccggaccctgacagcctggcaacgaggagacgatccgttcggagccgggcgctagagagaggtgcgcagtgcccgagatccctggctatggggaggcggtgactggtgcgggccaggccggaccaagggctgaggggctggctccagaggcaccgtcagatcgtctggaggagaaccgcgctgaccgcttcccagccagctttgcaggcgcccgcgcgcagccctcgacggtttcggtaccgagagacggctgtgggggaggctcctgcgggagaaatggccaaacgggagccgtgttggggggcgcccgggaggcagttggggggcgcctgggggggccctcgtgggccagcgtcccagctctgtgcctagcccgtgggaggtgggtcgcgttcgctgctccgggccctgattccggaaaggggcctgtggggccccgtgtcctgggtgctgtcccttcccacagactccaggttgatgtcaaagtctgtctgcgcggtaggtctggcgtattctgacaggacacagtgagcatctgtagaggagaggcttgaaataaaggaggagcacgaatattccctggatttctggaggtgtgtggggatgtggggtgggtgccaaacactggagaaccgaatcggggtgggggactgcgaccagagcaggtcaggcatccaggagcacctcttaatcttcccctctctaatggtgttccaggcgcttcccccaccttccatccccatctgcctcccccaccgtcctaaactgggggcttgaaagggtgagctttggaggtaggggtgatgagggagacatactgacaagtaccaattcacgacctgttttctagaatatgtggcgcccttcccccattttctgctgcgcagagcaaggggatgtggcgcacctagtggtgaatcctcagaattggagaagggagtaatgagaagagtatgacgtcaagagaaggagttgttatctctagaaccttgaagcagggcctaaacaaaacgagaatattccaccagcaaaaccccgaatgttgaaagacagatatcaataatatggggattcttatccttagcgttggtctctctaccaagggctttactgccacccctcatttcctgtcttactttttcatctgtttgtccataggcctgctttaaggctggccagttctgcaagaaaggcaaggaggaggagactggctcacacctctggaggttggtgagaagggggagggggcaattcaggggacagttggagaaagagagcatggcaggtggctttgagaccagtgggtgcagacccacttctactctgctggatttgcacagtgccagcatcctttttatttcttgcaggggacatgagataggtgtaggttgtgttgtgactcagaaagacctgagagcagggaccaggacacaggaaaccatagatacattgaacccttgaatgggaagacagatatttgtcacaggagccagagtgcttgcctatctaccattctccattctctcctgtatgtttacttgtctgtaggacccccttctgtcagctgtggggcttgacactacttgaacaagaaaaggagggggaaactgcaccacataagtgaaggttggtatgagagtgggtatacttttgggcggggtagtggagaccagcatgggtccgggagtgcttagggtccaatctggggacttcttggcccctcccattgccgacacactttcccaccattgttggacctgtttaataggaggcagccggtccagagagactttctcaaagcccagctgtcccacctagcattcaacatcagtctcactgcatatgtctctgcatgggatgacataattggaagagactcaaagccccatttcattctctctccctagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaatcacccttcttcttgaaattaaaatacagacccaatgataacacatgaacacacatagagataattaatatatgaataatatgttcctttcaaaagtttttttctcagctttaaacgcaaaaattaccaggggctgctatgtagggcatacttcagagaaaaagtagctacttcggttggactctgaagtttgggaaagatattggtggtgtaaaaaaaaaaaaaagcatggagttaggaaaaattttcctatgggagtgaggtatcctgtttgcctagagtgagtgagaggaatatattgagcaacatagaggatgacataagttttaaagagctgaggatttgcattttacagctcaaagtacaactgctgcttccatactacctaaagggcaaaagaataagacaggaaagcatagggatttgattgagtcaggaagacaatttaatcatgatggtaccatggtaagtgttaaggcaacatcatacagccattaaacatgatgatgtatagggttttaggaaaagccctgacatttttgatatttcatataatagagaacactggtgtcatacatgggaagtatgatcccatttgaaaaataaatgtgaataaattgaccaaa

SEQ ID NO: 780 - DNA, 67633 bp, Homo sapiens
gccgccgcggagccggcgtccgcagcggctgcgcatctcgggcctgcagcggggcgcttggcgggcgggggccgggggagagcctgtttgcgcagtacccccggagggcggaaggccgccgaggtaagagccgggactcggccaggtgggagtgggcaccttgggccgggcctgcagggcggtccccgagcgtcccggggtagggtgggctccctggggacgatgcccagggccccggccgcgctccggtcgcgccccaccccggctgcagcgcggccttggggcgctgctggcctcgccgcgggggtgggagcggtcgcggcctggagcagctccgggcgggccccaggctctggggccagggccagctgcgcgcaggggtgagtgagcagcccccgggccctcaagtgagcccctgtccgctccccaccttgcatttctcctctccgcagtgggcgtggtgcccctttgctgcagagggggcgcccagagttgaggaaggctgcgggggagaacgcagagacaggtggttgagggggcgagggctggtgcgccaaggctcgaggtattaatgcgtatttctttttccccccttcttcagggggcgcggaggtccgtgtggaggaggaggcgggaaggccagaggcatagctcaggagagggcaggtgctgcgggagatcacttggctctgtctctgttcagctgcccccacccctgccaaattaataaagtgggtgtggtgatgacggtggaggagtttgattaagacctggcccaaactgcccagaactgccccaggccggccgcctagtcccgcgtgtatatccgggagccgcagactctgagcattctgtagagggagggggaatattacccgaaggagctacagccactgaggcagctccagagataggggctgcggagcaatcttcaggctcacagcccaagttcatagatggtgaattggccaggaatggtgggagatgggggctgtagggaaatagggtaatttccttaggaccccttccttccagctttgcaaccgtagaccaaaatttgggatctggcatttgtcaaatgtgcttaatttttttttctttccctttcggtttgttttgttttttagagaaacagcaagtgacagagcagaggaacggctggcccagccaatcctggagctgctgttgcagcacttgttccccaaacaagtgctcctacattctggtaggaggacagagaggagggggctactggtccacacccctcccctgccgaggaccccatggctgctcccctgcaggaaaggcagctaggctgccttaggccggatgggcagaggctgccatggcccagggtggtgacggttttgcggcccctccctgctgcccagagtgggaagaagagcgcagagcctggcaagtttctctctgtgtcctctgggctggaaggagcaggtatagacagggccgaggcagccagggcctggtgctgctttggcattggtggcaggagggctgaacctccagccccttgggtttggttccacccctggcctgtccctggcactcgacaactgctcctgtgtgcttattggtgccaccatgttatataacgcttatataatcttccagggcgagcactgtgtctccgctctcaggtcacgcagacacggtgtccgtgtgggaggcaggatctgtggaagcctgtgggtgaacctactcccccgatccccaacctggctccttctcctgatctcagccataggaggggggctgggagagccaggtccctctccacaccagctgtgtgggatgagaacacggttggctgggcagttttcctcaccttcctgccccactagtcccacttgccctgtctggtagagcagaagccatccttgtgctttgataccagctctttgttttgggggacccctggcatggcaggtggcatggcgagatgaaccccaaaatgttgcagtggaagaacacatggtacttagggttggataaagagagggagaaattagctctgcctttgaggagcaagggtaactagaaggatggtggtggcattataagagatttggagcaggcctggggctaggggatggtcagggaagggtgtacagggaagtagatcagacagcaaagataaacatggtgttcttttactgtactctccactgggctgtccctggttaccggggcaacagaagcagtgatgaaaatcatgcctttcgttcagtggaaaaatttggctcctcctcccggctcttccttctctaaatcgcctgtgacccattgagagggttatgcttccaaggatcagagagagaccccagcatgttttcatcatgctcccctttccccagtcttctttatcatctcccctcttcctgcatcccctgtctccccccacagctcggcagttggcagttgcgtaggagttggagtagatgcagggggaagggcatggacgtcatcacagggcagggtgagcagagcgtgggcagagatgtggatgcaggaatgcctggcacatgaggagggtccagcattgatgagctagatggagccaaaagcctgtttctgggctggtaggagctgaggtgggcagggtgagatgatggtgggccttcagagttcagcagtctgggttcgagggagtaggaactaggaagggcctgaggtttcttgtgcagatatcttgtgatgaaaactaccaaaccgtatccctttttgaagttaagatttttgtttaagttttttctttcatcttgtgatgaaaaccgtgattcattcattcagcatttattgtgtgccccccatattaggtgaggttctgggaactgggaagccgaaggtgagtagcactggaccttgaccttgaagagactgtggtgaatgaaaggaggatgagtatatgggggaagatctggcattgttgcaagcctggaatctggggtccccagcaggagactagcaacataccagatcggaggtgataggttagggtggagcctgtggaaatgaagaagaagagataatttggagtgctactctggcttgaggacaggacgtggggaagagaaagtgctgaaattttgaaccttagtgatttatagaaatagaaacattagagttcaaacttgttttggggagtcatgtttgattttcttttagacatgttgccttcaagatgatggcagggtatccaaataaaaatgtttatggtcaggcaagtaaaatatgcaatggaagtcagttctgggaaaagatttgaaggatattggattatgaagcttgaaggtgggtagaggtagatcctagggcctggggcattacctggaattgagtgaggctgtatgccttgtactggtttattatcccagggcttgcccagaccctggacatttctgctaacaaaaacccacatcttctaccaaaccatatccctttttaaagttaggatttttgtttaagttttcctctccctagtaactatgtccaggtatacctggaaaaacacacacacacacacacacacacacacacacacacacacacacacacgcatgcacttatttcccccaaggtcttgtgccatttgcttatagctcggggacgtgctgtagaaatgtgccacaagtctttggcctcttctagcaagctgtttatcaccctggaggagtaagagcactggacagagtcaggagacttttgctagctacgtgatcttggacacaccacttccttttccaggcctaagtgtctagtcttagggatctagcttcttccagttctgaagccctctgatttgatgtctggaaagctttttccacctttgcccaggtttctgatgcagaccaggctttttgaacaagtagcctagatttcttagtaccttgtgggagggactagtagggatggaggcctagtccccagagtgggtccctgtcttcagtgtggataggagccctccgggtggatgggagcctctgttcctctttggagcatggaaatactggaagagcaggttttcccaatgaccagggattgcaaactgtggcccgtgggccggattcctgtttttgtaaataaagtttcactggaacagagacacgcccgttgtttgtgtattgtctgaggctggtttcatgctacaagggcatagttgagtaactgcaagggagcctgtatgccccataagcctaaaatatttactatcttgccctttaggataaaagataaaaacttgtcaacccctgctgtagactaccagaaaagtgcttggccttttactgaggatgcttatgatggctatttcagatttctagggttcttaaagattctgcattgggcctgtctttgtgatcccatgagaggatgatctggtagttgaaatagtagattattagagtcagctcaaaaatagtcactctgtatctaggaaagctctttcattttcagccttttccctggagcctggaggcctgagttcctcagcaggactgggtttgacaagctactgtccctctcattctgatttccctgggcagtacagaggatatactggactgacccaagtgttgggtcaaggatatactggactgacccaagcccagtgttgagtgaggagaaaggaggctcattggttccgcctgtcctgtaggatctttcccctgatatctctattgtttctgatcttactggcacctttagtgccaaggtcctggagatgccgccacagagagagcctgcaacccagcctggcatgtctgtctgaacctggcactcatccactctgtcagaataaggccctgggcttggcgtttgtgggacatgtgtctgtgttggcttgggactggaatcagcattcattattcctgcagccaaccttcatggagtccttctgtgtcctagtttccacctttttgacctggtcctcaagccagagtcttgctgaaactcctagctaggaacagggctaaagttctcgctgctgcagaacagcagcagcccagcagttggggcagttctgctcagataggaagtgagacacgttggtagcaggaggaaaccacttgctggaagtagcagggggaacggaggtgactgaggttgattctcgttacacttgatagggaggaggccagcagcaggaggagggagcagacaatccataatagcaaagaagacagaagtcgagcacacctagagctgcttttagctggtaatggtaactctggctctaggagcattccttcatacctccccgacacagtttccccagaggctgttataaagaaaacattctctcttaaatatcttttcatttgtagggtttagggtgaccccatactatatggtcttaaacttatgttgagacaactgcactgacttggataaataaatatcatttatcagatatttattaaagatctattatatggcaggcgctgtgtgaagttctcaggatacagaggtaaataaaagattcacagtttgatctggaaggtttatgggcagctgaaccaattttaattccatctgcactggatcacatgcttcaagagagcatgtctgtatctgtcttgtcctttgctgtcaccccagtgctgagtggagagcttggcacacaataggcctcagatatttattggctgacccatccttgtttgatctgtcctggaaatgtgcaggaggaatctgagtgggtaagtggaggaagagaggtgcttaacgcagcaagtgtgacaaatttgggggaagatggacatacttggatgtatgacgatgagtgcctttaagtgactgcctttaaggaaaagagaagggttaaagctgtatgggcatgacagaatccattggcattagggccatgagaaggaaggaatataacctggctacaaaggtgggttagaggtagtcaggatcattgggtatagcagagggccaccagaattgtgaagaactaaccagcggcagagaagggaagagtggaaggagagtaggagccattgtgagaggaaacatggagacctcttcaggcctaggatgaaagcagaaatgacacaagtgagtctcagatgaacatgatggcagggataaagaaaagatgggactctcagctctgttctgctggtctcctcagaaaccactgtgtccatgtatgactaaaaatgcctctcagttattttccaacagtgcggcaaatgcgaggaaattaactatggtttgacattatggttagtcttttttttttttttcaaatttgtcaatggaaattttcacaggtacacaaagatagagttagcgtaatacacctcaatgttcccatcccccagtttttcgacttgtaatcaacacatggcttttctcatttcttttataccttcacccacctttttcttactcccttcttggattattttacagcaagacctagatcctgtattattttatctataaatactttttaatatatctctaaatgataataccttttaaaaacttaaccctagtggtattattacaccttgaaaaagcacagtcatccctaaatatctcctgtcatccaaatatccaaatggtgtttaactttccttcgatgtctcaatttctttctttctttcttttttttttttttttttgaaaacagccagttggtttgagtcaggctccaaacaagatcctcatgtttcatttagttgatgacaaatcttcaaggctctgttaataaagattatggtcattcttaaaagaatttatgttttgcaattctaccttttagatttacttagctacccacgattcttcccagtcagctgccatcaacagcttcctgagttttgttagatgatttttatgattttgagcattttttcatgatccctcttgcctttatggtttaatgtagctagtcatttttcccttccttcagtagatgtttcttgggagcctgctctgtttcaggagctgtactggacactgggcctacacctgtgaaaaggacagacagggcccaactcctggagcttacagtttgaccacaggagagctgctgcttggcagttttccccgtgcgttcaccccagctgagcagtgtgaccacaaccgtcacttctgtgcaggcagacctgccacgtttttatagcttggtgttcatgctctcatgctgtcattttatgtggttgacaaaggtgcgcctagaatgttcaagaagccaggcatggcttctgtggcaggcctgtgtctcatagccacacgacccggcattctaactgtggtgctgcttgggccttgtgtgtatccatgtaacacttttgggcttgagtgtggatagctctgaaagttaaaatggagagcttcctgaattggtggattgtggagaggctaaatgaacacgtttaaagaggggggctctgaattgttacagggcttggcaaaagccaagtgttgctaatatgtttgagcaaattggatgtttctgtggctttgtggacttcaggttggtttggggcttttgcctgttccagttaggctacctgccagcctttcagatgacaggcccactttcttgatttgctgttcgttgtgtattggttagccagtctgcctcagtagctaaatatgatgatacaattcaggcctgtcttgctgataaaacttttaactgatttacatttctttatgtaagtaaataatcagactctgactcctgtgatgctctgattttgagaatggtccatgattcttcttatatttttgcattttcagttcaaatgcaactgtattgtagttactggattatagtgtctgagcctttaaaaaaatcttagttaataaaagtatattttcagatataaaacctagtatccttatgatacatatctccttgtcactgaaggcatgttcagcctctgatgatatgttttgttttctttcagttaagtggtctttaatcgttttgattgtgtgcccatatcagttaaaacttttgagcaattccccttgtttgtgtgtgtatttataatttataaaaagtagtgctgtgctaaaatacattatagtattataaaacacaaaacaaaagacttcaaatggctaggatatattgtattccctaccttcttcctaaatgaactcttcatggttctgtccgagggcagccttctactttgccctaaatttcagttactctcacatattcgacattgccccagcctgtcccctcctccttgcatcaccactttttccccctgctcgatcgtttccaaaggctttctcatcttcaaaaagtcttctttggtcacctctcccagctactgccccatcatctgtccctccatattttcagtccttgctgtgttcacatcctctcttgactcacaccactctgatgaaagtgctcctggcaaggtccatggtaactcccatgatcctgactctagtggtcacttcttcatcttcctcacaggagctcttcagtttggcaccgctgatcatacccttttccttgacgctgtttcttcacttggcttccagggtgtgtatttctggctttccatctgcctaattggccattccttctcggcttctcatctccctgacctctaaacattaaaggccctgggcacctcctctctatcttctctcattctgtctgtgatcctctcctgttgtatggcttttaataccatctatatgagtgatctccagagtttgcttcagtgtaatcctgggagatcaataagattgaccatgagctgatcattgttgaagctgggtgatgggtacctgggggtttattatacggttctctctcattttacttatgttagaaattgtctttctttttttttttttttttttttttttgaggagtctcgttctgtcgcccaggctggagtgcggtggcacaatcttggttcactgcaggctccgcctcccgggttcacgccattctcctgcctcagcctcccgagtagctgggactacaggtgcctgccaccacgcccagctaatttttttgtatttttaatagagacggagtttcaccgtgttagccaggatggtctcgatctcctgacctcgtgatccacccaccttggcctcccagagtgctgggattacaggcgtgagccaccgcgcccagcccagaaattttctataatggaaagttaaaaagtctatatgctgttgacccttaatcatttgtctgcagcccaaactctcttctgaactgtagacctgtgtctccatctgcctgtttagtatttcagctttgatattaacagatatttcactaaacgtgtccaaaatggaactcctggtttccctccccaatatgttcttcctgcagtctccccatcccatttatgggaatgctgttcttccagttgcttatcgaaaacacctctggtcatgcttgatttccctctttctcatctgtccttcatccagttcatcagtaagtcttgttgactctacctgtaaaatatatccaaaatttcatctatcagaactacttccgctgccaccaccttggtccaagccaccatcctctctcatctgcttctttattgccccttagaggctgtagtcctccccgcagcgaaaacaatccgtgaaatgttaagtcacatcatgctctgctgtgcccaaaccctgcagtggcttttcttctctctcagtaaaagcaatcacccttactgtggtccataagacctcatagcttatctcatcactgcccaatagaaatataatgtaagctacacatgagggtcacgtaggtaatttaaaagtttttgataaaggaaaaatgaatggaaaatgaaccactcgaagttaattttgataatgtattttatttagcccagtatgttaacagtattttcacttctgagatatgttacgttgcttttgttttgtttgtttgttgtactaagtaatagtcaaagcacatctccatgtgaactagttgcatttcatgtactccatagccttacatggctagtggctgccatcttgcacaatacaggtccatacgaccttacccggctttattacgttacttctgtatctatctcctgttactgttttcaacttgcacttcgctccagcatcactggcctcctgctgttatttaggtatactaggcatttcctgttttagggcctttgtacctccagttccctctgtttggaatgcttttccccagatagccctgtggttaaatctcttacttcctttgggtctgtgctcagatgttactttctcagagggtcccccaagcccccagcattctctagccttccttgcatccctttcatgtagtgtttttttcaccagttggcatactatttatttatattagtatattttctctctctccccactggaatatgtgctccatgagagaagggatttttgtgagttttgtcccctgctatatctcagagcatggaatagtgcctgacatgtgtatataagagatggatatttgttgaagaattaagtgaaattatctattaagaatgattctttttcactaagaacattgcaattgagcataatttattatttcagaatagcttggtgtcatttgcagctagaagttctgttttgagtcaggatatttcaaaagagacctcacaatgatatgcagatgcccatggcagaaattcatcctggattatacttacgaaatcttgataacttgttttttagtcacatccactgttttctgcaaaggtttttgttgaaatccagctaatatatttcagtcagtcttgatatcaatcagttgttcttacaaactcattgcaaaatttaatacttttatatgttgaatttaataaatgggttcaagacccctgaaatacttcattttgggagattttaaaacaagttttgatgttctgttttgagtgtgtgcagataaggagattttagagatgacatccttacattgaaattggcaacattatcacataatggtagaaatgatttccaagtgcctgttttaaaagaacaatggctttcttacccattaaaaaaaattctactttcaccataaagatacagagtatttatttgtttgtttaaaaatacccattaagtagcattctacttactggcactcattacagaagaggtcagcacattttagaactcttgttttctggtttaaaaaaagtataattcctctttttttttttttttttttgagacagagttttactctgttgcacaggctagagtgcagtggcacaatcatagctcactgcagcctccaactcctgggctcaagcaatcctcagccaccctggtagtgagaactacaaatgtgctccatgatgcccggctgatttttaaatttttgtggagacgggggtcttgctgtgtttctcaggctggtcttgaactcctggtctcaagagatccttctgttttgggcctcccaaagcactgggactacaggtgtgagtcaccgtacctggcctgattcttctctaagctgagcaactcttagatatttttaccacgagataattagtgacaatgtggtcagatgacgttcgggtctcaccgtcttattacaaaggactgttgtttattgtattgaagatggtgtctctaactttgcttcactgggcagatgtaaactgtactaaatcaacaggcaactgggggtgtcactgtctacccttctgcatctggatctcctactcagacacaaggattcctctggtaccttaaatacagcaaccacccaacacacaaattgaaggagtgtgtcagtgtcaattcccgtattaaataatagtaaaatttaattttttgtattttggtaaagtataaacattgtaatattttcttcttcatcctagtggatctgcttatacatgccacattagagatgattgctctgattgtttcttctatagtaaccttgcttccctaacaacctttgattgacataaaggttgagtcttgtcttttctgttgtttatagtacctgacagtgctgtgtttcactaatatttgttgactgaatagtgctgaggagtgtcctgttctctgacctcagtaccataaggtcatatttcttggacaacaaagtccagtagcagatttctttggtggctgctagagccatttcattaacagtattgaaagcttttgtgatattagagaaacagctctgtggtcctgttactgttggctgtgcatccttctgcatctgacaggtagaaagggatggtggcagctctagtcactgccatgttgtgatttaggaagtagatggttgtgttcagatgctctggaaatgagctggcagagattgctagaagagatggctgtggtatctagagcagccagctctcttcttcatgagaggggtatatgtctttgatgcattgtttgatgtcttccatcagtttacatgctgaaagtattggtgcagatatctgagatgtatgcttctcctccacctggatagtccaggaggtaggtcagccagacacatctacttgggcgttgtttttctaacttccctgactgcatgcacaatttgaaagatcagcagctggaatgagaactgcaggctgtggctgaggaacagaggccccatgctctctttgctgcaacagagacatctcccaaggtcccctggaccctgtgttgctgagtcaggcttgccctggtatgctagtcttgctgcttggaccactggtgagcccatcagcattcatggattgatgtgcatttacttaggatggcctctgtgaaagattctgtgtctgtttctctttttggatggagtggggtggggatggagaaggaataagtgaggtagacagataccttcacctaaaatagtgtgtaaatgtgacacaaatgaagtgtaagaaactgttgtattagccttaaatggggttgggagctggaggatgtctctggaaacacaaggaagatctcatccatcttgtttatggctgtatcctcagagcctagcatgatgcttggccccatcaagtgctcagtaaataggtgtttgttaataagtaagtgttcaaggatgagaggacttcacctgaaagttcatgccagaccaccacaaaactgaaggaggaaatggcttgttggcagaaggaggttgggatgttcagagagagtgtaagtggcagaggaagggctgtgtattggagaggtagaggcagtcttgggaggccctcgattaactttctaagaatttggttttggtggctcttaacttattttcctgccagttcatattagaagttgcatggaagctatagtctctccaggagaaaaaaataataaaagccccaatttggcatacaccgtcagaggattcacagatcccaagttataaaaacctgttataggggccaggtgcggcggctcacacctgtaatcccagcactttgggaggccaaaatgggtggatcacctgaggtcaggagttcaagaccagcctggccaacatggtgaaactctgtctctactaaaaatacaaaattagctggatgcggtggcgtgtgcctgtaatcccagctactcgggaggctgaggcaggagaattgcttaaacccaggaggcggaggttgcagtgagcggagattgcaccattgcactctagcctgggcaaaaaagagcgaaactacatctcaaaaacaaaacaacaacaacaacaacaacaaaaacaaaaaaaatcctgctataggctggtgagccgtcaaatgctcactgcgctcttatggtggtgataagatgctttttctcctggagtctttgggacttgcccaaatgcactgagtggacattctgggtttggagggcgctgataagcagcaagcatgacagtggttccgaggagcttgggaaagcagtggggaatgggagtctgcacactgacacaaatggagagatccagcgtttgctccacttagcaggggacaaaaatacctgttctattacttggaaaaaataaaaaaaaaataacctttacaacttactgattcaaaatattgaatgcttatgctaagtttttttctgtaacatgatttccaacttagatacccacccaggccataatgatggattcagagaggcagcatgttacatttgtgggaatggtgagtgtggaaaggagtcattagagttttatattaccatggcatagggtttgtagaattccttagctgtcctcatccatcagggagggctgtctggaggaggaggtatttcgcaggcctcttggaaaagcaggaagactgggctgagggaggtttaaggttggattgtttttttttcctgacattaaaaagattcccataaaatgtgtatctgtaccatcagttaaaaaaacaaaaacaggccgggcatggtggctcatgcctgtaatcccagcactttgggaggctgaggcggacggatcacgaagtcaagagatcaagaccgtcttggccaacatagtgaagccccgtctctactaaaaaacataaaaataaaaaaattagcagagcgtgcctgtagtcccagctacttgggaggctgaggcaggagaatcacttgaacctgggaggcggaggttgcagtgagccaagatcgcgccactgcactccagcctaggtgacagagcgagactccatctcaaaaaaaaaaaaaaaaaaaaaaaaagatgaaaaacttcccatcctccaggcttttgtagcacatctgatatatagataggctgtttggaggggaaaaaagccaatgtgggcagcacagtgctggcatttctgcctttgtgtgttataggtaaattcctttagtggagggtgaggttgaggggtggtgaggcaatgcttgatcccagtgaatgatggtgacaatcagccctgcactggcttgtgcttaggtgctaggccagtaccaggaggcatcactgcgggtgtggggggagctcctgcaccttgagagaggtggggcagactggggctctctgaggcagccacggcttatgcatattgcagagaaaggactgggcaactgaggttccaattttctcacctcactcattggcttagcaggaattttctttgtagggaggttagtctgtgagggaattttaaaagttctttcaaggagaagagcctcttccatttcctgcagagtaatgttcaaactgcaggtccagaggccataatgggtgagatcaatttagcgggttgagaccagcctttaaaatatatatagaatagaaaatattagattgcgtagtacgtagtaaagatgagtattatttcatgaaactttgtttcagttatatatatagagagagtgatacatatagataagtgcacatatatgcctgtgttgggctactgcataacattgatttcctactatgaatcagggtccagaaaatttgagaaacattgtcctggaaggatttctctgctcttagtgtagacagtgggttccagccacttccccagaggccatctctatggagacagatgtggtgagagggctctttttaaagagcagccagagtcagcttctgacagcatgatcctaggcttgtctgcagctgttcacccatgcctggtgtttcctgctgcggaggagctagggagaaagatcaggaaaacctcagccaggtttaggagcaaaggtcaccttccctgtcttctcaccagggtatgattccctagaatgcagcagcatatccagccccttccctcttctcttggttcctggctttattaactgtctcttcgctttaaaaaaattttatcttttagcagcaaatttccttcttccccacataccaaagccatagcaggaagaggaaggccatcccgactgtggttttgtccttatattctctgtttctcaggttcgttgcctagggagggtggagtcccggcgatctgggggcagggtgggggtaggattcgtggtgcatcagaatgaacttcctgtcacctcagtgattccacttagatctgtgattctctggctccatctttccccccgaagaagaagagcctttcttgggtcatagttgcctctccttccaccagctgcactgaccgacctgcagagtgttgacccacttgtcgtacctcaaatagaggtttaaattaggacctttaatctgtaagaggcttacagcttgttgggtggccagctgctctggactcccttgtgggcagagctgggtttttcctggctcttttggggtttagggaatcatgggggtcagtggctttctggcaggagccacaggctctgggactaggtgggtgggatctcttatgatggagttgggtggtggtgtgtccttgtaatgatggaatggggagctgggccagcaacttgggtgctgggcctgcttctcttggacactgagcctggattcttgctgatgtgcagttagctttgctggctcaacatgtgttttcatttcacagatattcattaatccagagttgtgtgcccagcatggtgctaggtgtcatagggaacacacagaagcatgagaatcaggccctcctcccaagttgcttatttgtagcctccttttgaggctacaaggctagtccatatcaaagcattcattcatcctgtagaccgataggtatggaggggaagtattattggagagacctcagggttttctcacctgagaagggagagagccctggggtggtcagagctgggccctgagtggtgggatttagaaagaagggaagaggggagggcttggaagataggagaaacagcatgaacagcagcagggggaatgggtgagtgtcctcctgaaaggactgtggagatggccgtggagcctcttcttgcccacttcctgagatggtcatggcttagtgctagagacttttattccttgggcaatgtagacccagctctatgggttccctgttttttccttctcttcctcctcattataacagataataataatgattcctagctttcagggaacacatcttgtataccatgttctgtgtgctttacatggattgtctcattacagcttcacaacaaccttagagatagatgttctgtatcattatgtgcaccttacagttggtgcagctgaggcgtagagaggttaaataacttgcccttggtgggtgacatagcaaggcagtagttgggtgaggagtctaccagggcagcctgaaaggcggaactcagtgacagcagcagggcatgctgttaacccactgcttcccactcgtctgaatattagaatcaccttggaatctttcagaatttccaaatcccaggtcgattacatcagagtctcttggggtgctgggacacaggcatcagtttttgaggcttcccaggtgattccaatgtgcacccaggtttaaggaccactcccttaaccttctctgttttacagcctctgaatatttgactgaatacattttttatctccaagattctccaaagcactgcagaggggccttcctccagtcctaccctgaggatgtctgtctgtccacccaccatgccatatagtatctgagggagtaggacccctgccaccccacagcatctgtgacccccaaagagtgaaacctaggtggtgtggggtgatcttcctgggatcagtggcccttctcactctgcatgccacctagagggcagagcctgcttcagagccctggagacctccaactggtttctcacatcttctgctccctggggcccctgacttcagcggggaagggagagggtcacatgagggcagatctcttctggacaagtcccattcctctctgtctgtccctgactgaacctgaaatggacacgaagagcagagtcgtttgggtggctgggaacagcactaaatttagcaaaactgtagctggtggggggccggcccagagtgagccaaacccagccctgagtggactagatttacagtcagtaacacagtcagcatcatctctgcttgggaaagtgtgtggttacacaggatcttccgttttccaaagcccagaagcttgtcagcctgtcccacaggcctccctgactctgtcccttgaagacttggctccacccccaccactgatgctgtcccttggacttagtcttccatccatctgtctgtctctcccttgtgtgtctggaatttccacttcagtaccttcaccttcttttatgcctcttagccaatgctgccaaccttgactcccaaggccctggagggcaagaccctagcattggtagattttctttagggcatctggcaccaaggacacctttcagtcaaggtggacaagtggaggaaagccaggagctgggatggttagtcgaacaagtgttgagggactgagatgtactttccctcctcccagaaacttagccacgtagatggtatttgtatacccaacaactgaagtgaattatgatggggacacagtggctgtgagactcttggacagttgggagtttctctttggttggctgagtctctgccctggtgtcgatgtatcttggaagaggtgggttttgtgggattaaagagtggaggtctgtgggtgacaggacatcttcccctgctggctccctctcccactcctcagatctgatggtggtgacttgtctggaggagcttctgttttcttaatgccctgggagataatgaccaggctaaatttactcaactctttacaaagtggatgattacactgagaggccaggactgggatcatgcctatgggagtgaaggcttcagggctctggcagccactggaaatttaagccttggattttgctgattgggaactgtgtcatctccttggtcttcttggttttcactcccttcacccaggactaggatcaaacatgatttgttagtgtagggcagtgggtctcaaccaggggcaattctgtactccctagctctggctcccaggggacagttggcaatgtccagagacattttttggttgtcataactgggctgcaggaagggtgttactggcatctggtgtgtagaaaacaggtatcctgctgaatattatacaatgcacagaacaactgtccctacaacagagttgttggtccaaaatatcaatcgtgctggggttgagaaaccttggtatagggggacagttttgcagaaatggccatgaaatggccaatgtagaaatgaaatggtcgtttcatccagctctctgcatctgttggaaataacttgaaaccaggaactattgagtcattgccttcttcgttcgtccactgctcccctctctcctcagtatttatggggaaccttggtagtgaaatacttcggcatctaacaatattgccttcaggaagttgtttccaagccatcgctaaagctcctgtggtccagtttcccatagaatccccctgtaagcacacacgtatcccaggtcatgcgggtggctttgtgcagctgtgtctctggtgcacctaaataagcctatgatttaggtgttggtacctttaagatgaactttaagggcaaccaggaagccattccaaggaggcttcatgtgggaatgatcagagtctagcctggagctgttttccttctctttctctctgtagctaaagtttgttctgccttgcagaactgagttctgcttgctaaagttctcttaaactcaggaaacacatactcattgccgtggagaacatgatgttatttcccaggtgaaagactcaacctgtggccagatgcctgaacagcctggtgcatctctcatctgccagcaccgttcttctgcagttggcagggctgctttaaggccagaacagggaaatgagaagtctcccaaagtgaggacctttgcttgctctagatagtgaagggagggtcactgtgtgtgaattctagaatgtgctgacttttaaaaattcacgacaagtttcaaggttctctccatgtgaccccactacctggactctctaatcgtcatgtcagagggtgaaggtgtgagtgacactttatgatttggggaaagaagaggtggtgggagtggtgagagaggagattggcagggagagggatagatattctcattgggtgcatttgacatccttgcctccagtttgcgtctcagtgttgttcccctggccacaaaacttattcaaagtccctgtttttgaggaggcaaatacatacatatatatatatatatatatatattttttttttttttttgataagcccaaaccagacagtttaggaaggtcattctacttaggaggagagtaaataacattttacaaatgactttggagttgcctgggtttttttctttttaaaagtctccctttgctagtggaagtcactggggaatggatgatatggcaagtgcttgctgttcttggagttcgggttcactactccccttctcatgcaagggactgagatggtactggtgggctcaggagccaggttctagattactgctgtcttagctggcaactagggcagtcgaaaccaaaagcctcagaagtcctgttcaatgagggtaaatatttgaatggattgaacagatgagtgtgtgtatatttagaaactcacacccagtagagaaagaacctctgggtaagcccggcttgctcatccctgctgcaggtcagagcacacccaaggttacatcctcttattccatgatcggctgaagtcacttccttatgtacccaaggctgcccacgcccagccactgtttcctgagccgggtcaggaagtgcagatcactcctctcataacctcctggtagcttatagtcatcatccagcagcattctggattcttttgcctgtgtctgagtctccacacttcagctgccatcttgcccccagatcctgagcttgtctttgagtccgtagcttcagcttggacttcctggcttccaggcccagagttacttcagggctctggcagccactggaaatttaagccttgaattttgctgattgggaattgtctcgtctcctccatcttcttggttttcactcccttcacccctggcccaaccacttctgtctcattaaaaatcttgtttcttataaaagttactttatatttcagcatgcatttataaaacccgaagacattttcagacggggtctcacagaacataaagcttgacaaatgaatttggagttttgaaaacatgtttattttttatggtattgaagctttgtagagtaacatttctgccatttattaaaatgcaataggaaaatgctcagaaatatgtgtgtccttcagattttgtgagcagagagtgtagacactaaaattcattggtgttggggaaacaacccattggataaaagtccattttctcctagattttttcttgttagcgttttttttttattagtcgtattaatttttttttttaagagacagggtcttgccctgctgcccagcctggagtgctatgatgccgttatggagtgccactgcagcctccgactcctgggctcaagtgatcctctttcttcagcctcctgagtagctgggactacaggcacacgccattgcacctgggtagtttttttttttttttttaaatagagacgggatctctctatattgcccaggctggtcttgaactcctggcctcaagcaatcctcccaccccgacctcccagagcactgggattacaggtgagagccactgcacctggcccttttttaaaaaattaatattgttattgacgtataacatgcatgcacaaaagtgaatgaatcataagtgttcggcacaaagcgtacatatcctgtcaccagtgcccagatcaggaaaagaaacagaacactaccaaaccaaaccccgcagaaaatactttgcatttttttctagttacaaaccacccttccaagggtaaccactattttgaatgctacaatcacagattggtttcacctgctcttcaacttcatataaatgaaatcacacagtatgttctcttttggagtctggtttctttcactcatcattttgcttgtggcattcatccatgttctgtgccattgtagttttccattctcatgactgtgtagtattccatattaatagaccacagtttattatttgtataccattgatggatatttgggctgtgtgcagattttggctattacaaacagtgctactgtaaatatgaatgtcttggtgaatggatatatacacatatacatacctgaatgtatgtatacatacatatacatacctgaatgtatgtatacatacatatacatacctgaatgtatgtatacatacatatacatacctgaatgtatgtatacatacatatacatacctgaatgtatgtatacatacatatacatacttgtgtatatacatatatatttctgctgggtataaacttagaagtggagttgctggatcatagttttaatagtagtgccaaagcagtcgtaccagttatactcacactagcaaagtaggcaagttctggttgctccaaatttttgctaatatttgatattatcttcctttttcattgtacttattctggtgggtatgtagtaatattgtactgtagtctgaatgtgcgttttgaggatagtggccatttgtgtatcctctttgcaaaatgcctcttcagatcatttgcttatttttctattgggttgcctgtcttaatggtttgtaggaagcactttatatattgttggatatacgtattatgaagattttcactcctcggtagctttgggtatccatttccttagtgatattcctaagtttaacccatgtgaaaatattagaattgtatatagtgctttgcacaggaatatattattctttgttagctatgttgaagttggggctacatgctatcactactcatctacaaaggtactcttgggatactggttatgcaggctggagcagggactcttgaagtttctggcatattaagtgctggcatctttggggttatataaaaataaaaactgctaatatccaagtgtttactgtgtgccatatagtgttctaagcacttcacatggcctagctcatttattcctcatataagcttatcagttaagtgctattattattcccattttcgagtgaggaaactgagactcagagaaatcttataattgcccagggtcacacaactgagattccagttgcagaggccatactcttaaccattgtaccacatagaaagttgcatttccctaaactgctgttttattatagtgctggattagtggctggcacatagtaattgcacatggtaaatacctgttacatgaaagaatttgacagtggtaagttaacataggtcttcattaagtgggaaaatttgccctggcaatgggatatgttgacattggaagcagttgtgtttcatcctcatgtatctcttacctggagcagtgcctgtcttggaataagtgtcatagtgaacattttggagtgaatgaatcaatcacaggcagattgcggaccctgtcgtagcagatggatgagctcagaggacactacaggaaccagggccaaggcagggccatggtcggggccatggtcatggcccagggagaattcacagtttggctagcagcatcctggttgtacagccacaaggcagcccagtttgtagtagcagaatagggtccagtgtcagcaggcgaggctgtcccagttacaggcagtcaggtcagaagaggtcccagcaggagtgcagggctggcaggattcaaggtcaggtaatccaaagtcacaaggttacaagcagtaaaagttcaggctggctggcgagagagccaaggagctcctggagggagctgtcgcccgggctgggctcccctcctgaatgaggcctttcttctcaggctgctcagagtgcctgagaggaatacaccagacctcagggcaggctggggagggtgaaccggagacttatcctggtacggagccagaaggagccttcatgaatgtcttgtcaaactcttcatttggtgagtgaggaaatcaaagtttaaatgagaggttattgagcaagtggtagagccaacgctggaatcaggccctgtagagtttttcccacttcctcgtcttttctatcaaaaatgaagaggtgatgggaattgtggttctcggaaggaggaagcactgaggtgcaagccttagagaggaatgatggagagcacttggatatggggcaaaaggaggaattccaggaggactgcacaggcctggagactggcggtacaggtgatgggaatttgaaggaaactgcttggatgatgactgagatactgactctagaatataaattccatgatgacaaaatctttttcattttaattgaagcataacatacagaaaagtgcatagaaggcaaggacttaacatttttttattgtgctaaaaaaacacatagcataaaattcatcatcttacccatttgtaattgtacaattcagttgtattaagttccttcgtggtgttgtgcaaccctcaccaccatctgtctccaggactctattcatcttacgtaactgaactctgtgcccattcaactgccttttcttctccccacagcccctggcaaccaccattctattttctgtctttatgaatttggctactcttaaaactgcatgtaagtggaattatatagtatttgtctttttgggactggtttattccacttagcataatgtcctcaaggttcatctgtgttgtagcatgtgtcagaatttcctccctctcaaggatgaatagtattccactgtattttgttcatcgcttcatccattgatgaacccttggggtgaggacttttacatggcttgctcaccagtgactagaacagatcctggctttaaaagtaactcaacaggtaatagttgaatgaattttagttatgttgaacgggaggtgatagtgggacacccaagtgggctgtccaacaggtattcctggatgtctcaggactaaaggttggaatcgccttcatgggtagggggtaaagacagtggtgtgaaggtgctcccagggacggggttgaacaataggagcaggggcctggggctagcacaggtgggaccagagtcatgacagatgcaggaaaggtggtctcaggacagtggtacaggccagaacacgagatcaggggaaatgtacccagtacagccagagccattaagtgctaggcagtaggcaaggcactaggactagcaacacgtgtgaggcagacgtaaagattcatcagcacaaatcattctaaggcctcgtggaagtggaagtcttgaacttgagtgtggacttgaaatacagttggactctgcactatgaagaggagagagaaggacaccacaagtgagaaagcgttgagaaaaggagcttggtggaaagaatgggagggtacagggcacaaaaggagaccagaatgatgaggcagtggacttgcgggggacgtgggaggcagggtcggcacttcttttatttctttccctttaaagttgatcaagagttggcagttgggaagcttaagtaatctacatctaaacactacatctaatgtaactcctacttaaaattactggacaccaaaaaatccccaggcaagcttattgccctgtatgtatggtagaatattgtaacatggacagtggtagttgtaaagacctggttgcatgtgacagatgcacttgctcaaatatgagtgtggcgatttctcagtcacatgctgaaaaatcaagagcctctagtcaatttaaccagtattcactgggctgcagctgagagccctgcttaacactagatgctgggatagaaagacaaaaaggtgagattaagaagtaagagttaagcctgggctgtacctagacttacctgagttttagagaccttcctttccacagatattgggctgaaaactgagaaagtggatgcctcgtctgctcccatcttactctctgcagcttcctacacaactgctgggctcccaatgctctgctctggggccaggcaaaagtctgtactctcatgcatacgcacttctgaaaaagcggcttggtaacttcttaggtacacccacaaggttggccccagatctcaaggaaatcctcagaaatggttttgaaagataatatccagctaactcccccaaattcaggatccctagaagctatttatcttctagggattgcctagagtattcctacaggatgtaaatgaaggatgcaagcacgtggagcatgagtattctatacagggaaccagtcggatgccacccaccagtgccagaacgaaggcagagagcatggggttggagaggccagagaccctacgtgcttctgaataatggggtgtccctgccagagctaggaagcgtgaggtgtcaccctaccagcctacagctctgagtgctaaaagggaatccgggaccctgaaggaagctttgagtctctgggcttgtgcctgtcagatctctgacaccactatttacctatgttccacaataggttaccttagcattcagcttagtctggtcttagcatctaagagacaaggtttcagggagccttatgtataagcaataatgtagtgatgatgctaactttattaagtgtttagtgtgtcctaggtgctgttctgttttctatgtattcactcatttaaacctcacagtaactctgagataactgttatatttgacagatgaggaaactgagtcacagagagctataatatctttcctgagatcactcagctagtaataagcagagacagaaattgcaccggtcctgctccagagtctgcattcttagggaaacagctccagtgggatgtgtaggagccaccagaggccagagcagagaggtcagctgctgaccaatcacactcctagatccagtttctccctgtcagagccagctgcccctgctgcttcagagagggggctgtggccctgttgttttacctaggtttgccaggaggattattagcctcttcctcgtgtcaaaacaagccaagcaggaaaaaaaaccaacaagcaactcatgacttgcagcagaaaaaaccctgcggtctctccagcaggaggggagacctcagctgcaggggcccgaaggtcccaggttacaacctggtcttaggcatatattgctgagaagggccttgaggtcccctcgtttcagtcaggatgctgaggcctggctcaccataatgcccagtctccacagcagcctgccttctctgctctcctgctacaccccgggaaatttaatagtgtctcccagtctgctcatgggaagcccggaggcctacagtctttcccctagttctgctgtgagctagctctgggaccctgggctactccagtttcccatatgtaggagaacaagcttgaatttgagcagtagtttccaaataaataaataaataaataaatatatatatatatatatatatatttttttttttttattgcagtggaacactttcttcaagcaaggtattaaggataggtacagaatgtggaacagttaaaagcagaagtgtatattttccaaaaaatggaaaaaggggaaacaaccttagggcagtcagacttctctatgaattcctcccagagcctgcagggttctgctgcatatgcactcctgccccttgggttgcctttgctccttcattctcatggaaggctttacattcttcagagcctccctcagcttccatctccttcgtggagcatctgcctgcagtgacttctgcccctttctgttcctgttatacatatttattagctatttcaatcattgggctcccctatactgcctagtgatgggcttaaaaaatttataacacatataatatttacatatattgtgtataaattagcatatacttatatatttacatatatgtgtatgtatgtatatgtatgtatacgccacacatgcatacacacacatcctttaaagagagaccatgtctgtatgtcccccatttcctggtacataataaatccctaataaagatttttttaaaaaaatttttatttgctcacatgctcttgctcagacaatacaagtttttaatcatggggattatcttccttgtcctcccacatattttgccaggtcagtactcagtaaatagtagtgttaggtgattgtacaatatggtttattttgttcccaggaagtcctggatttgaattttagttctgccatatactagctttatgtctataggaaatatacttaattcttcttatttataaggtagaaatgataatgcatctattccacaggtatttattgggtgcctgctatattccaggcaccattctaggtactgggaattctgtagtttataaaacaggcagaagttcttgtcctcatggagcttatattccagccagttttcaggaagagcagcacagtgttgctggaacaagaggaggaggaatgaatcccttctgcttggtcagtggtggaactgcagcctggctggaggctgcccctggtggcctctgtggggcccagggactccctgggtagtatagaatttctactgtgagatgaagagaaaaggcccttgggtcggactgaagggacagtgagctcctctgagccatattgctgtgcctgaccctgaagctgtacaatatcccgatgcccacagtgggaagggggaacagcactaggtggagatgcccctgtctagagactgggtcacagtgccccgtgccctcttgcgatgtgaatgtgccagcatcctgctcctgttcccccgtggtatagtgaagacttgcctggcacggacatagaggcatcctgggctgtcagggatgcatggaatcttctagccatgccgacacagccatgcagggacagaaagaagaaaccattccaaacacctcagaggtcccttcctcagcttgcgctagaggcaggacggtggagctgctgagcccttaataatatagaattaagtcctccgactacgtggcctgggggaaagatagatgttgagtggatctgctgtgaatttgagtttccatcccctcacactgtgacacttggctgttgctcatgtacgtctccccttctgcttgtctctttcttagaaggagagagggcagccttgggtgatgttttgttgttgttgttgttgttgttgtttgagacagagtctcgctctgtcacccaggctggagtacagtggcatgatgtaggctcgctgcaacctctgcctcccgggttcaagcgattctcctgcctcagcctcccaagtagctgggattacaggcgcccgccaccatgcccagctaatttttgtatttttagtagagacagggtttcaccatgttggtcaggctggtcttgaactcctgacctcaggtcatccgcccaccttggcctcccagagttctgggatttacctcctgctttaagtacatcttccatctaggaagcgttagcttccaggatggcctcttggggaaatagagagaaggtgccttggccatggccatcctggatttggcttcatccatggctgtggccacctctgactgccctgctggaccgcagcacccactcccagagatgctcactctccgtcgaagcctatcacttacttagggtgattctgagtaagttttacttgacctttgctatgcttcagtttcctcatctataaaatggggctgataataatcatacttacctgatagggttatttaaagaatgaaagtgagcatgtaaaaggctgaaaagagggtcttgctgataggaagtgctctgtatctgctgttcctgttattactttcacattggcttgtttgagttgccctatgaccacaagctcattgtgggcaggatatattttaagtatttctgtagtctcagtgcccagcccagtgcctagtacatggtaggtatttagaaaatatgtgttgaaatagctgtgacctctggatttagactgagctgagagggaggactcaccatatgcagaagcccatagaaaagaggcatatggaaggggcagtgaggcaggatcagaaggtacaggacgtgggaggatagtgaatcctgaggttgaaggggtagattggaaccacatgccacaggatgctgaggctaggtgctggggagccatgagcagctttagagcaggggaggcatatgatggttcagaatttcagagaagatactgatggcaatatctagacaggattggagaagagagcctgaagctagcagagtggccagttgggagcctgttgggaacacacagctgggagtcacaagctgcgtgggcagcagcgtcctatctgctgttctccccctccctcctcagctcagcgccacaaggaaccaggccagcacgttgtgaccttcccccgtccagccctgactgttcccagccctggtgcttgtctatttgcatcctactcattctgacacacctttcgtaggttgccaggttaccgcagccctgtgctttgtaaatccttgtgccttagcttctacaccacttaattcccccctcactctccgccctctgtatgtgtgtgtgtttattatttttatctcgaagtgggaatcagggaggctcctggaagtaggccatgcccttttatgtggtcttctcaccaaggacatgcatgttcccaagccccgggagcagagacccagagccctgggaaggagtggtggttgatgcaggatgtggagaaaacacagacccctgcccttgggagccacagctgtgctcaggctggcacagggcacgggctggcggccattttattcgtgtctagagactgcagctccgagccttcttctgtctttcttttgagtcctggaatgtgttcctcaggggtggacactgcttccttctagttgctgtggttgggagcttggctttgtcctgttattcttgcctacagctgtttgtgaggtacagtggctgggatatcaggaagttgctcctagtcaacctgtattaagtacctactacatacagttttgtatctcatgtccactataataggcacacagagagttaaggagatgttatagtcgctgcctggacagtggagagtaataaaaatcacggccatttattgggtgtttactatgtgttgggcatcatgctaagtactttgcatacattatcttatttaatccccacagtaaccatgtgtcacgcttgttagtagcactgctttagtgatacaagatgatgttaattaacttgcctcaggtcacacagccagtgtgagtctttgtgactcccacgctcccactctgaatgccaatgctgtgttttctctcaatggctaggtacccaaaagtcaggatttagcctttgggagtcctgggttcaatttgttgctctgctgcttattggctaagtgatcctggatgagtctcctagctttcctcatgttctcctccgtaaaatgggaataattgcatgtacttcactaggctttgatggggaatgaagttaatttgttacaaaagcactttgtaaactggaaggggttaaccatacatttcacctcatttcaatgagtcagtagtaaaaacttgtttaaaaaatacttatgtacaaaaaagtcacgtgtattgggcctttttttttttccctaaggaaacctggttagccccaccttttatgccagagatggtcaagtatgacaatagagagtagttcatctgccaaggacaggcattaggaggaggtctcatcagaggagaagggatgtcatccacatgtacagcacagcggttaagagacagggctctgagtctagttaccagctgtgcctcctcgtataggctccccagttcctatccgtggagtagaggtgataacagtgccagcttcgtcccgctgtcgtggaatgctgaatgagctttgaggcagcacggggccaaccaccaggcctgacaacgtggcaggtttgtggaatgtggaagttgatgttcgtgatgaggaggatgctgcttgggcagataaaaggcaaggggcatgctaattgggggccttggccttatttgaaggatctcccagagggggacaaggagaacatagaggtctggtgggactgagggcagccttgggaggaagccagagccctgtaaacgggctctcagccagatggagaatctagttctattcctcatctcccaaagtgggggtcggtggtggtcagggccgtggggcccaacaagggctgcagggaggtagcctctgtccctggtccttctgcaggccccagggagatggctgagtcctggaggtcagctggccagcttccattctgtgcctgagcaggttaccaatcaccgggaggagggacgcattccacggtgaagctcagctttatcatcttggccaaggagcaaagtttactcagaaagagttcctgccattttttaacttgttacttggttctgcatatgagagagaaaaaggagatgggggagccaagtgttgggatgggtgtgggaaggaggttaaatgttgagattggcttgctgggacacatttcttatacaaaggtgatacatgacgactctggggatagcctacaggtaggcaggaagtggccagtcagttgtatctcagcattgtatgattccaaaaatgaggggtaaacttggtatttcgaatgtttagaagtaggcctcacggaagttgtgctgtgtttccttcctgtgttcatcggcctgtttgcccagtggatggttactggacatggatgtgcaccatgtggtggcttaaagggctgtaagacgcagtccaggcccacgagaagcttcctagcagtgaggctgttttataactgttcccaaatcatgttagctctggaagctatttcaggaacgcctttggttatgaaccgtatcttatatttaattttgattctcttttccctcctgtcctggattcagtagcagcatccacactgtgtgcctggctgtgtcgtaggtgttggaagtacttagaagaattaggaggtacttggtaaaagcttgttaattaactaaagtggggacctagaaccatctccaaagaacttttggtcttctcttgtgcagtcaagactcttcatgtctcaaaaggaccctgagcttctgtctggagcgcatcagaatctgtgaaatgcctggatctaggccataaagtagagggtttgtccccctcttttccttggttgctgtatgttcttaataacagtaagagttttagcccaccgcaggaggcacttgaaggcatgcaaagctccacctctccacctacctcctagggccctgggtggcactcctctgctcctttcctttcttcttctgttaccgtatcaggtaaggccactttctactcttagttgaaatttacagttggtagccatggggaaccattagagtctctggtctttgattccctgggagagggtgggtctgacagtggccttcccacctgtgtgatgaggacagctgatttctgtctcctttgttctcagcctcacatggggtcacagggaaaaggaaaacacataaaagatccccagggctcagatttggggttgcactgtttttagtccagagccagctgtccttggcatccgtcaggcagaggggtgaggtgattgctggtgtttgtgacactacaggttgagtgtccctttgatatttgcttggggaccctttccagaagctgcagttagaagagcacattcttgtttgatacatttagatcaaaggaaggagagagtaggagaaacctcagaggacctgtgtgggtgggcagggaagggattcacatcaagtgagcccatttccagtgtgtttgttggggatttaggggttgtcatgttgacaggcctaatctagtccaatcaggcaatcagcaagtattgattgagtgctgctagaagtatcgctttggcaagaatgaaaaaagaattttgaagcttgcctggaccctttctttgaaaagttcagactctaattggaggctacagatgagccacgtgtgacatgagacatgacagcctattatcttggctctaaattgtaacaaggggttaaactgttggcatctggagaaggaagaacaatcatggcaaacgtggggcctgcaggattgctgtctatctcatctgggaaagagtgaaggatacaggtagacatattgcttagtctagtagagtccatgggtctcagactcttgtccaacatcaagagtatcaaagcaccttctccttgctggagtttggccacgtggaaagaatctatccagctaactctcgaaaaaggagcaggtgagcattgggattgattcccagctaagggaaattgagcagattaatggagataatatatgtgaaatggcttagtgtgtgtcatacagaaataattcaacaaaggcttattggcagattcctaagctcaagactgagagggtctgaagaaggcacatagcaaggttttaattattgtgtgtatgggagggctgggttgggagttgaggggcaggggaagattaagcaagacagggagtgaggactcctaagggaggaagaaggttctctgggagatcagagccggctgccctttggccttctcaggccacttttggagggccgctccagttcctgatctcaattaggagggaaaatgtcaaactactagttgaagtacagagcagagctgctggcacgtgaagagtggttaaaaacatgagactgcgtggcccagagaggtagagattttggtgagagggggtttgctaggtacagtattgtgtgcttaaagcactgtcaggtgatgtgggtgtcagagttaccctgtggtacctcagggggcagccctggggccagtgggtagctgtgacagggaggcagacgttggtgttgggagctggattcctgtcttgctttatgggctgtgaaggatgtgagggagagaagatgggtgaccctgtcaggtctccagctccttccgtgggccctgtagtgtttacacatgagcgaatgtccaccatgcaggggtgctaataatgaaaacagtagccataactttccttactgaatacttgttgggtaccaggcactgttgctgagtgctttactcaaatagactctaatcttcacagcaacactgtgaagaggtatgatgagcttatcagccctactttatagatgagagaatttaggcaagacatggaataactcacccaagatcccacaccttggactctaacccaaggcggaatcttcttgtctcagtggaaggtgaggccagatgacattcagggtgtcttacacccccagggttctaaggccctgtcttgtggctcatcctgggctatttggatggggttgagagggtcattgggtttggggcaggaacagtggttacgactctcgggatgacctgactgtggatgctggtgctgccctcgaggtcagtgatagggctccgtgaacagggttctcccgctggctgttaggaaagggcctctctagggaagtgggctgggacatcccagcttatctcagcatctcagttcctcctgtcttccttcctctacccttatggtgatttagggctctcagaagctccagtggtaattttttcatgtcagcctacccagaaacttatatatatattttttgagacagagtctcgctctgttacccaggctggagtacaatggcacaatcttggctcactgcaacctccacctcccaggctcaagcgattctcatgactcaacctcccaagtagctgggattacaggcatgtgccaccatgctcagataacttttgtaattttagtagagatggggtttcaccatgtcagccaggctggtcttaaactcctggcctcaagtgatttgcccgccttggcttcttttggcctcccaaagtgctggaattacaggcgtgagccaccgcacctggccccagaaacttcttgattgtgtcatgagcgcactcagcctgtagatctctcctcaacccccactaagctctgcctcccaagaaaggcatagagcaagtgatgtccaagtgcctgggcctccagggccggcaagacttgagctgtcttgtttggggggccagggtgggattaaggagccagctgtcctcctagcatcttgctttcttagtttaccagcctctgctgaccgagggagttcctgccagccaagggtggagctccttaaaaagtgcctcgcgctgtacctgacacatgggccccaaacacattatttttttggaatagatcaatggccgttctttctgttggacccgcctgctttctaaatattcaccctggcctctgaaggttttgaagttttcagagggagagtgatggggtactcctctcacctccaaagtatgtggcgttggagaaatcttctaagtgtaatcttctgtcttttaaggcagagctgttgttgctgtgctgcttttggagaaagaacattggcctcggaggcctatgtcaaatcctagcctgagaataatggctgtccagtggtcccagggggtttcagagagctgaaccctctaaaagagtgtaattccaacacctaccttcagtaaataaatcaaccacaggactgcctcccacccccaaagattctggtcaacatcccctcccagtgcagaggaagtattcacatcatcaaaggttttgtggaactttacttttggtatggtttcacattatgaaaacgtatcccaaatattaactgttatgttttagacagtccccagctcctctcccacccctgaatgagagtctcggccctggaagttttgtccctgctcctggcaaagctggcactttgctgaaagctcggacctgcacccaggccatgcataatggccctggtctcttttctcctctgtcctaggctgcaggtacggacgtgcccctgcttgggggataaggcagtatggaaatgaaagttcaagtcagaagtgtttggggaatcccctgccccacttgtgtttatgattcctgctgtctagatctgactcagttaagtagagcagaagtttgttgtgaggcaggaaagcgactccatttttaagtcacatggtgctaaacccatgtggtcacacagaggtcagcacagacccataaatcatcagaggcctaggttcttcctaccctagagacatctcctcctgcccacaagagcagcagcagcgtctgagggcaccaacctgtgcctggagggagtctggccaagacccctcaatcccggccatgtctggcctggcacaggctacaggttccgctgttgaggaatggagtaatgttctcctcaagtccctctcacatggcccaaccacactctgtctctctggaaattatttccatccattggcagggccaagattttgagcagccagccaagaggcacattgggttactccctcagtcccaagaagactttgtcctcctgtattttaggcagcaggagctgtgaccagtggttagcagagtggccacattcactcagccccagcccatagtcaggatagcaggtgccagtgctattgccagtctgggttttgcttatggctgagttgtgagccctctggggtgggagcttagatttaatgattagcggcctaagacaagatagatgttttggcctgtttcactttcccaagaggtgatgggagccagcttgggcaggacattttggagcctggatttctggcctgagagacagactgactgtgtctgtccaggaaaaagcatctacttacaaacagagcatcctagtcacaatatctgctgttgcaggcctgaccttcccccatgcaaacatgcccctctctgtgcagcccttgggcgtatttcacacgggagtccctgttggtgctggggttcacttccatttgtgctgtgaattcagcactcaacttggcctttgcttgtcttcctttaccctgagggtcggggagccctgtgttcttggccagcgtctgccaggtcactcactctctgccgcctggctccggctccctgtctgtggcggcattctgagtgtgtgtctgcatttcacctctgccagaacctaccctccagcacaggctgtccccagcccttgcctctcggattttcacttggcacctggcactgcattgtgtccttggagtgttcgttgtcactgctgggccttgtttcgcttcagctcagtgacatgggtggaagtgtcatggtctcttgggttgggggaaagctcctcagtggctctggggtagttcctccaggagactggcacagtgtggtcttcatggctgaggtctgaccacaccatgatcactgctgttggtctgcaactattaatggcactgctccttaggagccttttccccatgaatgccatcagacttctactctatgagtaccatttctgtccccaccccaacatcgagcacattctcatactttttgtgattatatatacttagatttctgtatttttgtttcttcttgaagttgcttgatgttagaaattcatctcttccttaccaggtgttgaactatcccagtaatttagcttttacttggcttctgcaacctttttttctctaagctccttatctgtcttgggcctaccacttgaacacacttgatcttgtctacttatctcgtcaatatgaagctaggtatggttgtgtctggttagtacttggatggaagatctgagaatgctaggtattctaagtcttttgaggtgttggtaggctttttcttataccaaatgcaaaatctttatgtcaccattgttgtcattctcatcatcatagtgatagctgggattaattgagcacttattctgtgttgggccttgtgctgcattacttctgtatctcacatcctctccaagaaaatcccaatgaagtatagatgaagctgaaactagaaacttagaaaggttaagtaagttgttcaagtttatataattagtcaagaggctgcactagaattcagattcaaatctatctcattttagagttagagtttttaaccactaaatgtaatatttttgtttggtagttaagtactctataaatgttggttgaatggcaagattgctctgacagtccagctgttctccatggtgtcactaatgatgatgatagcacacagcattttttgaatgaatgcttgcagtggtaagctctgtactaaaagatatgcattagttaacccatttaatcttatagctcaatgaggaagattacccccattttgctgattaggaaactgaggccagaaaggccaaggtaacttgcccaaggtgacacagctaaatagtattaggggatttggatgcaagctgtctcctaaactgtgtgagtctgtactcttaatcactatgttgctctccacaaaaaaataaggctgatttttatttttctgtgcttttcttcttgctgtccccttccttagctagtgatgctatttctttaccagttcttgctcatcctattcattctcagaagcccaggctggagttctcttctcagactatgcatgtccacatcaagctggcttctcacaattggcccctcagtgtattttcctaaaccttacttgtaaacatgttaaaatgaccagatttacaattagtgatctacaccgtaatagcagacctatttgtttgtcttatttctaccaaagaaatggaacagggagctcagaaacagacctatatgtatctggacacctgatttatgatgaagaaggcactgctgggcagtggggaatggatggttattttaataaacagtgctggttcaactggatatccacaggaaagaaatgaatcttgatcatatacaaaaataaattccaaagcgatcatcaatctaaatgtgaaaattaaaacaaaacttcatctacaagatagcatagaatatctttataactttggggtagccatacatttcttaaagaagacacagaaagcactaactctaagggagaagactgataagttggatgtcattaaaatgaggagcttctgattatcaaatgacatcaataaaagagagtgaagccaagcagagaggagaagatatactcagtacctatacctggcaagtggattcatatccagaatatataaataactccaacaaatccatcagtaaaagaaacccttccccctggacagaaaaaagttccatactgaacaattgtgagttgtatgcagttttcttctcccagtgcaaggttctaaccagtatgtcctggatcactggcacagcctggtggctggccttgggaactgtctgatctggtggctcttggcattttcttttgtgtatggactgtgggcccttcctttcccatgtgcttcttcacttgctattggtttggccacaagaggctcctgtctcatgaatgcctgtgtctcttcctcttttcctttggcttgttaacttttgatcagttatttcgagaatatttctctctggcttcttccccccgcccttcctttttaatttccctttttgtaccttcttgtttagcctaaaaacttctggttgtaaaaaccatcctaaagtgtctccaagtctttgggggagtaggcttgttctctggggctccagaggcagagtggagacctgaaggctaatatttccctgcagagagatttcatctcagttgtgttccacttgtctgaaccctccaaaggtgtggtgggagttattgaatcaagttggggctagaccatgacttggtcacggtggtgtttgtggagggtactgtgtcttgaatgggcagctggattatgataagcccttccaatcttatcaccaaagccctggatggacgttttgtggatgtccagagaagcgctctcaactgggagacagagccagtatatcagcatgacttttctgcctagctggcaggtcaggatgcacacatattattactacttcagttaaatcacgtatacttggaagtcatttcgatacacctctccacctgcagccctcagggaagttttaaattttcctcattttcctctatgcttattattttcctcaaatggcagatgtgtgaggtaaagttttcctctttgggtatgttctttattttatttaattcctcactctggcaatgcttgctcttttttttttttttttttattacaaacgtattgtattttagacacattacaaccaggagaacaaactggaagctctataggtatgttctgaccattaaaatatctggacagtgttaaaaaaaaaatcaggagtttaacataaagctagttttccgccttgccctgaaaacctggatgatctggactctttgggtctctgttcccagatggtccccagcaggcagagccaggagggtggcccatcaggagtggcacggtccttccactgggcacatcccctccccaggccactgtactccttcattacctgcatggcccctgaagacactggagttgatgacttcctggagtggataaaatgggcttttgtgagctagcctgggaaccaagcagtatgtttgatattatttcattgcaaaagtggatctcagcttttaaagtaagcagatgttttaaatatcagcaatgcaaatttgggaatacttagcctcagctggaatgtgtgtgttctccatgatggactgtttctgatgcttttcctgtgctgtatcttggcttagcacttagtaggtacttaataaatgatttacctcaggtggtaaccaagcgcctgttgtccaccagctcccagggagtgaacagaaatgccatcttgctgtggactgggcctgtcagttccacctgagaccagatcgctgccagatttatctagaacatccactctagctctagataacagagattggaatgtgtcctctgcacagcttccctgtctggagagcgaggtaaagacctagaccccgtcgagttggccctaaagaggaaacaggacagggaggccggcatgaagccggcatgaagactgcttttctggctgttgcctgccgaactggagtttgtggccggtacacagtgcttgcattccacaccctgaacaagggcgggtcaaagttcagctcattcccctttaaagaaaaaaattctttgtctttggcatttcgaagttttgacccagatcagtcggaggccacggaatgctcatgaagtctggagagtttgtttagttcctgagtccggtagctgccgaggagccaaagagagccggcaacctgttgggcttgagctgaagccttgccttttcaagtttgtgctggcctggcctccccaagcctctgagggtgagtagaaggagccagcaccttttccccactctgaagttatctttaccccctgaaatcaaacactgcatgcagcaccctgtaaaactgcttccttgtaggctcgagcgtgcttgctaagtaaacatcctcccatgtttttggaactgaattcatttctgcttcctggtcatcccattcgggtttttttgttcttggtgccttgtagaatcaggttaatagaaggaagacctagaattgggcagaggtacctaaaatgactgttttaatcctgcctcctccagcctcctcatataactggctgttttccaccgcactcaaggttccctctttcggcttaaagcccccctctgtctctgtacaggaaaagcctcttccttctttcttgcctattaaattctccactctttaaaaccactccatgtatgtctgtgtcattttattcaaaccggagcaaaaccgaaaaccctagtgttcttccagtcatcaaagccgtaccaacggggtcatgggaaggaaaagatttagagggaaaatgaaaggaaacaaagccttgctgaacgtagtgttgtcataggtttttgcgagtcatagttggttcatgccgcacccctgagatggggacttatctttgcagggactcagcttagttttgctgcggtcatagactacagtcggcctctgtacaaattctgtggctttgtaggttcctcctgtgaccctgcctcgctttcgcttcgtctctcatgacttatttgcctcttctctcacttccacccacccgtaacatccccatcgccatggcagtgagcagccacgtcactcaccaagttcatggggtgatgggccagctctgtaccaagcctacttccctctagttctgcctcctgaaggaggaggctccctggcagagctcagagccctttgtttatttgatcctgggctcttggataaatcaggaatgtcctgacatgaacttaggcatgtttttcttccatggagaaggaaactatggcaaatgggatttaagtaaccagaggacctttctgggggacttgctttagtgccatcaaggccacgttcctttggtcatcagaccagtaggtaacttctttattggcatgctcaaccttggagcccagaaggtgtgaatttgaagcactttcccccctgctgggagcctggcacagatactctggtcttcttttaaaactgtgtagtgccatgcttgtcttccaagtggtccttctttctgccggatgaaactttggcccagagtagttgcttgaagaaggctgcctgggaagcagatatgggataaggtagctgcctggcctcgcattctcattcatcttcctggaagttgcaaggttcttgatgtcatagacttcataagttacctgacccaggacctgaatatctcactcacttctggtcaagtctaggctcatatggtacaactggttgtcgggaacctttctgcattctttggatgtagcagtgtgggaacccaacactcccttggtctatctgggtatgtagggtctagtgatttagtatctcagttgttcttggaagcatttttgcgtctggggggaggggcaggaaaatgttgggggctctttgcttgctgtagtggagacctgtgagtatccaaaaacaaccccactccatctctagatcattggtggaccaccccttcctggaagagtttccaggagtgtggacatccatgcatgaacattgtggaggggttgggggtcggctcgtggatgctcatcttgcttgactgcccatgctggagaggagaacccagtcattggccacttcaggtccaggcttggctgttgctctgttttgctgtttttcatgttgtcagatcttcttgggaacaaatgactcagcaacccaaatctctgagactgtgtggccaattacttgaaaagtaattgaacgtatttacctaggccctaaaattttgagcccaggaaggatggatatccagactggttttactctggattcttcaggctgcagttcaatttggtttttcaaattcctgccctgatagaaggatctcatgtgtggggtaggcaggcaatgttttaattacgctttttgtccttaagaaattccagggagaaaaaggtcctggtttttggccaaaaaggcaaaaaacaacagaaatcagctatgactgtaatcctggacttgtctgtggcacaaagagttaatgggacagtggtcagggtgaggaacattttttctcagggctggagaagcccatatggctcaagaaaacatgttgcaacatttagtacagggcagccctgtctgggcactgggggctgccactcaaagagttaagctactcttatgcctgagaaggcctcagggaaggagtgagcctgaaaggacagggacctctatgccccagagcagtgaggtgcaggaggggtgaggtgggagggtgtgagctgaaaagtgtggccaaggaagcagagtgtaggcccaactttttttgccttgtttgaccagccttggcactgccctccggctctccaggggaaaagctgcagttctgctcttgcaacacaaggagcagactggagaatttagatctgcgtcacagagctgagagagagagagagagagagagagagagagagagtgagagagcgagcgagcaagcaagctccgtcgataggtctgctagcaacagccgtgctgcagcagagagagagagagaaatcaagaaacaagtcatagcaacaccgggcaccaggttctgccagctcacttgctgagcgttcagagatctgtcagggccagaggcctctgggtagcctaggctaggagatgacacgcaaggtggcacgggcggttcccgtggggaggaggtggggtggtggtggggggcaggggtgggagcaagaggttgtggggcgacggtggagggtttgatgggaccaaattctggaacattcgggactgcggcaccttacggcgggaccaagatttgggtctgcgcaggcggcgatgggtggtccgacgggcttcaggacttgatggcgtaacccccttcttcccccacgtatgtatttgctgggatcaggggcgctgtctctgtgtatgtgggtgctctgtctttctcaccttctttctcgatttttgctatttatttctctgagggagggttttttcccactttaatttcttttccctagtgtcagctgctcaagcctgaccagggtagaggtgagaggagtgaaccatcccctgcttcccacctgacctcccagcttttaccctatttccttctagtggacagacagactggttctccaagttgtttgggtgtcagcgtccatctgtctgtccgtgcaggtcttatgtggaaggtaagggagtgagaagtgccgaaaggaagacagagggacagttttttcccaggggttgccttattgaaaggtctggccctgggattctgaggctggtggggagccgagtggccagggtggggtgtgggctgggagaagtggggtaaagctggtaggtttgtcactgcgtagttgggaaaagtggggaatggtgacgcagtcactgttgcatctggttaggagctctatggggacaggtagtgaggctcctggggtctctgtggccagctgagaggggttaaggatgagctaagaagggaagctagcatttagagattaaatgtcatccttttggcgttggaaagttgtttaccttgcgctctctgtgtctccatgttggctcccttccagttcacatgtgatggccttccctgtactgctgcatcattaactaagtgactgagctggccttccattggccaggggagggctctccctccagacacttcctctgattggtgggtgggccaatggcaggtgaaaagctttttttgattggctcagggcagggtatcaaatctgaatttgcatttcacttgcttaaaggggagcggggagaagcccagcagctttctaaaatctctttaggggtgtgcgtaggctcctgtgtctatgcctgcttttgactgcccagttgaagcctcttcctatgccttttaaaatttcacgcactataaggaggaagagctcagggctcccaaaactttttatttagagggaagaatgctagggagatgggtatgcagagggttgaccaaattggaagaaaatatttattctgtagtttggtgttggaaaagggaattttccaatcagccacacctcagtgttgcggcaaaataattcttggctcccctggaaacgcatgggcaaggtagggcagagctgctgctgctgatactgccaccaccctgggcttcctgctgactctgggctactccctggggacaacagatttgcattgacgtccggggctgtccagaggccctcaagagccagttgtgagctgagcccagtatgggaaagatctaccttctggaagctactactacgtggtgcttggaaaggtgaggatgggggactgaccccaggaaattgctcgaaactccgcatctggtgggatttccagaaaagtcagtgggagacgggaggtttggaggccccgggttagaaaggtttgtcagtctagggaatgaggagaatcagaataaaactagggcagcaggctgtccgcctttggttgggggagggaggcctcgaaaaatcagggtcccggctctctaacctgtctttgtcgcaggtctcacgtttgtggggagggggtttaccaagccctgcgccatgcgcagtggcccccacccgtgactgcgcatctggaagcgcagtgcgccctgggtctctggcctaggacgagcaccgcccttcttattacataactgagggcatggcacgcgccttctcggcccttccttgcaaccctaccttcttgctccccagggcccatagagctggggagggtctgactgggtagcagtgaaggactgcaatccctgggagggctaactcttgtctagttactggcaggagccaagcttgaggacaaaagtggtggttttctagcctcatcttggggaagaggctacagaacatccttctgagtgccccataccacctatggcccctagggcctctctggtggagggggtggcacccttctttcactcatgtcccatctgatttttgagaggatgtttctgaaggaaaagatgtgatgattatcgggggcttggttgggaggtagttttgacagtttactccccttgtcactggcttcccctcttttccctgggtgggtttatgatctttctggactcctctgatgagctgccattttggagccatttctgctggtctccgacatggtggcgttggtttttctgtcctgctgtgccagttccgcagagtgggcggggggcgggggctatgacggaggaggggaagggggggcaaaagcacagcagaggcaggcacagtggtggctgccgcaatgaaggtggctctaggggcagagccgcctagtcccacccttggacacagtcctgggtggggattcaggtggaaggcgtctgggtaggggttcaacacctgggcccggctttgccagagcgtgggtttcccatgtcctcatcagcctggtgcttggagtagttcggaaaagctgagtgtctgaatgagagtggaggcagaggctcggcagctcatctcagacgtgtcagacccgtggtttgtgttccccaaataggctctgtctccagcagcctccctgtggggacagggaagtgaggtccatggcagctttgaggatctgttcggatggtcctgcctgcttactgtttttcttctctttctcctccatgccccctgccagtgccatggttccagctgtagtcctcttgtgaggctccccgctgcccgttccccctctctccaggcccttctgcgtgcagcggccatcttgtctttcttgctcagaaacttaaaatggtttctcataattcccagagtaaaattccttccctttagcgtgatgctcaatgctggccgtaactggccttaggtttcctgtacagtcttacctctctcagtttcttttggtggaccataggttccaacaaaaccaggcaacttccttttcctatctgttttcaccagtgatgttttccatgcctcttctcctctgcatccacctgtggcagtctcactttctccgtggacctctcctgatttccttggcaagaagcagttctcataaccacccctgccctttcagccaaacttccatacagtctgtccctttttatggtacttttgttgtgttatgattatttgtgtataagtcttatgtcacctatcagattgggagctccaggagggaggctagagaaaggagaaggaaaacaaatacctatttggtgccttctgtttgacagataccatgttatacactttccctgcagttacttcatttactcctttccacagccctgtggggagcatcccatgtctagtaagtggcctggtcatgactagagccctggtcttccaaagcctttacatttttcctctctgaattactggtgtttacaagatggctgttatgaagtagatccccaaaatttgtctatttaaggaattttgtaagtccctaatgctctgagggagtttgggtggtcaatcttgtgtccatggtctgggtccctcagctgttccttgacactgtcattaactttctcctcttcctttgtggtcaggttcactcaagatgatggcttttttcttgtagctgaaattgatggattaactgactcagttatcctggttgccttcctcgtacaagaggagggagaggtggagtgggatacagcatcttcaaagccagaataagctccagaattagagagcagggagcagagacactggacttgaacagacctaggttttcattgtgatccttcttcttagctgagtgactttagacaagtcatatgatttaagttttcagtgagatggagctactacaactgttatacagaaatgcctaatatattggcagcaaataggttcccatccctacccagtggtttatcagggacttaaaatgggagcatagcagggggctagagaagaaatgggggagacaggagctcctgtgccctaagtggtatcacagcaggggcgcagaggaggtaacctaggcgttacgcccttcaagcctgcaaggtgtactgtcccccacctgccataaatacccctttacttctgcatcaggaacatgccatggcatctgagtggtgggggctggtgacggcagagggagggtcagtgagctttcctgggagccttttgatgccaggttagtttcccttctttctgaatctcagcagtggctgcctgcttccctgacgctgctgagtcccacgggaggggagctgggcaccctgaagcccctcgttaccaattcgggggccgcggagcagagtgtgacgacagccagtgagtcgtcagtcgacggcaatggggaccctggtgacggctgctttgttgttttttttcctctttggaagatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccaggtaactcagcagggctctgggaacccttgcattttagagtctgaaaagaaaataacagctgtatgtgttattagatgagcttggcaaatagggtcactttttgagttcttcccactagtcccagatgacagacatcttcccagggcccagaaagccctttgggatttttcaccgtggttctctttgtgatagtcttgctggtcattgccttgaatgaagggcgattcgcttcttggggtaggggtgggccaggccgacctcagtgaatgcgggcgcacctgtaccttgggagaagtggccgtggtggggctgtggcgtcttgagagtcctctgccgggcggcgcttcaagatggcggatccgcatcaccgtcactaagctaaaggctggctcttgggcagcctgcgtcagcctcccctttccatattgacccaaatcagagcttctcttctccccttcatcttcttccttttcttcttaggtgaaacagtgggccttgagttcttgacccttttaattttgtttgcgtcatcatggcggctgtgggttctaggcttttctccataccgcagctttgcgctataggcgcgtgatccccccgccctgccccgccccgtcccgccccgtcccgtcccgtcccgccccgccccgccccgccccgccccgccccgccccgccccgccccgccccaccccaccccaccttcttgcgaccgagagagaagatgcacctccactgccactgaatgcggacaaaccgtcctcccctttctcttctctaccccctctgctggagcgtggggcagagggacaaacaattgcttatgaggatgagggacaacttggccgcagccccctccctcctttcactgggtactatttttcagtctcatgctttcccgcggatgatgctagcagtgacatttgtcactgagcacctcctcttctctccaaggacctcccagggtgactcatttgggatctctggtaggagtggctcctgggccttgggagccagagcagggcagggagatgtgaccgaggtcacatgagagagttaagcagggcagggggtgggagccagccatccccactcagagtgcaaaggcagacacagccgcttcatgtcatgttttgcacccgagtagagagcagcttgacctaaaaagattgtatgtatatggacgttggaacctttcgtgtctcattttctttgtcccaagctgtgtatatgataagagcctggatttcgggcttcaggcagctctgtggtctctcaggttcattttctgaaagaggtggtaaacagaccctccttcatcagaccctgcatcttctgttactggcctttctccaggacataggtcccatgtcattttgcccaacattgtcttgcgtctttcattggatggcgggcaacagctaagggtcatcatcccagagccacatactaacccagatgggcccctggttgggatctgctggattcattgcttggttggctctgtgagctgagcccacctatcttcctttctcttcttcctcatagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtaagtattcatctgcattcttttacattcctttatttcttcgaacatcagaaatgggtagatgtttattgagcccagccacctgctatgccttctccattcttctcccacacaccccacccttagtcctccagaagagaggactagattgattttctcatgctactggatagctgcagagaagctagaatttgctgttcagcccccacacatccccctcacatttgggagaagttgattttccctaaaatggagccaacagcctgtgtccctcagtgtggagtgttaatgggctgcctggaaggaccctgtgtgccctcacggcccccagccgggaagtgaggctccccattggctggcagtgggaggatggtccttgccagcacctagcatggttctctgccaagttctagctccacatctccaggctggtaggaacctagactatatatagcattgtgctaagcaattcttatcagacgtgtctgccctcccctgtgggagtggagcacttctatcagagaaccagaacctagagagcatgagccatctccaagggccttttattctgggaaggggtgtgtgtgtgtgtgtgtgtgtgtgtgtgtgtgtgtgtgtgtgtgtctgtctgtctggttcagggctgcttactttcctcctgtattgcagatgctgatagattgaaaggtcgtgctagatgaaggtgctgatgtgggatgagggccaggaagggctaatagctctgcgatggatattgagcttagagggagagaagctaggggcatgtgacatggctgagggtacagttgagccctgcctccgctttctcttcctggtttcctgtttgccatgctttgcctaaggatgtcttttgacctctctcttccttctttcggacctcttgcattccctgccttcctccaccacttcctcctccctttgattttctttaggatatatgagggcaaacacagtgactggcatcctgggtctgtgtctactcttcatccttacccatttggggtttctggagatctggctccagttgggcagagagggctcagctgtcctctggaggagttttggtggtgggtgagcatgttgtgttggctggttcagggcagggtgggttggatattcccctctttcctctcataggtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcaggtattaaaaccattgtgttctgattcactgtgtgcccaagcagattaatgccctggtgtgaggtcgagaagcctccaggtagaatgtggggacagaagtggaccaggctagagtatagctcccacacctttcccatgcgtggcagcactcgtaagactgacatgcccacccttctggatgggtggttttcctccccagacagccctgccaaccctttcaccttcagccagtttgtttggagtcattaggctgaggtgggtaaaacccatcaccctccttggatggcagagctctcagcaggctgggattttcatgggctgccttcttacaggtctaggtggccttcaggcatggtgccagggaaagcaagccccttccagcccttaccaaactaactggctgcttcctagtagggaacagccaccagcttgtttcagcgaagagtcattgctcagctgattctgagaggagaaaactggttctgttgggagggctgagacctgaaggaccccttttatccagtggaattggaaaggcaaaggatttcaatactaacatgatttttttctccacttcttttagagtgtttaattaaagtgatgcattgttaatggcttcttatctcttcttccagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatca

SEQ ID NO: 781 - DNA, 8702 bp, Homo sapiens
atacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtgagattccatcccttctcgggctgggaatggggcacgggagaggtaagggcaataaccttaagcctttgtttttccgccccgagccaatttatagctctttcaggcccctgtttaaggcagttccaacaatgacagggaacgtatgccccaccctggcatgtcagttcatattcctggcgctcagttgtaccgggccgcgccgaaaagtaaatatctggatctttttaaagggagactgttagtcacatgagcttaacgtacagttactgcttacagttttaaatattgctgtttaggaacacaatctggcaccgtgattaatgtacttgcaaagggtatgaaagaatcaccctttaaaaaatagattttggaattcagtctgggtcatttttatttagctattgtaaaaggcattgctcacatgccttttaagggcctcccttcttgcctccctccctgtctcctctttcctcccttggctccctccgtctctcctctatttacgcatttaaccaaacattgccttatttcctctaggtgagggtgcttactaaaggaccctgatgggaaagtttatttgtaggaagagtcctctcaactgttaattcatttcgctagacaagtaatagaacacctagtcagtttttaagctagactactaaagcctgcttatctgacccataatacctgaagcataatgttctcctaataagaagccccaatcaaaccactgtataataatgtttctgtcttgaaataaattcagtttgtgtgttgaatacctggaacacatattcctctggcacaatgaacactatttctctaggtttaaaccactggaggcatgttcggtagcttgtccttggctctttgagtaaaggagccattataaatggacacataatttccaggagatcaaggtacagaattgtggataataagagcatactgcatgaatcatcctagctgttcttaaacgacattggtttttctacctcctctttactcttttgcttcctggacttctccactgccaccccatctgttgcttccttttctaaactactatagaattatcgcccctttccccttatttggtctctgaagccaaaacacaacaaaaacacattttcccccagaaaagtattacttctatcttctgcccttatttttgttactttcttaaatcttgtaagaagaggcaatacaggctgtcttgtgccccgaccccaattaactatcccatgctggtgatagaggtggcacaaatgaacggaattcaaatgaaattcacttgcaaaacatttttacgtagtatattatggagctttcactggggcttctaaatggagggagaggaaatgtacctgatcaaagatatccaagagaccactagctggtgcaaatggcttagtggaaattcctcaggtagtcagcatcctcccacatctacccctttcttcctccaaagaacccatggacagaggggctccatagtgcggtgggatccaggtggcatgggaaagtgggtgagttgaaatttcaagcggttgcattgatggggtatagaatgttcttttggtcagtagcttttcccaggtagtatgctcgtcgtgtttggctttcattaaacagttcgccttcactgtcttgaatgtggcatggattaccctggtttctttatagctttctgctcacctttgacacttcatatcttacccagttcaatgagttagcaaaaagttcaatgaattagcattaaactacacctgaaagttattgcaaggttaagtgagaggaaccttaaaattaaagggagcagcatttgtaaagaaaagctagaatcatgaaaagacctaaggtaagatcaaatgaaattatgtagaagtgtaattcacttgcatcccacatcatccacaaagttttctatagttaaagcagtttgttttgatctgctcttttttctgaacttggacagcagtaagagtatacatcatacagttgagctattgggactcttaacactgttgtctaggagttttcatatgctgatgtttcctagtgtggtatgcagcttcttgaggagaatgaatatctccttttctgtctcccattatctttaacacagaattaatctacttttatgctgccttttgtacatggtatttcttctgcttgaagatgtcttcactctacttggcaacctacaattttttcaaaatccagttcaaatgttacttcagtgacgctttccttaatgtccttagaaaggatcaatcttatcttcttctccatcatctattgtcacacatttgcctttttctttatgggtttgattctgccactagtctgggaacttgaatttggaaatttttgtattcctggtgttttgcataatagcttcaacattctgagtctacaattaattttggaaatgcatgacaactatgtggattgatgtcatttctagcattttatttataatttctttgtgttattttattattcttcactggctttttgttattttgtttgttttatgccttatttgattgtttagccccagggatggtactagggagagagttaacatctgttaaatgtaaaggaatgctgtgcaaatatctgggtgcttatagttcatgtaaaattcaaaagtgctatgacaaagggaggagaaagtcagactggcccagtctttctgtcaactgagactgtcaagaagtatttctttataaattttcttttgatttctttttcaagcaagcagatttttaaaagtaacttattgatggaatagcttacctttttcaagttagaatgcctagctaaataccctaaaactaacttttgttctgaccattttaatataagccttagcgcattggagtagtaccactcaattaactgttttatgacataaatgtaggttgcttgaaaaaatttttgtgagatttgaaaaagtaatactaatttgtctcagtatctgtattggggtttgctagagggacagaactaataggatagatgtatatatgaagtggagtttattaaggagtattgacccacacagtcacaaggtgaagtcccacaataggccatctgcaagctgaggagcaaggaagccagtcccagtcccagtccccaaacctcaaaagtagggaagccgacagtgcagccttcagtctgtggtcgaaggccctagggccactggcaaattagtggtgtaagtctaagagtccaaaagctgaagaacttggagtctgatgttcaaaggcaggaagcatccagcacgggagagagatgaaggctggaagactcagcaagtcaagtactttcacattcttctgcctgctttattctagccatgctggcagctgattagatggtgcccacccagattgagggtgggtctgcccagtccactgactccaatattattttcctttggcagcaccacctacacacacacccaggaacaatacttttcatccttcagtcaagttgacactcagtactaaccatcacagtatccgtggctcatggccacgaagaggaaagggtattccatctaggttaatgaattaagtcttaagacagtgtggtttaattgggtctgatttaaaaaaaaatttttttgccttatctggggagatgtagtggggtcttcatgcaataataattattagctgcctactatgtattaagcaatgtgttaagggacactggggatacagtgttgaaaagactaggcataattcatatccttagagtacattgaggaagacagctaagtgagaaattacagcatgatgtagtctatgcagtgatagaaagttcagaatgctatggatcaatataaccttacatattgggggaagttgggcttttcagagaagtctataaacaagtaggatgcctagaggcaaggttgcatttgaattctcagagaaattcaaaaggcctagtgtagaactggaagcttagaacagtgagaggtgaaactagattcccagtcaagtgggatttagtgttaaggaatttggaatttatcctgagggtatctggaagctatttacctttagaagtagaaagaatagattaacaaatgaaattgtgccatattatggggtgtttttgctaccaaaataaatgggctatcattgaaagtttaaaaaataattggcacagtataatgtaaataattggaattgggatgctttacctcagagttcttgtgagaatcaatgaagatagtgcatcaaaaatgtaccaaaagaatatccacctttcatagattgttcatattgtttaaattcccaaacctccgttttctccacatatcactagaacattattaaacacctatataacaatctattaaagatttctgcattatataaagcattaaaacaccacattactagttatttaacatttagtgaactgtgggagagtgtgcagtacacaagatagtgaatgttaagtattgtgtataaattgttcttcttactgcaaagatcacttgccaccatgtaaataacaaaataaatcatggtaaagacactatctaattggatctaagttggtagtgccctcaggtacctggcagaagcaaaggatggggaagatatgtgcaataatataaataagagtactacatatgattcttgagtggagattgagatacgactttagctcacttcacattttcttctgcttggattacatgtactttaacttttttccaaggaatgttcttgtagattagggcttttgttggtttggatggtgattttgagtaaaatacttaacaaagtgttattttatatgacatatcagagcttgtttatacatatatgtaatccgataatgttgatatatatattatctgaagatgagtacatatgttttgcttatatgtagagcttgtttctgtaaaaatgtacaagaaggtgtcagctatggttgactgggggatgagatggggaatatacttatttttgatagtttactacccttttgtaaactttgttgttttatattcttattttaaaataattatagactcaaaaggtgcaaaaatagtacacggtttccgtgtatcctttacccagctttccacaatgctgatatcttacataactatatttttttaatagactttaaaatttttcagtctgcttatattacctattttaaataattttttaaaaagaggctcgaagattattaatagtaagtatggttattttatgatagttgttggatgacaaatgacctttgtacatacacttttcaatttagcaaacttaaacaatttcaactattaacatgttttttaataaatatttcaaattaaatatatctgtttaaaaatctttgacctcagattgtagaataatagcctaaaatgtagttgttgatatgttttgatttaaaattttctggaaattttaaattatgttataaatttaaatccatttggaatcagaagcaggaatatttgttactaagcgaatcttacatacgttttgatatgtaatgatgctttacaaaatggcctttggtctagccttgcatagcttgttttatacattgcaatgacgaagtctctttgcagggaatctaagatggacttatattagactgaattctatgtaattttaaatagaagagttaatttacttaatcacaatggtaaatagtacaatacattttgagataactaatttttaaaaatattatttcaatgcatcagtatttgagcttaaaaatccacttggattttctgttttaaaggtccatctgaactgtttactgtttgttcatcgattagcagaagagtccaggacaaacgcttgtgcgagtaaatgtagagtcattaacaaggagcatgtactggccgcagcaaaggtaaaatccaaatttcttttctcgagcaagaattaaacttcaaaaataacactcggttcatcacctctccctgatttgtataccttactcagctttgttgattgagtcgatatttggccttttatgaattaatgattttaattaaggagttatatttcctccatatgtatattattaatttccaatggtaatattaatggccactgctttagaggaaacattcatgttcctacaatctgctaatctgtagactgagaagatatatcaccttgaaatttatcaaaacttactttcttcttgatcttttaaaattatcctaattacctcattgtattagtccattttcacactgctataaagaaatacccaagactgggttatttataaaggaaagagaactcactcactatcaggagagcagcatggggaaaaccgccccccatgatctaatcacttcccttcctccacatggagggattacaatgtgaggtgagatttgggtgtggacagaaagccaaaccatatcaccaattatttgatttcttttaactttgttttggcagaggttgcagtgtgccaagatcgcaccattgcactctagcctgggcaacaagtgcgaaactccgtctcaaaaaaaggaaaaaaaaatctcttataagtagagatgattgctttttactgttatttttatataatgttaagaatatgttgcctacggtgcagttttccagatatgttcctgaaaatgttatttccaaatgatgttaatcaaggccctacctcagatgcttctgttgtcaaataagtgtagataaccttgcatactatacttccttgattagtcacagtattattgtagaacttgtttctgtaagaatatgtaagaaactggcaaccacagttgactggggatgatagaggagggaaacttatttttgacagtctacctctttgtagacgtttttgttttagatttattttgaaataaggtacaaaagatagtttagagttcccatgtaccctgtatccagtttctcataatcctaatgtcttaaataactatagtcatgtaaagttatgaaaggctatgagagaaatatagcaataaggaaacttgttgaactccatttagtattttgtaagtttgagtacataatatactcagcgttttgtaaattcatttgagtattcaaactttcttttgaagtacccatgataattatcttgtaggacagagaagtactagtctagatacagatttatttgatggtcttgtggaagcctagaaatgtgcatgtcttggcattttctagggcctttaaattatcttgcaattataaacattccaacaaatttctacactattaaagtcaatgtaaatatttttctgtgggaaaaacaaggcttaagatattgaagaatatacacgtgttttttacatttaggatttttattaataaactgtaggtttatttacttaaaatagtagataagtttttttttaaaaaaagagatattctgactaataccgtcagtctttttacaactaaaaatctcctttttttatttgtgccacagactattattttgaaaataatctacttaacaggttgttcagcataagatgactagttttagtctcaaatgattataattccagtccaactataagaaatttaatgttgcagtggatttgtcctagtttatagttgtgaaatgtctgatttataatagactttttgagtctaatatagactcaagaatattgtttaactctttaattggtattgtttaactcctaatttagataactaaattgtctaaaaatttcaaattcgaaaccattaatctggacacttttggtttacaatagaagaaattaacatctagaggtaactaataaaggcaggtttttagaatctaggcatgtttcatattcattgagataagactgtttttagagaaatctaagactataagacaaaagattccctaatcacctggaaggtgatttccaatttggaaaattgggttttataaattcagtcttgcatattatgcacccaggactatttaactttttgttaaggaatgatgttttatttttcatagatataatatgaatcttatttttttccctcttacaggtaattctaaagaagagcagaggttagaagtcaaagaacatattcttgaaagttatgatgcattcttttgggtggtaacagatcataaagacattttttacacatcagttaatatgggattattaaatattggctataagtgatgtgtgtgtttgtattttttttctggcatgaaatatctcaagtaaatgcataggactatttaacccttttatgggaattactattatttttattttaaatgtcctctagttcagtttgcttttgttttgttgctgctgcaaatattttatgtatcaaaaatgaaatcttactatattaaatactttgaaaatgtacttcttagaattaagtttatatatatttagatttagccacagttaactatggaatttaatctctgaagaaag

SEQ ID NO: 782 - DNA, 69313 bp, Homo sapiens
gtcatttctttgtttccgaaggcggaggaggctccgagccccccctccccgtgctaccccctccccccgggtgctggctccatgtctgtgtgaccggcctcaggggtagagtccaggcccgacgcggggcgggccagcggcggcggcagctgaggtgagagacggcggcggcggcgcgggcacccggccccccagcgggaggatgaagcggcggaacgccgactgcagtaagctccgccgccccctaaagcggaaccggatcaccgagggcatttacggcaggtgagcggctgcacccccactccgcgggcgcgggccctgcggtccccctccagctccgaggggcctggccccgttatgtaaccccgagtaggccgcacgcccgcgccgggggctctcctaaggagcgctggccccggagccgctggcccgcccgccggggtccgccccgggtgcgcggggcgtggcgagggtcggcccggccgggcgggcagggcgcggcgggcgctggctgagggagccgccgcgccgccgttggaagcgccgggcccgccggggggaggggcggagagcccccaaccagcccggcgttcctcagcatcccggccatgccgctgggccgggagggccgcttccgggacctctgactggccgccgctggcccccgagccccccggtggcctgggggcttgccggccggagccaggaggcgcgtggaccacagcgcgggggggtgggggaggctgacaaagttgagagcccactgtggcccctcgttcccccaagctgccagcatactggcctggggccatgctgtcacttctttcaccttctgcttcccatatgggatctcaaacttggcacccagggctgaagctgatacccccaaatcatgccctgtggccctgctccagattcggaagggtctgatgaccagtttttcagcaaatattgttttgacaattccaagcagatagcttgctttgaacgtttttaaaaagggattttctccaaactcttttttttttttttcatccgcaagaaaagcagtgtccctttaaatagaaattgaattcagtccaccggtagagaaagacaacaggttcatggggcaacttactatcatagcttccccaagtcgatttgtgtacgactgttattttctggttcttctcagaatgttacttgtaaatggtatttgccttgatacagatttcggtggagaagtaattagtttacaaagaagaattctcagcatgtggatgtaggcttaattgagtcctcatggtgttttacaattagcttctctagctgtgggatttcaagaaatatgtgaggtagctgatgacacccaagttgtcttaacataactgtacaccttgcacatgctcttgtttacagatgtggaatgattgctttccacaagcagctgactgatgtaaacactggggattttcttcaagtttaaaagcattaaggaatcaaagtaaaaatttcttgggtatattcttataaaatgagccatagagcataggagtaattcattcattcatcagttatatatactatgtgccaggaacatttctaatcagtgaagatagagcagtgagtaaaacagactctaatctatgctggatgaatcgaacttgaccattttaacttgaactgtgaaagcaaacaattttttctacacatagatggaggaaaggtctcttcaattcacgttacatacactatacattcttgaattaaagaaagtttttcccctttggctattgaaaaatatttgaccaacttaacattaatggtaacataaaaataggaaagggatattaaaccgagttggtagacttagcacaactgtggcatttgaatagctgctatttacagtaacataagatgatgtacctccatttatagcaagaagattgagagtcccatattgtttacgtgttttctgctgtatttccatttctctgtacttgaacaaatagacccagtttacaacctgcgccataatagctactcagtgtgaatcgatgtgaagaagtgaattcatcgtttaatgaagatttatcatcttactgatggcttttgaaatttgaattttcttaccctaaaggttaattgtaaatactctttgcaagttattcagaggttcatctgcaaaattttaaaaaccgacagtgcattagccttaaatcttcttatgcttctctgttttgcattctttaagttaaatgttaataaaagacctaaatgtatttctaactgtctttcctggttggagtatcatatatcaaatgagcgtttcaactcacttatctgtttcttggtttatattatggagtattggactgaagaacaagatttttttttttttgcccaattctgtttttaaagagatttagaaaaatttcctgttatttctaaagcaaacaggatgagtggactggttataaactagaatgcttgaggattcatgaatatcaaatttctggtgatcatcaaatttaagtctatgctaagttgtttttcacaccatctattgcccattttgtttctcaacaacatgtggccaattttggattcattaaacagagagccttgttttttttctggggccgtgttgacagttttgataaccactgtctactgtttcatagccaaacctttcatggacttactattttcatgttctcagtctgtacaactttctgagccttggcataggaaggaggcagctgtggtgaaaagcgcactggactgcaggaatcaggagacccaggatcagactcaaaatcccagctctgctgctttaggcagacagggcatccacagctttgagccccagttctcccaccttcaaatgagttttgaggactaaaggagatatgtacagtttgtgaaatgctttataaatcctagtgtagtttacagatactatttaccatgttgttgctatcacagtttaacgtgtggttaattttttaaggaggcaggaaatactgtaagatttggtgcaactgtaaacaaaagttgagtagccaaaacaaagggtcagttgctgtttggtcttgctttaaaaaatcctgttgtggactcacttttaaatcatgggctgcagtccaacaactgttactgaggtgactgtcaaatgatatcatttattgtgagtatcatggctgtcttggaattctgtttcggggtgagatgcaaggaaaattaattttagacattatgttaatgtaatctgcatttatacatataaaacatcatttgaaaagtgaaacatgctatagaaatattttagtccagttaataattaaaaataggagaaaggaaataggaatagtgatcttttcatcttactaggggctaaagttcgatgtagttttaaaaaaatctgacccagcccagagcctgacagagtcgacattcagtgttcaataaatgttgagtgagtaaattaataaatgaatataagctagtccatttcattcatgaagtgcctacgttgttcagggaattgcggaggatacaggataacacatggctcattgtcttcaaggagtttacagtctagtaggccgtagtaataccatcttaaatttgtacagtggtttagagtttccaaagaactttaagttctgttcaagtaaaaatatttctgttgtgctaaattttagcttactgttttagtggttcatctgacacattaacagctgtattttgctctgtgctattttatgataaagtagacagttgccactatatgagggagtcttttctatctcaaatgagatagatatgaaagtactttaaaaattatgaacataagttattaagtacctaactcttatatttctaaggtcctttggttttctgggctgggttctctccttgtgtctgcctagacacatgtgcaccagacactcccgatagtaatatctcattgcaggcagtgattttccaggtgaggtgaggttagggtactatgtagtttttaaaagccttaaggggattctgtatggtttacccctacctctcaccctgccatactttccactcccttccctcagagaattactgactttataatataaaaatgaggagataagatgtggtaagtagaagaaggaggcagaaacatttatgtttaaagtatacatatattccaaatcgctacagttaaatggttatttatgcaagtaaatataatacgaattttaagtaaggtatatgttttaagcttctgggaatgattttatatctgtgttactggtggctgaaggaagtaccctttcactgtgtatttaagactgcttcctgtcttcatgtactggattctgcttgtagtgctgtgtgaagcttaggcagtgcagtattgtacctgactgtcatatttttgcagcttaatgccttaaaactaggactaagaactcagcactggtgtatatgttattatttcccatttttatttcagagaaaaattctctggtccttggggctcctcaaaagtgactttttaaagtgattaaattttgcattcttctcaacttcccaatttcctttttcagacccttgtctacatctgatctccagaggtttcatttgactgctttttctgcctccttaatgatgttttctaagcctagttttagactcctttgggctatgcttattaaagtcactgcaggctgtcatgacccttggctgccttgattgtacatgtgttctgcaactgaaaccccagatacctgtgttgcaatctcatagcctaaaagcattttggtaatcttggtaggctttaactttaacaatcctggacctggcacgaaagtgatagattctgtattgttttagaggagtgttggggaaggagaaattgaaatgttttcactaacctgtgcagtgaagtgtttattagctaaactcttctatttgtggttttcacaaaatacactttaaaaatcggccacactgggatgaaaaagcactttcctccaactttcattatgattcttcctgtctgagcagtcttggcagtttagtttcattaggtgttttgaaaatccctttaaattgctgctgggttgaggaggggaacaggagagaacgtgattcacttcacattatttgcttaaaagcttcctgttttatcattgatagtctcctttttcttcacatcgattcctcatggcctctcttgaacctcactagatttagagattgatcttaatggtaggtttaacaaataattatttacattttcttactagttatatgcttgtatatatctcatggacccagtccatgttctgtaagcatttatgttcctagaatctttttctttggccatttctcccagatctccccactgatactgttaaccctttggggttttatgtatataaagtgcactttgttttatctgtttctaggctaccatcttgtggagtttggagggcaagtagaaatttcacaaacatagttaagtgaaatactgtaattaggttacttttcttcataaaatttagtgtgctcttcagatatactgattagtttatccccaggcttactagatttgggcataattattttacttggctcttgctcaagaattaagtccagaagaaaaagaagttggctgtccagcaagctgcataagtaggatggtacatacaacagtagatacacatatccttgttagactttttccactgtggatttcttcagatgcttaagtagtgacttttcaaagcctctcaccttgcatcctggcaatggaagcttgaaaaaagttaatcaacttttagagaatattgaggctctgtatctttaatttgacatttaaccgacatcaaattgtctcagctgatgagccttccaaggcacttgtcttccctggcctttgaagacagtcatagtactgaccttgattgctttatatttttttctctgctgcctttaaggatgatatgcccactttgagtcatgggattgtggcaccaaaaataatgtatccctcaccccatctcctctgttgccttctctttttcagagcttttgcatttagtgattaaaatggtgtgactactccactttcatatatctgttcatatcactgatgagtttgagctgtttaggaccgatctcccactcagcacagaggagtggctagaaataatctcattctgtttttgaatcatattgttacgttgttcatcttcaaaacacttttttttttttttttgagacagggtctcattctgtcgcccaggctggagtccagcagcgagatcacagctcactgtatccttcatctcctgggttcaagagatccttacacttcagctgaccgagtagctgggaccaaaggcatatactaccatgcctggctttttttttttttttttttttttgcgtttttgcgtttttataaagatggagtctcgccgtgttgtataggctggtcttgaactcctgggctcaagtgagccactcaccttgacctctcaaagtactgggattataggcatgagccaccgcacccacccaacacttttaaaaaccaaataaatagctgagtactaaaatcagtactttgcctatcttgtagcaagaatagttgaacattaaagagaatgaatactatgttcatgtccaaagtaaggattcctgtctcagaaaagagagatactgtctgaggcttgagtcgtcttgctcagatgtaataagaatttttggccgggtgtgatggctgtaaccccagcactttgggaggctaaggcaagaggattgcttgagtccaggagttcaagactagcctaggtaacatagcgagacctcatctctactaaaattcaaaaaaattagctgggtgtggtgtcacattcctgtagtcccagctacttgggaggctgaggcgggaggatcacgtgagcccaggagtttgaggctgcagtgtgccatgatcgtgtcactacactccagcctgggcaatagagcaagaccctgtgtcaaaaaaagagaattggctgggcgtggtggttaatataatcccaaagtgctgatattataggcgtgagccaccataatcagcccccaatttaaaggaaaaaaaaaatctagaatggaaatcgctaaaaaaggttttcacggttttgtagtataacatttttataaaggtctgtatagaccacagagatatcaaggacaggtattgtaacctaatgcaggtggtgagttttagaatttctgtttcaagaatacttttaacagtgtggagtctatggggttgaggaaggggaggggtgaagaagcataggcggagagagaaaacaactcacaggctctaaaaaaacctgttaacattatataaacattagaaattcatttcataagggaatcaaaattatgcttcatataattgatagtaataatctgcttaatcacaccttacatttctgtcttacttgtaacttttccaaatgttttcatattatctcattttatcctcacaagtgtgaaataggcagagtaggtattgccattttataggaaacaaacctgaggaatagagaactaaaaagctgcaaggcactattgaaagagtacagaaacagaagttaggagactgcagagaacagtgtaaattctatgtggaactctatgttgctgctaaaatggataagggaaattctatataaagaagtggacatgactgggccccgtggctcacgcctgtaatcccagcactttgggaggtcgaggcgggtggatcacctgaggtcaggagttcaagaccagcctggccaacgtggcgaaaccccgtctctactaaaaatataaaaattagctgggcgtggtagcatgcgcctgtaatcccagctacttgggagacttgggagaactgcttgaacccaggaggcagaggttgcagtgagtcgagattgtgccactgcactccagcctaggcaacagagtgagactgtctcaagaaaaataaaataaaataaaaaactaaaaaaaaaagaagtggacatgtcaaacagaaacctgtttttgttaagaaagaaacacatttgtttatatagaaaaagcaaattatatttatgaattatataacagcaatcatcttggggcaggactactaagggcttttatattatacattatattacctttttaataacaagtatgtgttgcttctttttaacttctcattttgaaataattttagatttaattaaacagaaaagtcacaaaaatagtacaaagtacttacaccttagtgaaaggcataagataccctatttatttatttatttatttttaaagaaaaaaaatagccaggcatggtggctcttgcctgtcacccttgctacttgggaggctgaggtgggaggatcgcttgagctcaggagttggaggttgcagtgagttatgatcacaccactgcgctacagcctaggagacagagtaagactctgtctctgaaaaaaataaacaaacaaaaaagggcatatttcacactgttagatttgtcattgcagtggctgcacatgtacgcgcgcgtgtgtgtgtgtgtaattgacactagaaaggttccctttgcagtatgcaggaggcctagaatagaaaaaagaaatatagaacagcttggtcttctcagcctgctccccttttttggattttatacaaggaggtgcctgcagaatgcagcagtggttccagtttattttatgttaaggctcacacacaaatttctgttttttttttttttgtcaaaaaatttttttgtctctggatctctttacactcttaaaaatgattgaggctggacactgtggctcacacctgtaatcccagcactttgggaggctgagacaggtggatcacttgaggtcaggagtttgagaccagcctgaccaacttggagaaaccccgtctctactaaaaatgaaaaattagctgggcatggtggcgcatgcctgtaatcccagctacttgggaggctgaggcaggagaatcacttgaacccaggaggcagagattgcggtgagccgagatcgtaccattgcattctagcctgggcaacaagcgaaactctgtctcaaaaaaaaaaaaaaagattgagaatatcacagagatttggtttatatggattatatctatcaatatttactgtattagaaattaaaactggctggatgtggtggctcatgcctgtagtcccaacactttgggaggtcaaggtaggaggatcacttgagcccaggatcttgctatgttgaccaatctgggcaacatagcaacatcccatctctacaaaaaaaaaaaaaaaaaaattagccaagcatggtggtatgtgcccgtagtcctaattactctggaggctgagataggaggatcacttgagcccaggttgaggttgaggctgcagtgaactatgattgtaccactgcacttcagcctgggcaacaaaggaagaccccagttctgggaaaaaaaaaaaaaaaagaagaaagaaaaaagttaaaatagaaaaatttaaaacattagttcacttaaaagtaccaataaattgctgagcacagtggctcacgcctgtaatcccagcactttgtgaggccaaggcaggcggatcacctgaggtcaggagttcgagaccagcctggtcaacatggtgaaaccccatctctactaaaaatacaaaaattagccaggcatggtggtaggcacctgtaatcccagctacttgagaggctgaggtgggagaatcacttgaactgggaggtagaggttgcagtgagccaagattgcgccattgcactccagcctgggcgacagagtgagactccatctcaaaaaaaaaaaaaaaaaagaaaagtaacaataaattaataaattcatgagaagactggtgtggttttacatttttgcatagctctttagtgtctggcttactagaagatactttgagaaccaccgctgtcgtcagagccagtggcaggtaggccaaatggagtgatagtctggcacccagaacaaggcttattaaattagtttcttcatagtgaagaacattcagaacagatgggagcaggttcatggtaatcgttcaggcagaagctgcattggttatcttggttgttgttgctttgtccagacaccttcccagtcagtcacctgtgtgtcatctctccctctatattcgttgtaagtatgtgctttggtaaaagtcctactgtcagtcctaaacacttttctacattacagatcattcattcaacattttttttttttgagacggagttttgctcttgttgcccagactggagctcagtggtatgatctcggctcactgtaacctccacctcctgggttcaagcgattctcctgcttcagcctccagagtagctgggattacaggcatctgcctggctaatttttttgtatttttagtagagacggggtttcaccatgttggccaggctggtctcgaactcctgacttcaggtcatccacccgcctcagcctcccaaagtgctgggattataggcgtgagccactgctcccggcctcaacaaatattttttgagaaaaaaaatagttaagatcctgtagtcagagtactgtgctgggcactaaggagataaaacagggaacaaaatgggcagctccttttttcttgtggactttacatccgaacagttaattacacaaaatattatttaattatcattgtgattcagtgttcttatagtacaggatgctacgtgaatatgtaatggggtcctagtctttactttggggttagggcggcttattgtgaggaagtgatatttgtgctgtgtgccgaaggatgagtagctatggaagtgcttcatttagttttaattgtacttaggtagggatcttggctttgactcagaaagaaatgtagaaaaatggaagaactaaccctgaacagtttgaatgttcccagttatgagaaggacagtcaaccatttggtgataagtacggattatctgattagggcattgtcttttttctgagacatcctgtaattgagtggaaattccatgacaatgagaaatttatgttatataccagtgcttctaaaatttgattgtatgcgcaagtagcctagggatctggttaaaatgcaggcttagattaaataggtcctgaaattctgcttttctaaaaagctaatatgtgatggtgattctgctagtccagagaccaatactttgattagcaaggctgtaattaacaaatggccagtgtgagacttcaggtagagtacaagccagataaggggctgaacgaatgttctagaggtgatgtccagtagggagaggtattggataacagaaaagataaagcagtttggtctaggaagtatggcagatactgaatgcaaaaggtgactcacagttgccattactgagaggacaggaaagctgggattgagatggatggctactagcagagccagtaaaatattccacagactcatttctgtagtgaggaccaaatgaactaaatggccattagtctgcctagggaaaaggtcaggtactaaggattgatggccagctggtggtaattgtgtgggctccagaaaatgatctagatgataagcagctagagatactggagaaaaggtgcactttacttggaataagaagaatgttgaatactgcttctcattaatcatagatgattaatctatggatggagagtactgctaaatggattgaggtaaaaaaatggttgtaaatggcaaaggtaggaatagaatggggggaaaccttatagataatattcactttgatagagtcaccaccattaagcctaacaattgcataagactgcttaatttcattggcactcggaagcttacaagaccatcagaagatgttattcatttgcccttgtttcaatatattattttggaaaatatctttttgttgcagttatgctttaaaattttgtttaagatacagtatagttattagcaaatttatttggatcagagaatcaaggtaacatcaaattagccatgagtcatataatgaactgtgtataaaagtattttatatttaatcatattttcttcatggtttaaaagaaatattttagaatgccatgatggcttaaatccctgtctaattttctcatcccttggaatgtcatctctttagatttggcaaaaatcttatgaccttcagaatatgaaaggagaggaattagggcttttactgtgatgagcaattaatttaggttacttgtctttaacttctgtacatgtacctacagaaggataagaggcatgatttactgatggagagggctaagtgaatactgaatcaggcagctgtcttaaacttctaaaacctctaagactaaaatgacttaatagaattcaagattagtcttagagaaaggtttgttaattaggttgtctcttgattttggaggcaggcctgcctgaaaggagagccagaggaaagttgagggtatggcatacgtttgtaaaagatcaagttttcttagatacctgtacttctaaactgtgactcagtaagaactgggtgtcaaggaacatcaaaggtatgaaagcagttgtttgaaaagaaatgtatcaaaaggaaccccgccttaaagttatgcaattgaaaaagaatagtcactaacaaagatggtaatttttgaactacgttagttttaaatgattgaattattaaaaagtacgtattcaacaggctaccattctttggataatcctatctaaatagtgaagcggagtgttgccatggcaggatctgactggggtctgactgggatcctgccatgccttgggggcattttgggcagaaagcaattggtggtactctttcttctccactttgggaatggtaaggactagacctgatggggtacccttcatgtctcattcagctacattccagagatagctccatggggaaaaggattaatcaggaaaaataatatatttccatgcccttttttttttttttttaagagatggtgtcttggccagacacagtggctcacgcctgtaatcccagcactttgggaggccaaggcgggcagatcacttgaggtcaggagtttgagaccagcctggccaacatggtgaaaacacgtctctactaaaaaaatacaaaaattagctgagtgtggtgtggtggtgtgcacctgtagtctcagctacttgggaggccaaggcaggaggatcacttgaacccgggaagtggaggttgcagtgagctgaaatcatgccaccacactccagcctgggtgatagagtgaaactcagtctttaaataaataaataaataaataaagagatgggggtctcactttgttgaccaggctggacttgaacccctgggctcaaatgatcttcctacctcagcctcccaaatagctgggactacaggtgcacaccactgcttctagctatgccattttttaaaaagtgctctgaaaccatggtggagaggctgttattcctttttcaaaacgtagaaagggttctagacacaaggaaaaaaactcttagttttaaagtcaagcaccttggaaatctagtttcaaactagatttgtgctcccgaatacctgcatgagtcagttgtgtttttttgtttgtttttgtttttgttttgagacagggtcttgctctgtcacccaggctggagtgcagtggcacagtcgtggctcactgcagcgtggacctcccaggttcaaacaattcttttacctcagccttctgagtagctgggactacaagtgtgtgccactacacctggctaatttttaaattttttgtacagatggggtctcactatgttgcccaggctggtctcgaactcctggacaccttggccacccaaagtgttgggattacagatataagccactgtgcctggccctcgtttgttctttgtaataaaatgtgcattgctctccactaggtcagttatggatttaatgagtgagaattacgagggctctatcttcatctggccagcagaactctagtgaaatgaaactaaaaggtgggacttaggattcaagactgtgttctggccaggcacatacctgaaatcccaacactttgggagggtgagacaggaggagcccaggagtttgagaccagcctgggtaacatggtgagactcccatctctattaaaaaaaaaaaaaaaaaaaagccaaacatggtggcgcatgcctatattaccacctacttgggaagctgaggtagaaggatcacttgagcccagtagattgaggctgctgtgagctatgatcgtgccattgcactccatcctgggagacagctcaagaccctgtctcaaaaaaaaaaaaaaaagattgcgttcttttgtgatttgctttggattcctttatggcatacctcttagtagaaacttattatcaaacctaaagaagttctaaggataaatattagaaatcgaccctagatgacaaattatgtatcactgtgaatactgtatcattgagggtcaaatgtttctgttcttgacatctcttgcctgaatggcttcaaagggcacaaaataaatcctcaatgctggatcctactttttttttcttttttctttttttctcttttctttttattattttactttaagttcttgcttttgtttttgtttttttcctccaagtatgtaagtcttttgtatcttattggaatatatttcaaaattatttattaaaaatctcaattttgttgtttttttaaatgactaatttgatcacatcagtattggaatatttgtattacaaaataccgtgcaaggctttatcccaaatgaaagtgaattttaggtatttccattttgtatattgtggaaaatattttttaatacctaaatttgacctccagaattggcaggattaggagcacagaaatagaggcttgttaacaagtagaatctaaaggattctattgtccattatgcaactaatgaactggaaaattgacctatagagtatatgaaaaataatattttttttctgtgtccttgtttgacctactgcagtggttacatatgtgtcctaactggcttgtctgagtgtttctgtttaacacaagtccagagggaactgggaacacacatttatatctcagctggagcatggcttagatgtttaaggagttttttctttaatgtacatttttatgccttcacagcccttggtagtgattagcatctgctccctaagtttgtttctgtctatttggggaagtcatttggtttttgtttggttaatgcagatgaatactatatacagaggcaagaggaaaaaagggggaaaaaaagacagaattctttaagcatgtaaggatgtgcgtcaagaatttcaaagactcttcaaacagatgtataggggtggggaaacagcaaatttgaagcctttcaactgtgacattttcttctaatgaaaaacagcttgaaagctgtaattttgagagtgttgcagtattttgaagtcagacacttagcacatttttaaaatagtggtgggatttaaatggtttttttccatcttaagtagaattaagcgtttttggtatcatcttatcttgatagttttgggtctgagaatgaacaccagagcatttaaaatgcagatgggccacggcagcatctcttttttgtgctttatctccattgttttcatgatatatggaggtatttttttgtcgttttaaacagaaacagtgaattttctatttctagttattcacaaatgaccttaaattaattctttatttttatattttgcagtacatttttatacctgaaattcctggtggtgtgggcacttgtcctcctagcagattttgtcctggagttcagatttgaatacctgtggccattctggcttttcatcagaagcgtctatgattccttcagataccagggactggtatgtctggtaatacatgttttccatgtgtggggaccattcagctgtttagagtagatgttattagcaatactcaggtaactatgttaggattagctaatagggtctgttaactgaaattgacctctaaactattttgtctaaacccattgatcaaatagttacattttctcctcctctcccattccagtgaaacagaacagtggaggaagcaataattactcaggcttttggagggcggcaacctagtctggggatggcatattccctcctcttccatttcccattgcaaccataaaggccgttcctaccttaaaaaaaaaattgctcagtcctgctttgaagtgtttctgggttccctgttgctaggttagtgattggattggagttagagtagtgtttcaaacgttttggtctcagggccccttttcactcgtaaaaactattgaggactccagagagcctttgttaatgtggcttatatctatccagatttactgtattagaaattaaaactgagaaaaatttaaaatacacacttattaatgcacttaaacatcataataagcccattacacgttaatagaaattacatttttaagtgaaaaatagttatattttctaaaacaaacagaatatagaagagtggctccatttttgtaaatctctttaatatttggctcaatggaagacacctacattctcatatctgcttctgaagtcagtctgttactgtatcacatgtcatgtaacttacagaaaattccaccatatgcatgagtgagtgtaaaaaaggcagataacatcttagtattgttatgaaaatagttttaacctcaaagagcccttggagggatctcaaagacaccccagaaatccccaaaccacatttagacagctgctggattggagcaagcataggcctgggcttgttcccttgattaatgtgttaattctgttgtgttctacagccacatcttaaaactataactcccacccaggcctggtgctttggtcagagcaaatctatgctttaaaaagatagtttcggcttatgttctattggcggtagtggtgtccagaggaaagctgcattattaaaattattattagtttggtgcaattacttttgcaccaacctaatagcatcagtatatttcttactaatattatggttcatctgtgctccagacagcctgtcttttaagaatgaagctctttaggaatggtttgtgaggagagagaagacttttctgtattaaaattctagttttttcagggccagacgtggtggttcacacctgtaatcccagcactttgggaggccaaggcgggcggatcacaaggtcaggggattgagaccaccctagctaacatggtgaaaccctgtctctactaaagttacaaaaaattagttgggtgtagtggcaagtgcctacagttgcagctactcaagaggccgaggcagaagaatcgcttgaacccgggaggtggaggttgcagtgagccaagatcgcaccactgcactccagcctgggtgacagagcgagactccatctcaaaaaagaaaaaagaaaaaaaaaattctagttctttcaggtaacccacatttatttggaatccaaatgaattcactgtgttcccacctcagctcattctgatccagttctttttcatgatttgaggaccataaagtactagtattctttaatgttaaagtaaccgctactttttatatggttgattttaaatgtttaaaatttccttttgtgaatttgctttacagttaccaagttatctcttagcagtttcaataattttgtccaacatgtgtttaacaatgtgtggttgaaaataacaggttctaagatgtatcttttattttgttttatttttccctttaggccttctcagtattttttgtttgtgtagcattcacgtcaaatataatatgcctgctgttcatccccatacagtggcttttttttgctgctagcacatatgtatgggttcagtacgtatggcacacaggtaagtcttaatgatttcttagatggatagaaatcttagattcaaatttttaaatgtggttatttctttgaatacattatttagagttgagtttaatgtggacattttaaagttttcttttcttaataggttataatataccttcaaaaatatatatcttttttcgttatttgaatacaaactttaagctgttatgatttgatattttaattacaggcattgcaggtaccagctctcactctgaatatatctttttaaaaaaaaaatagttggactgatttctatgtaggtatacttgaagacagccatgtgccaaaaaagaaaaaaaaatgttcatggaatttcatcattgaaaggaatgtcatttagatgaacccttaatttggcaaaagaatcctcacagcatccctgacacgtggtggttttacctctgatggaaaacctacagtgacaaggaacttacctactgttcctggtaccctactctgtttttgggcagctataaaataaagttattcctcatattaagccagaattttcttccttaaattttgacccagtatgtcttcactgtttttgggctcgttgatttcttttttaaaaatttctatttttttttaagatggggtctcactatgttgcccaggctggacttgaactcctgggctcaaatgatcctcccacctcagcctcctaagtatctggactaagccacagcttgctgatttcttagaggatctaaagaggctttcccagaaaaatataagggaatgtataaaacttttccttaaaatgtcaagggggccaggcgcagtggctcacgcctgtaatcccagcactttgggaggctgaggcaggcagatcacctgaggtcaggagtttgaaaccaacctggtcaacatggtgaaaccccacctctactaaaaatacaaaaattagctgggtgtggtggcacatgcctgtaatcccagctactcgggtggccaaggcaagagaatcgcttgaacccgggagacagaggtggcagtgagctgagactgcgccactgcactccagcctgggtgacagagcgagactccatctcaaaaaacacacaacaaaacaacacaaaataaaaaaaatattaagggccctaccagaccatcgcctcaatcccaaacattgaacctctgcattagagccacactgaatgaatgtaatctcccttccacgttaacatttctttagagatttaaagacactgtcataacctcttaagtcttttctgtaggcaagaacacctctggtttcatcatcttttccttatatattttaagcactttcaccctcctcgtctgcctgcctcagtggttctctacactgtggcaggtatgttctgactagagtagagctccctacttcttagagctatacttctgtcacttcagactaagatcagatgagatattttgacagcctcagcccaccgtgaaagccagagcttggtatgcactaggatttgaggattggctgtcagagtcaaatttgtctgcaaagctgcatgaaacttgattcttgggcctagctacaacctgtaggattttgaccagagagggagcaccaaataataataaaagctgtctggaccaatattcatcctcttctcagaactgctaagataatgatgttggcccatgtagaagacacagttgagctgtattttttaaagtatctgctatgagcatgattttctccatgtttcacactctttcatatctgacttgatttataagctactatgaaggttctttagtctgctttcctctaattaaagtgatttttcttcccaccagtttttaatttgtattttcttatcctgggcctcagtttctagtgagctgccttttacactcgtcactctccctaggtctcagcttctctgttatataaaggtgtagtaatctaaataatggctaaagaaccttccacctcaaatattctgtgactttgatgagctgtggcgatttcttaaatttctttagtaatatcttagtagtggagaagaaactaaccatataactattaatagaacctattggaaactagttcagtggttgacccacagggcagcagtgtagctaatgtcataaaatgctactggcccatctttagccctaggctcagaaatgcatattggaatagctaagttatgaaatatgttttaatttgggatgactagtgcttaaacaaacgaaacaaaaaactactcttattgggctgacaaatatgagtgcaattcctataacttggggtagttgttaaaatttaaaattatttcctgacaatattaggaatggttgatgaaattacatatgattacaaagaataatattgtagcataagcttttttcctggtggttaagaggggaaaaaaacaggatataaaactgtacgtacaatatgattattatacttgctcaaaaatgctttcaatgtgattttgtttatttcatagatgtagaatacaggtattttgtctaatttttctatttttttctgtaatgtgcttattatgtttataataaccttataaattaatatagagaatagggcagataaatatttgaaaatgcattttgaaatgattttgaaaatgcattgttctgtgggttgctgttcttcctcctacattgtgaaaatacctatttttgggctgggcacagtggctcacacctgcaatcccagcactttgggaggccaaggcgggtggatcatttgaattcaggagttcaaaaccaacctggccaaaatggcgaaacttgtctctactaaaaatacaaaaattagccaggcatggtggtgtgtgcctgtaatcccagctgctcaggaggctgaggcaggaaaatcgcttgaacccaggaggcagaggttgcagtgagctgagattgcacctgtacttcactgcactccagcactccactgcactccagcctgggcgacagagcgagactctgtctccaaaaaaaaaagaaaaaagaaaaaaaaaagaaaaggaaaaaaagtacctatttttgatatgttaaattcataagagtggttgagaccattagctggcttcacagagcatccagtgacaacttcactcaggtactaggactaagggaggttctccttagaagcagatttagtactgtctctgtgaacttgggcccagtttatttaaactctggggtttactcttcaacaaaatgaggaagttagacaaaatgatcttcctagtttgaagatactatgatttttctttagtttcatcccaaagatccttagcaaaaagccttcaggtcactgattttttccccctcgtgcccatgtagtccacattcataaatatcccgttattagtcatgtcctgatatagatggacctagcctgcagattttgattcgaaaagccagtggacatttgcctttatttgcatcttattttgttgcaagttgctttttcctcccttgaaaattgtttttaattacaaagggaatatgagtttgtgcttcagaaaaaatttttttgaacagtacttaagtgtcagaaacatttctttgtcctacaacttgttcttacttaaggattattttttttatgtcattccatgacaatgcagatcttcctcattctttaggaaccttcaacatatttcattatatagatttatcataaacagtttcctgttgatgaacatttaaattctaaatttttgctattgcaaataatattacggtgaattgttttttttttttttttgaggcagagtctcgctctgttgcccaggcttgagtgcagtggcgcaatctcggctcactgcaacctccgcctcctgggttcaagcaattcccttgcctcagcctcccgagtaactggaattacaggtgtgcaccaccatgcccagctaatttttgtgtttttagtagagatggggtttcaccatgttagtcaggctggtcttgaactcctgacctcgtgatccacccaccttggcctcccaaagtgctgggattacaagcatgagccaccacgcctggccctacagtgaattttttttttttttttttgagatggagtttcgctcttgttgcccaggctgaagtgcaatgatgcaatctcggctcaccgcaacctctgcctcccgggttcaagcgattctcctgccttagcctcccaagtagctgagattacaggcgcctgccaccacgcccggctaatgtttgtatttttagtagaaacagggttttgccatgttggccaggctggtcttgactcccgacctcaggtgatccgccctcctcggcctcccaaagtgctgggattacaggtgtgagccactgcgcccagcccagtgaatatttttatgtatttatctcaagactcttttatgtttctatggggtagattcttagaagtggaatttctgggccgggcacggtggctcacgcctgtaatcccagcactttgggaggctgaggtgggcggatcacgaggtcagcagatggagaccatcctggctaacacggtgaaaccctgtctctactaaaaatacaaaaaattagccggtcgtggtggtgggcgcctatagtcccagctatttgagaggttgaggcaggagaattgcttgaacctgagaggcggagcttgcagtgagccgagatcacgccactgcactccagcctgggcgacagagtgagactccctcaaaaaaaaaaaaaaaaaaaaagaagtggaatttctgggtaaaagaaaggtacaagtatttaaatttaaatatactgccaaattgctatctaaaatggttgtcccaatttatattattgccgagtatgaaaatgaacctttgcccataccctccctatgctattatctgtctttaaaaattttatctaatagttaagaaaatggaatctgattggtttaatttgtatttctctaatcagtagttaacatctttttctatgttttttagccatctgtattcttttgtgactcgtaaattattttctttagttagctttttattgatttgtaggagctctttgtatgtcagggctatgaatcctttgttttacatacattgtaaatattttttgccaggatgtttgtcttttatttttgtcagcgattctgtggaatcatttgtcatataaaagctttcagtttggatcagtttgccttttaatttagtttaggtgaaggtcttaatgaaagttactgtcgtcaaattagtctcccaaacaatccatctgttagttactatatcgtttattaatgcttgcctctctgctgctttctcacagaaaggggagtgtgtttgcctacagtgtctctctggatcctctttgtttatattgaagcagccattagatttaaagatctcaaaaactttcatgtagacctttgtcgtccatttgctgctcactggtaagtattacataaatgtatgtgtgtgtgtgtgtatatgtgtgtatgtatatatatgtgtgtgtgtgtgtgtgtgtgtgtgtgtgtgtatatatatatatatatattttttttttttttagacggagtcttgctctgtcacccaggctggaatgcagtggcacgatcttggttatgcaacctctgcctcccggcttcaagcgattttcctgcctcagcctcccaagtagctgggattacaggcgcgtgccaccacacctggctaatttttgtatttttagtagagacagggtttcatcatattggccagactggtctcgaactcctgacctcaagtgatccacctgcctcagcctcccaaagtgctgggattataggtgtgagccagtgcacccagccagtattatatatattctttgtctataattcatttcactgtagaatgttaagttcaactgtaaatttattcttagaaattttacatggatccagaaagcagtacagcatggttggaaagaccatgagcccccccttttcaggcagatgagtgaatcccagctctgtcctctgacagcttgtgttgccttgtcactgcctctaagccatggttttcttacctgcctcactgggtcatgggaaaaaggaactgaagtgatacatgtattcaacttaatgccaagcacataggtgtctgatgaatgttagctatgtttattataatcaggtaatgattccagaaggtcttgatgaaatatatggctaattcatgaaacttaaaataatttagaatttccttagcctatttataaaagtaagagaatattattaataatttttgaatgaatattatttctctttatgttaatgaatattaagatattattcatttaatcttaaccatgaaacatttttgaaaaatgagcttggttcttatttagatctattgtggaacttaccacctaatgtatgtttctcctaaacacaccaatttttactaatatttatggcagaaaccaaaataaacagtaatcaactaaaaaaatactgtttccagtatttttagtctttttacaaacaagtaaattaaatgaacttggtcagtaaaacatgtcaccgtaagtttgtagtgagaccacatttagactaattataaattgatacattttcatgttagtgaaacttatatgggcttgacagtgtttgcagaggctttgaaatgatgttaggcaggctggtaagttcaatgaaaatatttaactttctatcccagagattagagttctaagtacagctggtttaatttggtgatacaaaccaaatcttggcactgatcatatcggatacttatttaaatgattcttgaatttatgtatgacagaatttatatatgacagagtgtttgtgaaccaatcttcaaggaatagctggtgacagtacccctcaggcagcaagaagattaaattagtcacctgaatttgaccctgccttctagtattgaaaatcaaatgatgtccttgtgatttttttttttaacacttatgtttacttttggctacctgtaaagtctctacccttttagtttttaaaagcatacaggccaggcgtggtggctcacacctgtaatcccagcactttgggaggccaaggcgagtggatcacgaggtcgagagatcgagaccatcctggccaacatggtgaaaccctgtctctactaaaattacaaaaattagctgggcatggtgatgcaggcctgtagtcccagctactcaggaggctgaggcaggagaatcacttgaacccgagaggcggaggttgcagtgagccgagatcacaccactgcactccagcctgggcaacagagcgagactccatttcaaaaaaaaaaaaaaaagggtacaggtatctgcctaagttctaatgcataaggcagtttcttcaatatttcttcaaaggcattattagccactgtatctgacagtcactgtggtgactccttgaattaatttgaagaatgccaacgtctaatgggaagtgtcgtcttacggtctagcagtcctgttgttcctgggggttttgttctgtgtgccagttgcttctgatttccacagtagacattacatttatttgtgtgtctagtgaatgctcttctcaactaccatcatcaattagaatttatttttaatttttaagccataggtattctcatgtgcttgaggcacatgtggttcattttaaacctacaattactggctggattgtcttctttctagtattgggtaccctgtggtaactttggggtttggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaaggtaggtctttaccctaaagctgttggctcaataggctagtcattattttgtctcttggtagaattttcttttctggaaaagtagctaggattttgtttttttctgtctaatggtgttcctcctcagggtcattgttttatttggtcaatgaaatacagatggtgaatgaagttttttacatactgtctgaagactatgtgtttaaatatgtttattttattattttaaaatatatttatatcttttttatattttaattctgatttttttttaaatttagttttttgagacagggagggtctcactctgttgcctaagctggagtgcagtgataacagttagggaccactgcagcctcaaactcctgggagcaaagtaatcctccctcctcagcctcctgagcagctgctaccatgggcacgtgccaccatgcctggctaattttttttaattatttttttgtagagatgaggtctcactgtgttgttcaggctagtctcaaactcctgatctcaagcaatcctcccacctccaccttctgaagtgtagggattacaggcatgagccactatgcccagcctgttttacgtattttaaaatatatattctcagcaacaaaatactatggaactatgtgaactggtaattgaagcaagccaagaaccaaagtataagcacaatggagatgtagacatgtagaattgaacttcagaagccagatgtcttctgaatagagccaagatggataggtcgtgttctaaatgcttcatataatgtaatgcagattttaaattgaaccatttctaatggaatctctctcatgggcatttgaccaatagaaatagataattggcagtagctagtttccattggtttgaaagttgaaagtttgaggtcatgtttttatttaatatatttcaaaattttctttttgtgtgatgtggtgcaaaaatatctcttcaagtagaccttaataaattggaatgtgtagacccaatacacaaaattctttctgagtggtctggtaaatgatacagacttccttattacctcaacactagagtccagaaaaaggatagatgtcctgtatcctaaaattattcctcttcttttgtttcatttaacctctttcttttcagtaaagttattaacagttcgtttactccaggcacttaaaaaaatatgacttcttaggatctgcctttgtcctctcacctcagtgataggcgagtttgatttgactaatacacaaagtgtgacctaattataaaaccctgatcttgttttcaagactagacctttagtggccatcattttcataaatgatgatgattttctaaatgtagagtttctcaaatgtatttggattttcttctattttttcctacatcttctagtaaactatgaggatttgcttcttgattagcgtataatgagtgtgcaaactaatgtgaatttcttaagtgtagataatagtttgttgaattaatctgtgttgttaaacaactaaatattccggtgggggctttttgtttgttggtttgtttttggtattgtagcagccaaaggattacctgatatggattcttcgatccttatacaccacaatggaggtatcccagccaacaaaaaactctccacaactttgccagagatagaataccgagaaaaagggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggtaagtgcacatgctgcatccttactaacactttccagtaaacttgacatactcttgacatactcccatatgggcctgtagggattgtttgtaatcagatattgtgactagtgacgtgtggtgttttacatgagtttgttggccaccttgtgttattgtgttgaagcattgatttcagctctttgcagtgttctgaataatgagtgacactgattacttcccacatgtgacaaattgacctgtaacttgattcttctagtcgtgttgtaaggcacttctttggtccttgtccttttctgtttgcatgtccagagttctcttggcgtaaacacaaaaagaagagtttgtgcttgttcacgcaaatctctgtcaaacagatatacattgcaggagaggggtgagaaagttgtccttactactttgtgcttgttttgtttttctgtttgtttttctgcacttagaatatgaattatcctagataactctgggaaagttagatttgaaaagcaatctctttcacaaaaatccatggagaaacagtgttagacacaaagtttaattaggaatgttgcttttctcattttaattaaaagaatttttttttttttttgagacggagtcttgctctattgcccaggctggcacgatctcggctcactgcaacctccgcctcctggctccaagtgattctcctgcctcagcctcccaactaactgggattataggtgcttgccgccacgccaggctaatttttttgtatttttaatagtgacaggatttcaccatgttgcccaggctggtctcaaactcctgacctcaggtgatccacctgcttcggcctcccaaagtcctgggattacagatgtgagccaccgtgcccggccataaaagaataacattgttttattacattgactggctcagacttaattttactatattttatatggcttatgttaggcaaacacaaatatgttcctttcacctcagatctttaatttggaaactgagatctaaactggagcttttttgtgtgtatgtaactcaagagggcaattgaaactctccccttccagtaagttatattcttctttctctggcttgctttaggcagccctttaggcagtccgtttattctaggagggaggctttccagcattataaatggtatgaactagattattaatttgttttaattttctgattggcagttaaactaagcgaggtatatttgggttctactaatacaggctctagaggtttcacagcccccaggctacttttggaagtgtgctatttgctgttgcctggctggcatccatatccatttgttaggacattctggccattgtgcccagcagaaaaaacacgtggaagagaactctcctccagatgcccatgggagaaagaccaattagtttaccttctatttcagaggaatatcccacaaattcactaaatgctatacacaaaacatctgtcacagctatttaccatcctttctcctacacatgtttttttttttttttgagataggatctcactgttttgcccaggcttgagtgtagtggcgtgatcacagctaactgtagactctacctccccaggctcaggttttcctcccacctcatcctcctgtgtagctgggactacaggcgcatgccactatgcctggctaattttttaatttttttgtagagaggagatctcgccatgttgcccaggctgacacaagtttagtaatagcggtcaagctattactaaatgatggtttgtgatattgattgactctactatctgatctgcttttagtagagaagttcaaggacccagatggctaattgtccagtaagctggagatgatgacatgggtccagtgcccccgtgcctacacctaaggagtatgctgcttcttgtggtcactaatgcgtactctgccttgacctacagtgtcccaggtattactctgttttggagaactacttactatcaaatgactaatagacaacattatatttaagtaggtttataagctcccatggtattattttcaacttttaatgttataaaaaataaggggatcgatagactggattaagaaaatgtggcacatatacaccatggaatactatgcagccataaaaaatgaagagttcatgtcctttgtagggacatggatgaaactggaaaccatcattctcagcaaactatcgcaaggacaaaaaaccaaacaccacatgttttcactcataggtgggaattgaacaaggagaacacatggacacaggaaggggaacatcacactccggggactgttgtggggtggggggaggggggagggatagcattaggagatacacctaatactacatgacgagttaatgggtgcagcacaccaacatggcacgtgtatacatatgtaacaaacctgcacattgtgcacatgtaccctaaaacttaaagtataataataataaaataaaataaagaatactatgcaaagaatataggtttttaaatcacaccttggttggatcctggaccttctatttactgtctgagtggccttgggcatattatttgacccctctgatttccatttcttggaaagttgagataaaactaatagaatagtgctgttgttaaggtacaggcattcaataaatgttggttctcttccttcccccccctcaaaaaaaagggtgatgtaaatatccaataatgggagaaatttaaaataaattatggtccatccatttgataaacttttcatatagatactataaaatcatactttcaagccatattaaagaatatggggaagtatgtcaaagcatttcatgaataaaggagaaagcaatttaatgaaaaacaattttttctaatatacatagaaaaatgatttaaagggaaaataaccaaattgttaacaatagttgttatcccttgatagtattgggcatttattttttctttttattttcatacattttcacatttttctatgatgaacagcaatgaaagagtttaaaaggaaaagcctctatctgagcagattatccagcttggttggaggaggtcttatcttacttcctcccacccttccttagccgtcgcctctgtttcctcatttgacttcatgtatgttttgatccatgtcaataagattgtgactgattcaaacctgacatgtttgagttgttagctagagagtgggtttgttatccagatggagcagcctggactcagcagtctctaagaccccttctgatgcaaacatacagggctgacagtatgtacatgcactgtttgcttctgcaggcatacttggggtggtgcacagtttcaggccaacaaacttccccagggatgctttagcgataaaactgatctctccttttttttttaattttagatttaggaggtacacgtgcattcatatgcaggtttgttgcaagggcatattgcatgatgctgagctttgggcttctattgatcccatcacctagacagtgaacatagtacccaataggaaggtttttcagcccttgactgcctccctctcttcctccttttcaagtccctagtgtctgttgttccagtctttctgtccgtgtgtccctaagttgatctacccttttctaagtgttgaagacaaaatttgaaaaccagtactatattaactaaccagtaactctactgtaataatatagattaattgcaacacattctacagctatgtctgtctgaaaactgtgggtgagaactgctatttttgagaaaccaattcagtgacttttggggggaaaattcattactgctccaccagtttcaaggagaattcttatagctcggtttggctgtccaattaaggtttgatggctattccctgtaaaagggcgggcagtctggcaggtctttctcaagctctctcagctccagggatattctttagtatgctgtataccatgggttagcaaacaacagcacacaggccaaatctggcccactgcctgtttttgtaaaaataaattttactggaacacagccactctcattcatttacatcatatcaatggctgctttcgtgctacagtggcagggctgaatagctgccacagagactatggcctgcaaagccaaaagtatatactgtctggccctttacagaaaaagtgtgctgacgtccatcatatagtagtcacttgttttgacgatctttcccccttattagattgtgagttccagggggcagaagctggttctcttcatttttaatatctctctacaaaaatagagtgcttagtgaatgttgaatcaatgaatgatatatggtgacaaggaactgggtgaatggaagaagctctgctttacaaggaaatacaggagaaagtggagcagaagatgctgggtagattgctaaggtaaagaaatgtggaggaaggtgaggaacctgggaataaataggtgttgcctatagggtcctttcctagaaagtttgggaacttgccaaaggcagtctggagtactctgttggttttagaaacatataccttacaaaatgaccctgttttctaccagcttgatttctgaattgtttacctaagatatttaaaaacagacttaatgttggaagccaaaaatggttttgattccaacatgagaaaaattctagtcaaaaacagaaaaagcaatgaggaagatcagttgttttaactaagtactaagttgcaaaggaataatataaattagaataaggttggtttaaaatttttcctcagtggtcaattaaaaatattttaagtgtgaaaaaaatcattacaattttagataaaggaagagaaaatagtcccacaatcatgatacaaattgctgttaaaattttgttgtcttctcttaggctaattatatatagttgtcatcatagcattttatagtgttttttaaaatagattttaatttttagaacagttttaggttcacagaaaaattgagtggaagatacagatttctcatatacctgctgtccccacacatgcctagccttcccattgtcagcatcccccaccagagtggtacatttgttacacagacgaacctccattgacacatcattatcagttagtccacagtttacattagaattcattcttagtgttaaacagtcttatgggtttgaatacatttataatggcatgtatctacctaatgtataatatacagagtagttttactgccctagaaatcctctgtgctccgtccatccatccctaccctcccctgacccctgagaagtgctgatcttttcactatctctttagttttgccttttccagagtgtcgtatggttggaatgatattacatagccttttcagattgacttctttcacttagtaatgtgcatttaagattcctccatgtcttctataatttctttttcttctcttttttttttttttttttttttttgagatgggttctcactctgtcacccaggctggagtgcagtggtgtgatctcggctcactgcaacctccacctcccaggttcaagcgattctcctgcctcagcctcctgaatagttgggattacaggcagctgccatcacactcggctaatttttgtatttttggtagagatggggtttcgctatgttggccaggctggtcttgaactcctgacctcaggtgatctgcctgcctgggcctcccaaagttctgggattacaggcgtgagtcaccgcacccgtctataatttcttcccccaccccccccctccgcgaaatggaatcttgctcttgttgcccaggctggagtgcaagatgctatctcagttcactgcaaccttcacctcccgggttcaagtgattctcctgtcttagcctcccaagtagcttggattacaggcacccaccaccatgcccagctaattttttgtatttttagtagagacggttttttagtagagatggggtttcaccatgttaaccagctggtcttgaactcctgacctcaggtgatccacccacctcggcctcccaaagtgctggaattacaggcatgagccactgcgcccaggcaatttttttttttttttaatatagagacaggaacttactatattgcccaagctggtcttgaactcctgtgctcaagtgatcaacctgcctcggcctcccaaagtgctgggattacaggcatgagccatcatgcccagcctgctccgtgtcttttcctggcctaatagctcatttctttttagtactgaataatattccattgtctggatataccgcaagtttatccattcacctgctgtaggacatcttggttttttccaagttttggcaattataaataaagctataaacatctatgtgccggttttggggtggacataagttttcagcttctttggataaattccaaggagcacagttgctggatcatagagtatgtttagttataagaaactgccacaatgtctttgacagtggctataccattttgcattcccaccagcaatgaatgggagttcctgtaaatcctggccagcacttggtattgtcagtgttatggatttcggccaccctaataggtggatagtggtatctcgttgttttaatttgcatttccctggtgacatatgatatgatgttacatctttttatatgcttgtttaccatctgtgcatctttttttggtgaggtgtctgttaaagtcttagcccacttttaaaatttgtataaattcatggtgtacaagtgcaattttgttacatgcatagattgtgtattggtcaagtcagggctttcacccaaataatatacattttacctgttaaccaacttctcattatcgaccctccttctaccccctcgtctttccgagtctgcattgtctatcattcaactctgtgtccatgtgtacacattttttagcacccacttatgagtacaaacatgtaatatcaggcttttcgcatctggcttgtttcacttaagataatgacctccatttctacccatgttgctgcaaaagacataatttcattctttatatggctgaacaatattccattgtgtatgtataccacattttctttatccagtcatccattgatggacacttaggttgattccatatctttgctattgtgactagtgtggcagtaaacatacaagtgcaggtatatttttgatacattgatttctttttctttgggtagctaaccagtagtgggattgctggatcaagtggcagttttacttacaattctttgaggaatctccatactgtttgccatagaagttgaattgatttacattctcaccagcagtgtttaagggtttccttctctccacatccttgccaacgtgtgttattttttgtctttttgatattagttctgcccattttatttatttatttatttttgagacggagtttcactcttgttgcccaggctggagtgcaatggtgccatcttggctcactgcaacctccacctcctgggttcaagtgattctcgtgcctcagcctctcgagtagctgggattacagacatgcaccaccatgcccggctaattttgtatttttagtagagatggggtttctccatgttggtcaggctggtctcaaactcctgacctcaggtgatccacctgcctcggcctcccaaagtgctgggattacaggcgtgagccacctcacccggccagttcagcccattttaaaatcagtgtgtttgttttcttattgttgagttctaagagttcttcgtatattttcgataatagtcctttatcaaatgccttttgcaaatgttatactttcagtctgaggctttttactctcttcacagtgtcttttatagagcagaaatttttattttaatgaggtctagcttgtcaattttttctttcatagatcatgcctttagagttgtttgtgcagtttttgtgtcctgcttttttcacttaaattatataaaaatcattttctcaacttagtctaacactcatttttacataggatggaatattccatggcaggccagtgcgatcattcagaaatcatgctcggccgggcacggtggttcacgtccataatcctagcactttgggaggccaaggcgggtggatcacttgaggtcaggagtttgagaccagcctgaccaacatggtgaaaccttgtctctgctaaaaatacaaaattagctgggcatggtggcgcacacctttaaccccagctacttgggaagctgacgcaggagaatcgcttgaacccaagcagcagaggttgcagtaagccaagatcatgccacagcactctagcctgggcaacaaagcgaggctctttctcaaaaaaaaataaaaaagaaatcactctctaagatcaggcagagcagggtgcgacacctgaactgctgtcctgaagtttcaaggcctgcagaggaatcaacaattttgtttgtacttgccacaaggttccctctcaaaacagcccaagaccatgtggtttcttgtcggcaattgttacttctttcagtttccttgttaagggagagaatttaacactttgagttaacaaaatactaagtgatccataatctgcagaaatgttaaagcaaacgtctcttctctgtttatttccattccactgccttttttgttaagacagattcatcttttttattatagtgtttatttttaatatggtatcaaccctttaaagtagttgaattgtatctggtataaagagtcataaaggaaatgtatccagagtttgcttggtagagtaccatttaataaaactgagtagaaattagaatgatgattttttttttttttttttgcaagtagaagagatctaagagctatctagaccagcttccttgaactctgttgtttttcatttttatcaatgaagtaaatgaaccctagaagattacatggctggtgtgggtgaccaagctagggtgacggtgccaggaccagaactgaagttttttgacttctggaaccctttctgttacaccatagtactttaaaaaatttttatcaacttgcttgctttttctgctttatatttttttggctttttgttttgaatgcaaatacaactaacattggcccaaggattggcactagaatgagattctaggatctcatggctaaaatctgtagaaaaattggttagaatttcagattttttttttctactagagaggtgctgttgtgtgttaaaaattcttgctcttgccaaagacacatgagtgtacttacttatctctaaatagaagggagccagctgcttgtgtccttgaaagcttacaggatctctgagacttcaactctggttagggctagcttgggaattggtctggtccagacagcctagagccccacagcatgggaattgttctttatgtctggagtaggcttagcttggcagcagcagatttaagagccctgaactagaagacttgagaccagagatgtaaccatcaacttaccctgcagagaggccaccattaacctggttcctcattcttgcttcgaaggcctagagtcctggggtgtgcacattgccatgatggtgagctcctagaaattttgaagccatggaaaagaaagtgccttttcttaaggagaatatggaaatctgggtaaagtgtaatatattgaatactcactcttttattccgctccaaattcatttggttattttaggcacatcaaaatgatattacttataacttggtttgctcccataattagttctgtttagagacttgagagcctgaaaggaaatggggaaaacattgctcaggattttttcaggaatctctaagcaactggtagacctgcctcagagaagagggaggcatagagaggcactttgggagattttaactcatttgtttacactgaggagtgttttttggtttttttgttttgttttgtttttggagacggagtctcactctgtcgcccaggctgaagtgcagtggcgccatctgggaaacttcacctcccaggttcaagtaattctcctgcctcagcctcccaagtagctgggattacaggcagtgccaccacatctggctaatttttttattttttttagtagagacggggtttcaccatgttgcccaggctggtctcgagctcctgacctcaagtgatctgcctgccttggcctcccaaagtgctaggattacaggcgtgagccaccacacctggctgagaagtgtttaacttatactcatattcaagtactaatttaaattaacaaatctgaatctagagaaatatttttagagcatatatattgataacaacataatctataaataagctatgtaatgttctagtcatcagtgagtatgttgattagtattgtgttgtctgtgatacgagtttttgtgactcattcctttctggtttaagttggtgagtgagcaaagtgtcattgcccttcattgtactttctagcccacttaaaccttgtatttatgttttatgattttaaaacatgaatctgcccttttttccttaaaagggcagatgaagatagcaaatgttaaaaacgatcagctttcctctgtgactagactttcctgatggcacacattgctcaaatgtggcttgactaggaattcacagactttcatacttctgaatttaaccttgtcttccagctaccagcatttaatactgctgtgtaacctctgactttttttttttttttttttttgagacagagtcctgctctgtcacccaggccgtagtgcagtggtccgatctcggctcactgcaacctctgtcttctgggttcaagtgattctcctgcctcagcctcccgagtagctgggactacaggcgtgcgccaccatgcctggctaatttttgtagagacggggtttcaccgtattggccaggctggtctcgaactcctgactttgtgatccacccgcctcagcttcccaaagtgctgggattacaggcatgagccaccgcgcccggccaacctctgacttttataagactccttggtgtatttggtcttgcagtttaggaaaaaactaaagtagatgttttagggtacttattttttgtttctccacattataagatgtctacacccaatttaaaattacacatttgttgaatagaaaggactatatttttagatactgatttttcataatcagtggattcaatatgatttggtgtgaataactataaaacagagcaaagtgaagagagaatccaagatgtccctattttgtgatcttagagaaacatttcaaagccactagcaaatttgggggctaatgctatttactatctatctttctatcattctttatctcttgtagggaactggcctgggtcagggttaggagtggttgaggctggctcctagctccagggcaagagagaaagttgcaacagaaggtggagaagaagattcagagcatgtagcccaaggttgttaataggcatgaagcaagaatagaatccaaagctgggacctgaccattgggttgaagcaagacagagcggtcagtttaggagacagagcctgtgagcattccctggactggtaacccaggggcaggtggcctttcatggaggattccatccttctcccaaggccctgatgagtccttagtggggaaccacagtagttaagtgggaaagataacaaacaattatcttgaaaggtgcaagcccatcttaaggtaattaaaggaacccaagattgtctgctaaagtggggtggggagggggcaggtagcaaaacagattgtatagtatgaatccatggaaaaatatgggtaggggccgggctcagtggttcacacctgtaatcccacactttgggaggctgaggcaggtggatcagttgaggtcaggagtttgagaccagcctggccaacatggcgaaaccccatctctactaaaaatataaaaattagctgggcgtggtggcatgtgcctgtagtcccagctactcaggaggctgaggcacgagaatcacttgaacctgggagtcagaggttgcagtgagccagggtcgcacctctgcactccagcctgggccacagagtgagaacctgtctttaaaaaaaattaaaaatatatatgggtagggccgggtacggtggctcacacctgtaatcccagcactttgggaggtcaaagcaggtggatcacataaggccaggagttcgagaccagccttgccaacatggcaaaactctgtctctactaaaaatacaaaaattagctgagtgcagtggcgggtgcctgtaatcccagctactcaagaggctgaggcatgcaactcacttgaacctgagaggcagagattgcagtgagcagagatcgtgccactgcactccagcctgggcgacagagcaagactctgtctcaacaaaaaaaaaaaaaagaaagaaagaaaaatatgggtagatatatttctcatgtgcacagaaaattacttgaaatatataccagatggtcaattgtagttggctgccagagacatttactttctgcattgtttatttctgcatagtttaagtttttataacatgcttattataccataatagaatgtaagctcagtaaggacagggaacttattttcactggtttgtcacagtacacagtgcttggctagcacagagtagatactcagtaaatacttgttgaattaataaatgctacctttgtgcagggaaaatactaggaagcagggagggtggcacccagtaattttatcacagtgcaactcaaaggcttttgaagttagaaaacctgaatatcacattagacccaatcgaggactgcacatccagtgtcaaactctttgttatttttgaggttattaataattttatttctaaatagaaagtctctttgctccaaaccccttttcttggtatttcacagaaagttttaaaatccagcactccgtcagtagtttttcccaaggctttgaaagaggtgtaagaatttctggaagttacaagggaaaagaggagaaaagtcctctgagacactgttgtcaaaaaaggcatttgctctggcagtggggttggttgtgcttcagggccaaggaatctagacagaagcctcatctcagccaggaacagggaagataatctcagtttgccttgtcttattcatcttttctggtgggtctagccctctctctcctcgccagtcccagatcattctttgtctttgtggtagctggaaatacagctcagatcccacattaaaaaaatatatatattatactttgagttctgggatacatgtgcatgagttctgggatacatgtgcagaatgtgcaggtttgttacacaggtacatacatgccatagtggtttgctgcacccatcaacccgtcatctacattaggtatttctcctaatgctatcccgcccctagccccccacccctcaacaggccccggtgtgtgatgttcccctccctgtgttcatgcgttctcattgttcatctcccacttatgagtgagaacatgcggtgtttggttttctcttcctgtgttagtttgctgagaatgatggtttccagcttcatccatgtttctgttccaaccttctctccaaggagatcctccaggttagaatatgtgtttggctgctttctctctaatgctacagagagaatgttaaatttgtttgttctcttctgctttgaatgcattttgcttgtgtcaggagtagtttgcggaagaaaatctgatcttggtagacagtgattcaggctttgggggttcccctagctgctttccctacaggtggctacacaacagggtgctgacagattgctgcagagtcacctgcttgacccctccctgagtgatggcgaccacagccggcctttctacttctgtgaggcataaaataatttttcggaacagcattattctagctgagatataaaattataataaaaatgtatgaaattttagaatgggaactgtgaaaactagacacttagatgttctagctagactaaattgaatatgttggctatagctgctgctgaattatttggaaattatcaagtgggaaaaaataagtagtagagacatctgtctagtaagtttagtgtgttttctgtctctgtggaaacatgtttttgatttatgtttttctagcactatgtctgagcagatatactttgtcggacctgattaattttcattttctgctataaccataatattttctatacctatagtttgactctgtttatattaatatacaatatagtttgagtttattttaaccattgcaggaatttaaaactatcgtattctgggatataaatgtggtaatagaggcatgattttatacttaaacagggttttttgtggcttgaaaaacgtggcattttagaaactaggcataagtgaatttaagcaaacagtttaccgaatgtctccatatctaagaggccaaacaggaaggtgattatggtgtatggataaattatgaagtaacatgtaggttattggggagggggcttctacataaacatgaaaaaaaaaatttttatgttgagtcccgagagttcattctatcaaaactgatttctagataggctgtttgaaagtttactccctagaattgagaaggaactattacaaaactttgaaaggctttgtgttaaattctgagtcagtacctctgttggcatataatgaatttagtttttcatctaagggggttaggggtggattccctgaagggaaggtaaccccaaggaaaaggaaccatattctttaaatattattcatgctatcatttagaaactggctatttggatactttgccagccaatgtgggtatatttcatctttgcaaatctcttgggtacctcttagatctttaaaaccaactttcagtttcttttttataggtagaatgacaactctcctctatcacaaggtacatttcacttttcttgttagagtgttccaatagattcaaaacagaaacacaaattaatgaattagaaaggaccattactccccccacactctgctccagagcaagtattgcagactcagactcctacaggagtgagtgaggcaggctagggtgagcactctggagtctggcattgtcatcattctcattcagtactgaacctgacacctagcatttggggagcataaacccttccaaaggggacagccagttgttgccatgggggattgtaggcccaatgttgccaagtcttctgatactttggggagatgctgaaaatatctttacgtgaaacctctcagttaaaaaactttttttttaacatcatgtaggaggagggtcaaacaaaacatgtttatgggctatattggctcaccagtttgcaacctctgtgcctcactttttctgttatacttgtgttttgctccctctagccctctggccccaccagtgaaaacttgactttcctttagcaaggacttttctattagggaatacctggtaaatcctatgaactaatctgccatatattaatgggacctttttgctttttcttcttcagtcttctgtgctcctagaaaataggccatgttgatggtacctctctagagtgaaacaccactccctttactgttaaattcccacacctgactgtgaggctttcataccgcttagaaggagaggggacagccttgtgataagggtggtttggggccttctggcattcctcaaactatactgtgcagagagctgcttactccatctgtgtctaggactggtaacttcttctacatcaagatatttttctactgtgttctcagagcacaaaatacaccaaaactcaggatgtgggtcctgcttcttcacagacgacacagggttggcttagaatttgaacttcgcagcaccatttcttgtagcgtgtggtacagtgaagtctcaagtcagagcagtgcctcctctcctgcagtcagtgttgtacgtaaccaagagatctttccaaagagagcaggacaaacaggacaataaactgcagctagagaatctaaatttagaaaaactattattttgataggagcagatgaataggaagtagttgaggtagatttaaaaactgaggcattctcggccgggcacttggctcacgcctgtaatcccagcactttgggaggccgaggcgggcggatcacgaggtcaggagatcgagaccatcctggctaacacggtgaaaccccatctctactaaaaatacaaaaaaattagccgggcaaggtggcgggtgcctgtagtcccagctactcgggaggctgaggcaggagaatggcatgaacccgggaggcagagcttgcagtgagccaagatcgtgccactgtactccagcctgggcaacagagcgagactcggtctcaaaaacaaacaaacaaaaaacaggcattctctgtatcagaaagttaaagttccccttttttggagtgacctaaaaagtttatgttggctgagcatggtggctcacgcctgtaatctgaacactttgagaggccgaggtgggaggatcacttgagtccaggagttagcttgaccagtctggtcaacatagcaagacccaggctctacaaaaaaaaaaaaaaaaaaaggaaaaaaagtaagagacttggattttccctaaggttttgggttgttctgaaactgccctgttacatgggcaaatctgagagtgtcagtgaatgcggaacagaatggggagcaggttagtagtatcctcttttaaaattatcgaataataattaaaatgttaaaaataagttatgcatattatatctgattttgaaaaggaagagataaccactattttatatcctcccagcatttttctcttgcatatatattctttttacaaaattaagctcatactatgtatgttttgtagcttttatttttcacagactctatcatgagcattcttccatgtcattgaatattcttcattggtgattttttaatgatttaattttttaatgacaatcaaatatgaatgtactgtaatttagccacccttctgttgactatctaagtgcttctgattttttcttattacaacagacaagcttttacataagatatgaatattaatgactgctgatacacacttgtcaaatctgactagattcctttatggaccttactaaaatgactagttcttggcactcacagctttattcttgaagaactttaagaagtcagtaagtaccctatttccctaaatgaccagttgtgtgaaagtctctagaattcttttctgtctctctttgcattcctttaggaaaattaatgtgtttgccttttgtgtttgacagattatggagcagagacataaagtactttgtaacatggcttcacctagtaatcaggtcatcaagctcttgcttgtttttgtacacttatgccttgtagtcactacagtgacaccagaggcagcttcatgtcagtatttccaaatctgtggtttatacctgctacactgaagcagggtcatgttagtgtaggcctcacttaagatgggatatatctaccatattcttaaaatacatttttctgtgaatgacccaagctacctgtcctgtcagtgtgagtgacctggaaaggagagagggaggagttggtatagagggtaatcagtatttcttctgaggacagagctttgatttatgagctcaactttctgcacagacagctgtgtggtccttaaacaagtcttgtcttgtatgattaatgtgtaccaggggaactcctaatggaactaggtactaatcgagatgaagcagttgctcttcattaattcttttcatgtgcacctgccttccttaaaagcaaatgcccacttacccctgttcccttcagccactatttaaattaaaaatcagatggtctgctgtagataggtttccagagcctcttatgtcgtaacactgaccctgttccattgtgagcactgaggagatagacacagagtgaagattagtgacatgatctataaggattggaagaaactttagaaatacagtcccagcttctaattttgtagcacagtccctggcttcaaagaacttatagtcttgttagaaatacaatacagtcacaggaaaagattaaacatcagaacagcagcaacaaaaagaagcccagcacagggcgatggtttgatgccaaatgtgaaacactaacatggagagctttagggttttagaaggagaagagatattgggcaccgtgtgctggagagtttaatttttgttgttttttaactgagccttgaagaatgggtaagattgaaaaatggaggccattcctcccaaagaggtaacatagtaaaaggcagaaaatgtctggaaaacaaggagtgggtcattttggctgatgtgaagggtttgttagaaaacctacctttcaattagttggctgtataatttggagatgactttttgaagccccttctcctacagagcaagcagcagggtaaattctgtattgcagagcctagagcctctctgtcacttgctctttagagttcatagataaccagcaaagctgaggctccttatcatccccaggggttcatggggtccaacctgcagcccacagacatatatctttaggtggttttctggaatgggtatgggctgtgactcatagtcacccctaggtgaagtcttggctgagaaaaaggtctgcttcttttttataagacttgattcctggggaaatttactgccctgatgccttaaacttcccctatgctttcagtcaggcctcataaagctgaagtcaggcttaaaaccatgaagttattggcagtagccactgaagacttttaaactttcagtgaaggcatagtggtgtgggctgtaattcaggtaattcacaagagataagaattacaaacatttagacatagtatctccctaccttttcagatacttaaaaacaatacccatttcaactaaaagctaatacttaaatactgtgtttcagctgggcgtggtggctcaggcctgtaatcccagcactttgggaggccaaggcaggcagatcacttgagttcaggagttcaagaccacctggtcaacatggtaaaaccccatctctacaaaaaatacaaacattagccaggcatggtggtacaggcctataatcccagctactcaggaggctgaggcacaggaatcacttgagcccaggaggcagaggttgcagtgagccgagatcatgccactgcactctagcctgggcgacagagcgagactctgtctcaaaaaaattttttcaataaataaatactgtatttattttaccaccaggtgttcttccagatactcaaagatatttttcctctttagcctgtctgaaaggctaacatttgaacttcattcctttggtcaattagcagattgccctttattaaaatgtaaatctcttcctcttaaaattaaatttaaataattattaatcatttacattacagtttatcttaattgggtaggattagggagaaggtgagatatagttaaggtttggagtaagagtgatccttaaacttgacacttttgctttgaagtcagcctggcatctgacacagggacctgagaaagtgctgctgtatgggtcccaactcttgctgtgagttagataataggattcagaggtagcttcacaactcccttagaagttgagtgctatcttttgaaattatcagtaaagtgagtaggaaaagttgcctggacctgatgtgtaataatttagaaccctggcttgttcagttggacaaaaatggacatatttattgtacatataaactccagctttgccatgggccctgtctgtgtccaaagtggtgatgccacagggcaggcctttgtaagggtgaaaactggttccacaagaattaggcaagaaggaagtgcatttatttcctgactaagccttattaaagcttggtccagatgtatctggcccattattttttttttaaatgagattgtagctcttctggagaaaactactcttttatcccttaaaattctatagtctagggaagagtgtggcccttaactcagataaaaggggtttgatgttttcctccattctctctatccctgtctgctgagattagtttcaaggcttataatctattacttctgcctcgttttcttcctgatcattgcttttaatttaggtttcagctaatgacattttaataaaatcatattaatacatttggcgattttgcattaaccttttaacaccacttaataaaaacttctttgtacttcacactaataaattatatatctgtattttacctataaagtattgaacttcagcaccaaagggttaagtatgccattaagacaaatagtagttatctgtttaataaatgcttctagcactcaactatcttgattcagttcaatttgctaacacatacttcttttttttttgaaatggagtctctctctgtcgcccagactggagtgcagtggtgtgatcttggctcactgcaacctctgcctcctgacttcaagcgattctcctgcctcagcctcccctggtagctggaactacaggcacaagcccagctgctttttttgtatttttagtagagacaaggtttcaccatgttggcagggttggtctcgaactcttgacctcagatgatctgcccgcctcagcttcccaaagtgctgggattacaggcctgagccactgcacctggccacacataattctttcaaaactcatgacatacatttttctattgggcaaatgcaaaaattgagatatatcttagaaaataggattgtatagtacgtccatacaatggaatattagtcagcaattaattatttatggaaaatgtctaatagtgtgagaaggtacttgtgatttataagctgtatatgtggtactctctcaccaatattaaatatatttacatgtacgaagaaatagaaaaaaacatacagaaaagaggtacaccaaatagtgagcagttcgtctggataagaggattatgagttatttatatttttatttatacttttccattgtttattcagtttttgatactgtgactgggtatcaaaaataaactcaatgcaggtggtaaatcattttgctgcctaccttagtaaagatttaaaatatataatggacattcaaggcaaattaatgctttctgtagacagctaatgaaaaattgtccatcataaattttttaaaattgctgagaattttgccatttactgttttatgttatcctgcatgccattagccattgggcagtgttcttgtagagcagtgtttcttaaactgggaatgctggtgttaactctcaggcttgctgcagcagtttggaaaataattcacaatttggaaaataattcagttttacaaaattcatggtagcagttatgaaaatcctgaagtattttagttctgtgtcttatgagattattttattttttaaataaaccttttcttattgaagtataacatatatacacaccagtgcacaaatcaagtgttccatttatgaattttcacaaagtgaacacattcctgtaaccacttcattttatttttgttgtattgtgccactgttagtctttgataaaatttttatataagcttcacattaaaaaatatattgttggctgggcacggtggctcacacctgtaataccagcactttaggaggccaaggtgggtggatcacctgaaggaagtcaggagttcgagaccagcctggccaacatggcgaaacctcgtctctactaaaaatataaaaattagctgggcgtggtggtgggcacctgtaatcccggctactcgggaggctgaggcaggagaattgcttgaacccaggagggggagattgcagtgagctgagatcagcctgggcaacagagtgagacttggttaaaaaaaaaaaaaaaaatatatatatatatatatatatatatatatatatatatatatatatttcatgttctttggtcttcagaagttataatctagatattttatgctttttggtctcataactgcattagctcattggatttttacatttttcaaggaactctaaaatttcgctcagaataaatattgttatttttagtttgtggtgggaaaagattaaaaaatgaaagaaagtaacaactacaaaattctcacaatctagcctctacagatttaatttttctttcattcccaactgtggcatatgtttttccccagcgactggttgtgtggaacttgattcctgtgcatctgcatatgatgcagcttagtttgctaatctaaagaggcaaatcagcagccatctgtaagtgtgtcaggcctagaaatcctagcccaaactgggaggaactttagagttatcagccgtagatgaggaaactgaggcctggaagattacacaccttgtgcagggtcagagagttggcgccagagctgaatgtagaaccctgatcctaaactctgttactaaaccaggcttagcccctattttcacctaaaaactcaccctttctactgaaaatgcaatcctcagactgtgaaatcagcttctgaagaaagacaaattacctaacacattttcagccaaatttctcaaagaggatagcctgacagcattgacctctttcggaatatattctttgggctacttaggagtgaatgagagacagtatggtgatggtataaatgccgatctgtaattgtttagagcagttctgagagtacattcaactggaataactctggcaatagggaaagtgtggtgtgatgtcgacttgtgacccttccctggggagcaagctgtcaggacacccagcggtgcttttggaacaaaaggtttctaggccatgctcccaggcactggacaggaggactggctacttgcacctgcagggtgactgtcagtgttttatgatttggggttttgggggttttttaaagttgcctaaaggtagatatgtaaataaagctgccctatgtcaggcaacatttattgagtaagcgttgatcactgtggagggctctggggatttagtgcttaataaaacatgtctctaagacttagtctttggagctgacagttccaaagagatcaccattgcccttcagaaatcttggttctgttggtatgttgaattagtgacatgaacaagaatctcatcagagcaaactgactttacctacttgtgagtttgtatcctgatggaaaaagcctcttctaaataaatattgttattcctagtttgtggtaggaagagatttaaaaaatgaaagtaataactacaaaattattgagatccagcctctgtagatctaatttttctttcattctcaactgcagctcacatggcagccatccttgacctgaccttcagcaccactctccacagtcctatctaccagatctgttctatcctttcctactctctccccagtacaagcttttctcagaagccagactaatggcttgcccgcacatgtctatggctgttcctgcctttgagttttttaatacatttctcccctcatttagaatgtcccctcctcttctacttctccaaatcctatccaaacatcagggcccaagtcaatctctacctgctctgcaaagcctttcccagtcttctctcctcagactcacatagcacttcttcctctaccatgctgtggatgacatggctatagtttggcctaatggtgaagagaatggactctggagctagactgcctggatgaccttgggctgcatcctttcctagcctagagttcttcatctgtaaaaatgggaataggaattgcatttggcccatagttgtacagattataggattaaaccctatagaacagtgcctggcccataagttctcattaaatagtagctgttgttattattccttctggcatatatttaatcatggccttccttgtcttattgtttaatcatttaaattatgtatttcttggttcctatttctttgttcctaattgtgaagttttcccatgaagaaagagacttgattttatagttttcgtttgtttgttttttgttttttgagacagagtctcactcttgtcacccaggctggagtgcagtggcatgatctcagctcactgcaacctccacctcctgggttcaagtgattctcctgcctcagcctcctgagtagctgggattacaggcacgcgccaccatgcccagctaatttttgtacttttagtagagatggggtttcaccacgttggccaggccggtcttgaactcctgacctcaggtgatccgcctgcctcgggctcccaaagtgctgggattacaggcatgagccactgcgcctggccgatagtttttgttgaccattttcagcactacatatgcatagtaggtctccaatacctgtcacttaaagtgaaactattactgcagtaaagaaaatagatggaacaagagtaaggaattgacgagaaaagataggcttcattttacagatggagttctcttatgattcttagagcatgtaatttgttccttttttcattgttattgagtctcgtgagctcttctgccgcaatcaccagagttgtgaacgtcattcagcaaggatgctgcaatttctggaggtcgtcgcagaccgttttcttctaggcccatggtgggacgcagtctcagacagtagattctgatttatcaaaatatcacaaagcattaagtggtaggtcatgtgctagttgtttgaacatatttcccttgctgagggcatgaaaagccaccagaagggagcctttagtcttcagccaccctctctgctgtccctttctcctttatcagcagctcggatggatattcacaagcaccatactcacctgtcactattcataaacagggggaagttgaaagttacaccccagtaggaagaggtagggacccaggtggaatcattcaacaaaattaacccagttgcagacaggagtcctcatcatggcaggaactgccagcggggtcctttttctgccattcacccagcagtccaggacccccaccaggtccctcccagctctgtgggtgccctcacctagatgaaaatgctgcatttctcattctcctaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagtacgtgcacctttcaggcctttggccgtaagcccggcagcttcactgcttctcctgttgccaggggttggagcacaagatttatggtgacagagacctgctgagaggtttttaaataaaatgtttaaaatactttatttagtaccagatattcaacatgtttataaaatctataaaaacttatttcattgccacaaaacagtttattaatattactgtttttgtcttctctcatttaataacttcttagtttaaaatagttattgagtttttggatagtaaaattgacaagaagtagttctgtcacattttgaaaattttgctcctttgagtgaaaatttctagaggatttgactatatttacttttatttccagaactaaaagatgacattgaactttgattttatttgaaaaggcaggcagaaagccaggtcttctgtgtgaattcatttaggcttttgattagttcattctggaattacttcttaactcagtgtaggtctgtccttttttctttttttaaatctcccagcaatgtgtgcccgtggtagtgatgatcattacaggctgttggctttctgggctttccctgttgaaagaggagttcaacatttttaaggaatgtaactcaaaagctagggcattacaggcaaataacctctccattgcctctgaccagcatttgtggtggttctagcattgatatgtagagaacatcccagtgataaactcacctcatgctgataggtaaagctgggggtggtagtaagcaggaaatatggctgaaatttctatctgaaattaagcatcctgtgactctaaaagaggatttggggacactgtgagcaaacatcctgagctggaaaggaaaagctgtagtaggctacagcaaaattgtattcaggaaaaataaaaaccttcccctttccaccccttaccttagtttcactggggctggtcccatcagtggttctttggtgggactgaagttctttcagggtgctctggaacattagaattagttctacaattatcttcccctctgttcaaaatttgttttaccctgttttctggatgaccttttgtagatcacttacttgaacagagcagaggctaggtcttaatctctgttttgtaaggcagcttgtttattggtgtttaggaattattaaagaataacagtgtgttttcctcaggcattctgggcattgacatttttgatttgctgttcaaacctcctgtttaattggccttaaggtgataaagagatgtttctcaagggtttatagtgggcatttgtaattttaagactttatatgacaatcatttccatataggttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggtatgtccatgtcacctgagtgtttaatccaaggttggctttcctttaccaacaaagacatgggaatttggtgccttgggcaggattggacgtacagcaatcatgcacggatggattgcttttaagtactgttttattaactggtttaaactccatgtgtgcaagcttgcactatcttataacagctttatccctcagtgacctcatctataaagtgggatgagggaatcaccatgtttcccatacctgggaggcaaagtactgctcataaaaaggtttccagtcactttttgtcagactgatgattactaaatgcattgagagattctatctggaagttcgttccctttagagagctatcattactctccactcttaggtatatgtgtttctgaagtttttatcttaaaatggaagaaagataaaatcttggttgcccaagcactgtgtactggctgctcaaatggatatcagcaaactgtcaaatgaaatggaaaaaaaaagtgaaacataagtctctactagatggaattacatttatggcataatgaaaattggggactacctcctataccactggaaagtacccctgtgtgcaagtattccaaaaactattagatagttaagagctttttttttctttttgcttctacttcacttatcactttttcctttgttttcttgactagtgaagtccctctgcatgtgggaatcagttaggtgtttgcagatatagagcgagggtaaattattatttatttcacttttaaattccatcctaatttgtatctacgtggtataattcaactgtaatttttccttgaattttgctttgtcgtaattaaagttaagtaatttaacttttggcatgttgatagccttctttgtgggttctggcatttgcagaataattggtgaatcatttcaccttttaggaaataacagcaagtgagaactctctcctgtgtgatcctgcctccccccagcagatggctgagctggcttggcccatcagcatctatacagacttacaaggcccttgactagcctgcctacaatgtgggattgtttgtttgtttgaagatgtatttgcattctgaagcacttaaacttgcaggagatgttcttgaacagtcatctagtgatgactgctctcctctctcctcaattcatacagcacctgccctttctgaaaaattccactcaggaggacatagcagttccttaacgatattgcttagtgtctcccatgcctgagaatcagtaagttgatttcagtgtctaccccaaatcccttttgcttccagttaagcttatttatcttatccctggatagtccttgtttttcataacttattctttttttccttctttttgagacggagtctaactctgtcacccaggctggagtgcagtggcgcgatctcagctcactgcagcctttgccacccaggttcaagcgattctcctgcctcagcctcccaagtagctgggattacaggctcctgccaccgtgcccagcaactttttgtatttttagtagagacgaggtttcaccatcttggcaggctggtctcgaactcctgacctcaggtgatctgcccaccttgacctcccaaagtgctgggattacaggcgtgagccaccacaccaggcctgccataatttattcagtaaatctcagggcataaatctctgactggaccttccgttttggtaggcagagaacacctactttcttcattgggctgtttctggaacctagacagtaccagctttggactggccattgccatcatctcttttagctcaaccttatgatagccctgagaagcagctcaacagtgtgcccttatttttctgtttactccagtcttgtggcaactttatgacaagaaagacaaaagtcccaatgcgtagcccctcaaaagtggggggaaaatttttttctagttcaccgccccctgctggacatagtacatgttcagttctatctggctttgtgtgtattgtctcaagtctcatggcctggtgggaagtttgctggattgggaagccagaaaatctcagttcttatccctattctaagacctaaaagctaggtaaccttgaactagtattttatctatgtagcctcagttttcttatctggaaaatgggataaatataccctaggttgttataaggattgaagaaggtagtatgggtaaagtaccttagtgtctggctcatctagacactcagtaataattattgtatatatgtatgtattttgagacaggatatcattctgtcacccagactggagtgcaatggtgcagtcatagcttactataacctgaaactcctgggctcaagttgtcctcttgcctcagcctcctgagtagctgggactacaggcatgtgctactatgcccagctattttttaaattttttgtagagacagggtctctctgtgttgcccaggctgatctcagactctgggctcaagcagtcctcccaccttggccttgggagtgctgggattacgggcatgagccaccatgcccagcccagttattttagagtattattgaaattatcaaaggacacagagaactgagcagactgagccaaaagctaaaacctgacagaccctggagtataaaagaaattaaaagaaatataaatcccacaatacaagtaaacctatagtcttttttttttcttttttttgagacagagtctcactttgtcacccaggctaacgtgctgtgacaccatctcagctcagtgcagcctctgcctcccaggtacaagcaattctcctgcctcggcctcccgagtagctgggattacagatgtgtgccactacacccagctaatttttgtagagagagggtttcactgtgttggccaggctggtcttgaactcctgacctcaagtgatccacctgccttggcctcccaaattgctgtgattacaggcgtgagccactgcactcggccaacctatagtcttttttaaaattttatttatttatttatttatttgtttttgagatggagtctcactcggacgcccaagctggagtgcagtggcacgatctggactcgctgcaacctccacctcctgggttcaagcaattcttctgcctcagcctccccagtagctgggactacaggcatgtaccaccatgcccagccaattttttttgtatttttagtagagacggggtttcaccatgctggtcaggttggtctcgaacccctgacctcaaataatctgcctgcctcggcctcccaaagtgctgggattacaggcctgagtcacagggcccagccccaacctatagtcttttaaatcactttatttccttctcttctttttcaaaaggggagaatgcaccgaaaccttacggaatcggatcagagaactagaagcagagggcaagaagctcacgatggacatgaaggtgaaagaagaccaaatcagagaactagaactaaaagtccaggtaaggggggaacaaaagacttcccttgtatttgaattccacttttatgctaaacttgtgctctgtgttgcagtgtagagatgatgccttttaatatagatcaaatctcattgcatctgaaaaatctctatgtgacaaaaagatttgaagttctaatcttgtccagctcatttcaagtcatattaatgtagccagattctaatacaaaccagaaatgttgacaatcccttggtatgttttataccaggatttaacttgctgtagattcatttaactttttcaggttataggccagattagtgtcctttgaaacttacacacctccttttagccccaaccctctttctattgccaggggactgaccctcctgcatggctctgagccttgcagattgttgttcatagcagtgaatgataggaaaggtgctagtgctatggacgtagcctgttttatgggctgtgtatactttagccaaatatttgtcatttaaactaatgtcatatattgtaaagttacagtaatttgagccaggtgggacaagtgaaaaattactgtcaagtcagtggactagaatgatggcctggagtacagtaccgaaaaaaatacgaaaaaaagtaaaggtggcatcagagatagatgggaaaggtaacgattagtcagtaaaaggctttggaatagctaaataactggagaaaaaaaattagaaactcatctcatgccacatataaagaaattccagatgaagagttgaaggcagaaaaaacaaagaataaatgagtttttaaaaactaggtggaaatatacttgaccttgaaacaagggaaagattttctaaacatacaagcaatgggaaaaaatcacaaagcaaaaatcataataataaatgaaaaaattgattggggaaggtatgaatattgcaacaaatattataaataaggaattaatattctcaacatatccgtagctcataaaagttgctaaggaaagctcatatatatagcaaaataggctgaggatgtgaacaaataattcagaggaaatacaggtgactgataagatcataaaaatataaactcaccaatcatcaaagacatgcagattaaaagtagatatcatttttctcctatgaaattagcagatgatttttaaatgagaatatcaatcatggtgaggatgcaacaaaataggcctcatacattgctggtagaaatgtaactttctggaaaaggtcttgcactttttaagtatttaccttttttaggaatccagcctaaggtaaacaattttaaaatctcaccaatgagtgatgtacagagatgttcatcgtagtggtataaaaatgcaaaaaaattgaaaacagtcttaacaatgggagagtcatttaaattttggtatgtaaacattcaggaatattgtacagccaataaaaattttattttcaaacaatagttaaaatcatttagtttttaaaagactatgtacaaaactgtacatttaatatttcacttctgctaaaagatacacatatgcataaaagattaaaagaaatattaaattttttagtgttggtattatgagtaattttcattttcttctttgaatttttctatattcctaaattctctgtaataagtttggatttttctgttaaaaagaaaaattcaaatatctgtatatattaattgtttacattaaagtgggcttattctgcagtatgccctgtcaaaataattaacatttttacaattattaatgcaggttgagttttggcaagttcgattacagcattatgataatttgcacgtggccagcaaggaaaaatgttttctgtggttctgaattaagcttataagaaaagtgttttatttggaagcagattccattgttttctagacacatgcccagcacagtcaaatgatcatcttctaaatatttttgtatgtgcttattgccatataaacacatttagcacttgcctaaacccatgaaacaccagattttgtgttctagtggccagaccaagaatagtgggatttaatttgtgatttcaggctaatttatagacatcgatgccaaaactaccttgtagcattgctgttttgatgatattgataggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggtaggagaacgtgggcccctggtgaggtggtgtgactgataatgcacagggatgcacaggccagacctctcctgagagctctcaaccaaggggcatttcagttttctcttcaagagtcttggtaagtgcccaacattgaaatataggaaccatcacattaattcatttgcagacatattttgagatgagaacatgtcaagtgcagggcatacagagaatagtatgatttctacattcaaggagctcacagtgttgttgaagaagtagagaactgcagaggcatcaaaaggtgcttaggtataagtatatacggggcctgagggaacatagaaagagtcagggacgaaactagtctggggaattggagagggcctctccccaggggagctgatgtctgaggtgggcctgaatgatgaggagttggcccagtgaagcagcagtgtggtggagggtgaggggtagaggggtccacacagaagaaacagcttaggcaagggctgggagctagtgggacttgatgtgttccaagctgcagccagcctgcttggctgaagcagaggatacaaatgagggagctgcaggtgagagtctggagagtaggccatggtcatctacttggccgatatttactgagacctactttgtgccaagcaccataagatgacttgaaaatacagccctggcgatgacaggtgatgaacaagccagcagggagtatgtcaggtggcagttggtgcaatgatagaaataaagccatggcgagacagaacgtatgtggcaggggtctccctttttaacagggcaatcatggaaaatcccttgagtaggtagtatttgagcagagacccaaaggaagagagcaggagtgagccgtgtaaagagctggaggaaagcacttccggggagggggcagcaagtgaaaagcccggcagggggagcgtgggtactctgcaggcagagggtgggggttgtagcctgtgtgataacggggagagttgtcagagcagacaggagtaacagcagtcagactgtatgggacttgaggcccatggaaagaacttagggttttaccgtgagtgccataggggagcactggaaggcttctgaacagaggcatggcatgacctgagaaaaataaatttggatttttgtccaagaaattgattagctatccaaccagagtactaaattgagtatagtactgaaaaaatagagtactctatagagtactaaatagagtactgcataaaatagagtactgaaaagaattttcaaatggttgacttagtggaaagagaagaatatttcaagcaaggcatggtggtttgtgtcagtgcctgcccatagtcccagctgctcaggaggctagggcaggaggatcacttgagcccagaaatttgagactagcctggggaacatagcgagaccttgtgtctaaaataaagaatatttcaacagggactgacagagtagtcacactctgtgcaaagcattgtcctagaagctctgggggagacaaacatgaatacaacatggtgtgtgaacttttgtcttagggacccctttacactcttaaaattattaccccaaagaggtttatttcaagtggattatatctatcaatatttacctactagaaattaaaacttaaaacatttatttatttattttcaagacagggtcttgctctgtcacccaggctggagtgcagtggcacagtctcaactcactgcagcctcgaccttctgggttcaagtgatcctcccacctcagcctctccctagtagctatgactataggcatgtgccaccatgcccagctaattttttttttttctgttttttttctagagacgaggtctcactttgttgcccaggctgacctcgaactcctgggctcaagagatcctcccatctcagcctcccaaagtgttgggattgcaggcatgagccactgtgctcagccaaattaatttattattcatttaaaaataacatacaaacatattacatgttaatataaataactttttaatttgaaactcttattttccaaaacaaaaaaaaattcctgaaaaaagtggcattattttacatttagcagatctctttaatgtctgacttaacagaagatagtttgattctttttttttttttttttttttttgagatggagtcttgctctgtcacccaggctggagtgcagtggcacgatctcggtgcactgcaagctccagctcccgggttcacgccattctcctgcctcagcctcccgagtagctgggactacggcgcccgccaccacacccggctaattttttgtatttttagtagagatggggtttcaccgtgttagccaggatggtctcgatctcctgacctcgtgatccacccgcctcggcctcccaaagtactgggattacaggcgtgagccaccgtgcccggccagatagtttcttatctctgtttctacattcattctgttgtgatttcacactccacctaatttctagaagactccacttacacttttgacagaatgagcatgaagaagggaagtaatgtctcagtactattatgaaggtagttttgagcctgtggaccctgactgtactttgagaattgctgacctagggtgagcccagcaaaaaagtagaggcatgaggtagaggcagggggctagaaaggccagaggaagatcagggaaggcctcgtgaaggagggggcattgagtgggctttgatgatgaatttcaagagcagagaatgccagggaaaaacatgttgcctgaggaagtagtataagcaaaggaaagaaggtgccgggatgttcaggtgagcagtccggcagccttaagctgggggcagggaaggaaagagtgggagggtaggggaccatgaacgaagccatactagagagggtattccctagatcttcctgaaggaagaaagaggggacgtgttcagactgttaagcgggaaatctccctcctatagcatgtgaaagaccgatggaaggggtgagactgagtggagacagactgtgaggaagctaccactgtcctctatctaagagatgataagtatggggagggcggacgggccagacaggtgagtggagagtggaggttcctgagagttctggaaggacaaagttgttggaaccaaggaagggagagcagaacagatacaaggagtgaaggaagaataagtttggttttggatgttttgatttgaaggtactccccagaaacccaagtaggaaatattcctcagtcagtgggaactttgggcctaaaccaaagacggaggcccaaacccctgggagtaaggggttggatttagaagttgtgagaagttagtgaagcgcaggagtggcttgggatggcacaggtgattgagcaagagaaggagtttgagaatcacactgctttaatctgtggactcgaggaaaggcatttaagaaggttcccaggaatcctgctttgaagccgagcttctgaccttacactgactttttttgcctgcctggcttagttccctgaggagtggccacccctcagtgcttcaaccctgtttacttggttttgcaaacttggaaaagattccccctggcgtgaagcagcacctggcctcagagtagccagaggagcttggcttcccagctcagactgtgtgctctgctgtcagcccagaaatcctcctgaagtgacaaagaagccaaaagaactttttccaaagcactgggtatgttttcctgttactgattaaagaaatcaaacttaaatcggcagggaaaaagatacagtggcttatatatcagatgcttttaggtattttattcatctgaggcttatcttgttcaaagagaaggtggatatttgatgcttccttgaagcttaggggacatgaaggaagtgaggggggcagttcctttctactgctctcactgctgccttccccactccctccctacagggttgtgctcaggatattctaataagaacccaactttgtaatttaaatcaaacctcttgttgcttttctccttcctactctctatatcatttgatacatcctggttccaaaatgactttcaggccaggcgcggtggctcacacctgtaataccagcactttgggaggccaaggtgggcggatcacaaggtcaagagatcgagaccatcctggccaacatagtgaaaccccgtctctactaaaaatacaaaaatttgctaggtgtgatggcacacgcctgtaaccccagctactcgggaggctgaggcaggagaattgcttgaaccccgaaagtggaggttgcagtgagtagcaatcacgccactgcactccagcctggcgacagagcaagactccatctcaaaaaaaatgaacaaaacaaaaccaaaatggctttcatctctactacatccttttaaaaaatataccgccaagctttcttatattccaaatagattattgtcttctataggacccatgagcaatctcaaaataaatgcaactcaaatgcaacctttttcttttttaagcatttttgtgggcttttttttttctttttctttttttttttgagacagggtctctgtcgcccaggctggagtagagtggcacaatcttgcctcactacaacctccgccttctgggctcacgtgaccctcctgcgtcagccttctgaatagctaggattacaggtgtgaaccaccaagtctggctaatttttgtattttttgtagagacagggttttgtcatgttgcccgggctggtctcgaactcctgggctcaagcagtccacccaccgcggtctcccaaagtgttgggattacaggcattagccaccacacctggccagcatttaagtttctgaaagactactcctaagtgttctaagtgcttttacatataccaatcatgtctttcttctggtctccctagaagaccaggaagctacatagaatgatgaaagtcatgtgaggctttggaacaaagtggtcctgggtttaaatcctgccctaccttttgataactaaatgactttgagcaagatacacaacttgtagaactccactttttactggactgggcaatagggagctaacaatggaaaaaaaaaaagggtagacacagtgtctgccctcatggaactcatggtccagcagagagacgatggacacagatcatcaccaaatgaatagttgccagagattgaagaatgctgtaggtaggagtgtacatttgaaacagactgcagggaattgaatcctggctctgtcactagctgtataccttgagcaagtcactcaacttctctatgcctcagtttcctcatctataaaatggataataataattcccccatcatggggttgtcgtaagaaagaaatgagttagtatacataagcatttagcatgcctggcatatatgaagccctatgtgttagtttttgtcattataagtgacagaaagggaagtggagggtgtgttaagaatctaggagttagaccgggcgcggtggctcacacctgtaatcccagcactttgggaggccgagttgggcagatcacctgaggttgggagttcgagaccagcctgaccaacatggagaaaccccgtctctactaaaaatacaaaattagccaggcgtggtggcacatgcttgtaatcccagctactcaggaggctgaggcgggagaatcgcttgaacccgggaggcagaggttgcagtgagccgagatctcgccactgcacttcagcctgggcaacaagagcaaaactccatctcaaaaaaaaaaaaaaagaatttaggagttgtaggaagctaatttagacaggaggctcagggaaagttttgctgaggaagtagaaacagaatcctcaagatttagctagcttcacaaagaaagcaggagatacacaggacaggaagtggcccgaggtaggcaggagctgactggatcaagaaactgaagcgtagtgagggcaagtgtgctggaaggctaaatagggtgatgttgctaaagcaagggcaagtgatgtgggtcacactagcgttcctcccagtacagcagccacagagcttcctctgttttgtcagagaacctggtggcagaagcgtattactgtgactgagtctgaggccttggttatgctgtattccttggtctgacactcagagatagtctgtcctctcaaaaaaattccagctcaagaggtggagccagagttcaaaatcgccagccctcttacgctgtcatagctgactgccatgttcaaaacgtggttcctggaaactgacttctttacatcaaccacacctatatgaacagaatcccttcttagctctaagccaagaatcagtaaactgtggcccatgggccaaatctggcctgccacctatgcctgtactgcctgccgatgaagaatggtttttacatttttccatggctgggaagaaaagatgacaaagatagtaagtacactgtatatggcccacgacacctaaaatatttactgtgtcccattacaggacaagtttgcctgctcttataaatcactgaacctggagctgttcacactgaaccgaatctacttagggattggcccctggggacattgtgttgggtgaggcctcccttttcactaatggtgggtctttgatcttacaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccgttaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaggtttttttttttttgttttgttttttcatttcatttaactgtgctttctccacttttcatcattttgtgtttgatgatttaaaagaagcttgactattcctcagctcttgtgccaaggagggttttttttttttaagactcttaaactcaaaactctgcacaaagatttcagtttcaaatgtgtattatacatgggtagaaaagtgtttgcacaggcaacttttggaagtgtttaagaatcagggtgggggtggcgggagggaccgggtgggggcaatgcaaaattgtatttggaaactaggaaaaattaagaaaccaaataaattggttttgcttccttgccatggattctggaaggacatagttcttctaaaatttcctgttaattggcatgtacgtctcatttaaagcaaattaagtaggacaagcaagtcagtaaaatagaagtattaaaaagaatcatcctttaaatcacagatcttattttgagattaaaaaaaatacttctagctttagccaggtgtgcatgttgctgccattttgcatttttgaatcatcttgtgtaattgtcaccatgaaagtgttactcagaattgtcatagattttctcttctttgtgcaaaaacatggaaaattgtcactgactttgttttgaggtttcccccattttgctgccttttgggacacttcgttaaatactggtcttggctgcattcttttttttttttcctgtggggttcaaaagaataaacattttcttacagataaaa

SEQ ID NO: 783 - DNA, 11737 bp, Homo sapiens
cgccttctccccggccactgcttgagccgctgagagggtggcgacgtcggggccatggggctgggcccggtctttctgcttctggctggcatcttcccttttgcacctccgggagctgctgctggtgagtggcgttcctggcggtcctcggcggagcgggagcagtgggacgtttccgggggtcgggtgggtagcggcgagcgctgtgcggtcagggcggggctcctgtgccctgtcggtggcgcagggagctggacgcggcccgttaccgccacacttcagccctgcttccccgtcacttttcagtcctcctcgggatcgcgcatcacctgcactttctggtctcctcctgctctttctctcctcgcgtctcctccgcttcctctcacttttcggacaaaccagtccttctgaggcccatgggttcccgggctgcctccggggctgctcctgtgaatggcattcgagtgcccttccagcgcggccactgaagcagccacaacccccggtgctcggggcggctctcaggtccctgaagtcctgtcctctcccggagccgacgtgttctcagctcctgggccgcagctcctggagtaggggccctcctttctcgggacccggagctggtgcttcctgctgctgtggggactgtggggggtcctgactctcaagctgaggggttggagtctgcaggctccgggcagaggattcttcctgcgacttctctcatccccagctcattctcccctcgcctctggctccgagggtcctctcctctctctcatcccacccctactaatgaccagtgatctaaggacaccagattccctctcacctcctccctgcccatctcagggcccgctgagtccttttgccctcccagctccctgctaccccttcctgtgtgctgttctctgatccatttctagggtgtcctctgccctcatcccctgtccccgccaccgaaggtccctcctgcaccccttatgggcctttcctacaagcagccttcacccagtgctgcccctatgcctccccgttcccaaatgtccctgactctaactttctggtgctgccttttatccgggggggtcttccctccatcccactcccctccagacccccaaggggaaccctgatgctaatggcagttgggccttaggcagggcgcagggcagcgcagatgccccctcccctccagtgcagatgcctgctctggaccctgcctcatggtggccccttccccactccttcatcctcagcctcaccctcttgaggaccccaccctccagcccacaggtgctggaccatccctccctggtccctccgcccctctccaccttgggaccttgtgctgctcctgtctcttgcccagctgccttgggccctcagcacgttctcatctttcagtgggaaagtgggagtgctggagcatatgacagtgctgagcatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccaccccttgctttgtttttaatttttaacttttgtttgggtacgtagtagatatatatgtatatatttatggggtacatgggatattttgacacaggcctacaatatgtaataatcacatcagggtaaatgggttatatcacaacaagcatttatcctttctttgtgctacaaacaatcccattatgctctttcagttatttttaaatgtacaataaattattgttgactgtactcaccctgctgtgctatctactagatcttattcattctaattatatttttgtacccattattaaccatccctgctcccccactccccactacccttctcagcctctggtaatcatcattctattgtctctccccatgaggtccattgttttaaattttggctgccacaaataagtgagaacatgcaaagtttgtctgtctgggcctggggcttatttcacttcacaggatgacctccagttctttgcaaatgacacgatggctgaatagttctccacatacacatgtacaccacattttctttatccatgcgtctgttgatggacacttagattgcttgcagatcttggctactttgaatagtgctgcaataaacatggaaaagtagatagctctttaatataccgatttcctttctttggagtatatgcctaacagtgggagtgctggagcatatgacagctctattgtatttttagtttttggaagaacctccacattgtttcccatagtggttgtactagtttacgttcccaccaacagtgtacatcctcaccagcattccttatttctacatcctcgccagcattccttattgcctgtcttctggataaaagccagtttatctggggtgggatgttatctcgtaggagttttgatttgccttcatctgttgacgaatgatgttgagcaccttttcatatacctgtttgccatttatatgtcttcttttgagaaatgactattcagatcttttctcatttttaaattggattattatattttttttcctatagttgttcgagctccttatatgtttcagttactgatcctttgtcagatgaatagtttgaaaatattttctcccattcttggatggtctcttcattttgtttattgtttcctttgctgtgcagaagcctttttacttgatatgatcccatttatgcaattttactttggttacctgtgcttgtggggtattactttaaaaatctttgcccagtccaatatcctagagagtttccccaatgttttcttgtatagtttcatagtttgaggtcatagatttacatctttaatccactttgatttgatttttgtatatggtgaaagacagggtctagtttcattcttctgcataaggatatctagtttccccagcaccatttttgaagagactctcctttgccaatgtgtgttcttggtacctttgttggaaatgagtttactgtagatgtatggaattgtttctgggttctctattctgtttcattggtctgtgtgtctgtttttatgccagtatcatgctgttttggttactgtagctctgtagtataatttgaagtcagataatgtgattcctctagttttgttcattttgctcaggatagctttatctattctggtttttttgtggttccatatgcattttaggattatttttattatttctgtgaagaatgtcattagtgttttgatagggattgcattgaatctgtagattactttgggtagtatggatatttcaacaaaactgattcttccaatccatgaacgtggactatcttttccattttttgtgtccttcaattttttgcatcagtgttttttgtttttggtttttgagatggagtttcactcttgttgcccaggctagaatgcaagggtgtgatcttggctcaccgcaacctccgcctcccaggttcaagctattcttctgcctcagcctcccaagtagctgggattacaggcatgtgccactgtgcctggctaattttctatttttattagagatggggtttctctatgttggccaggctagtcttgaactcctgacctcaggtgatccacctgcctcggcctcccaaagtgctgggattacaggcatgagccaccacgcccagccacatcactgttttatagtttttattggagaggtctttcacttcttcagttaggtttattcctcagtattttattttatttgtagctattgtaaatgggattcgtttcttgatttctttttcagattatttgctgttagcactgatttttgcatgttgattttgtatcctgcaactttactgaatttgttcttcagttctaatggttttttggtggagtctttaggtttttccaaatatcagaccacatgatctgcaaacaaggataatttgacttcttcttttccagttttaatgccctttctttctttctcctgtctgattgctctagttaggatctgcagtactgtgttgcataactgtggtaaaattagtcatccttgtcttattccagatcttagagaaaaggctttcagttttcccccattcagtatgttactagctgtgagtttgtcatatatggcttttattatattgaggtctgttccttgtatacttagttttttgagagtttttatcatgaagggatgttgaatttatcaaatgctttttcagtatcaattgaatgatactggcttttgtcctttattctgttgatatgacgtattacattgattgatttgtgtatgttaaatcatccttgcatacctggaatacattccacttgctcataaagaatgatcttttttaatgtattgttgaatgtggtttgctagtatttccttgacgatttttgcatcggtgttcatcagggatataggcctgtagttttcttttttatgatgtgtctttgcctggtttttgtatcaggatattcctggctttgtaaaatgagtttggaagtattccctcctcctctatttttcagaacagtttgaataggactgacatatgttgttctttaaaagtttaattgtggtaaattatacattacataaattttactgttttaaccacttttaagtgtatactcggtggcattagatacattcacatttttgtgcaacccaaaactctgtgcccattaatcggtaactccccattcctccctacctctggcccctggtaaccaccattctactttttgtttctatgaatttgaccactctaggtacctcatttaagcagaatcatgtaatgtttgtctttttgtttctggcttatttcacttataatatttttgaggttcggtgggcacagtggctcacgcctggatttccagcactttgggaggctgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaaacaataataataataatatttttgaggttcatccaagttgtagtatgggtcagaatttcattccttttaaggatggataatactcattatatgtatgtaccacatcttggttatccatccctcagacaatggacacttgggttacttctaccttttggatattggcaaatatttcatttcctttgggtatatatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttgcattttcctaatgagtgctgatattgagcatcttttcatgtgtttgttgatcatttgtaattttctttgaagaattggccatttaagtcttttgcccattttttcccccacatagcttctcttatcagatatatgacttgcaatatttatttcatttcggggttgattgctttttcactctgattgtgccctttgatgcatagatgttttgaattttcatcagtctactttgtcagttctttctattctatctgtgctttggtgtcatatccatgaaagcactgtcaaatcctatgtcatgaacattatccccaatgtttgcttctaagaaatttttaggttttagttcttgagtgtagagtttaggtctttgattcattttgagttaatttttgtatatagtgcaaattaagggtccaattttattttaacaccccctgcccccagaactatttgctgaaaagatcaactgactctttgtcacctgctcaccccagtggacactagctgttccatccaattgctgtcctggggccttgtcatgctactcttccactttgaacccaagcccacaccgttcgttgctcccctctgggatactgaccccactataaacttctctggggctacaaccttcctaccctttgtgcctcatgaccaccccctcccttgtccccgccatgcccatgatgagtctcttctcgaggcagctccccttgcctccatctcaccctcagcctatgcaccacagccacactggacatgggtccctctgagcctgagtcccttcccattcccaccatcccctctggcaagaccttccttccaccaccttcatgctcctcccttgcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccccaggaaggttgggacagcagacctgtgtgttaaacatcaatgtgaagttacttccaggaagaagtttcacctgtgatttcctcttccccagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacaggtaccgacgctggccaggggctctcctctccctccaattctgctagagttgcctcacctcccagatgtgtccagggaaaccctccctgtgctatggatgaaggcatttcctgttggcacatcgtgtcctgattttcctctattgttagagccactggataaagacagagggtcagggactggaccatccagtgttgtaatcagggcaagtagaggaccctccgacagaatcctgagcctgtggtgggtgtcaggcaggagaggaagccttcagggccagggctgccccctctgcctcccagcctgcccatcctggagagttccctcctggccccacaacccaggagtccacccctgacatccccctcctcagcatcaatgtggggatcccagagcctgaggccacagtcccaaggcccatcctcctgccagcctggaagaactgggccccagagtgaggacagacttgcaggtcaggggtcccggagggcttcagccagagtgagaacagtgaagagaaacagccctgttcctctcccctccttagaggggagcagggcttcactggctctgccctttcttctccagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctggtgagcctagggtgaccctggagagggtcaggccagggtagggacagcagggatggctgtggctctctgcccagtgtataacaagtccctttttttcagggaaagtgctggtgcttcagagtcattggcagacattccatgtttctgctgttgctgctggctgctgctatttttgttattattattttctatgtccgttgttgtaagaagaaaacatcagctgcagagggtccaggtgagaaaagcgggcagtttctggagatggtaaggcccctgtctgggcagtagggtcccctcattgctcctgcaaagataggcatgttggtgacaaggcttccataacaggggatgaaagttggggaatttgggaagggaatgggggcagcatctccatctacacccataagtgctgcccaagcaagggtcaaacgcccagctgtggcatcctcctgctgcaggtgaggagtgggcagcagggagggctgcggcgcctgctctgtccccatcccggtctctgtgtctcttgaactcactagggcgcatccaggtggggtgagctgggaatcacgtgctgaatgctaagggcctggatgatcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagaccccttgtaacagggagggtcctgagcacacatggccatctctgtccactttgcagctccccatgcacctcctccaggagctttcttggggttgtcgtgtcctctgcaccattcgaggccctactctttccaggttcccacggcctggcctccctgagtttcttgcagatgacatggatgagtagataagcagatgtccctgggccatttgaggagtggggcccagcccctcatcagggcagctgtggtccctgttttcatcctacctccgagtgttttcttctccagtccctgagggacacagtcctcagggcccatgtttttggggatttaatctgtgctctgtggcctcaccttgccctccctgagccaatttccctttctaaaggtggtcactgcctggtaagtttggagtaagggacggtcagaatcatttcccctacagtcaggttgtttgatgggggatgaaaagagacagcaggaagttttgtgtttctgcaaagacagaagcagttcaggcgacagtaagaggctggggtgtccaggaggatgtgtctggcagtagggtcgctggtttctcatccttgaacctaattgcactgtcaatcggcccctcaggcctgagcagatgggaaggtttgtcccctgccctgcagcaagagggccctgtccaggaggcacccacaacaggggcagtgcaggtctgtggtcactcctgctctcacctgtggcgtctcccgtagagggattgtcagttctggttccctgtgggcaggaatggtttcctcataggtcactggagttttggccaggaaaagagtatgaagttcatgtgccagtttctcaaaattcctgctttcaatgttgatgtccagtaaagatattcgtaatttcagctctataatcttaataggatttcctctaatattgtgaagcatattatatgaaacaggaacacaaatttctcaaaattcctgcgatgtccaataaagattttcataatttcagctctgcaatcttaataggatttcctaatactgtaaagcatattaaatgaaacaggaactcaaatttggagccccctctccaggaggttctgtgtggagatggtggctgtggcagtggcagttcccaggtgcagagggtgggcagaggcagcctcaggctaaggggtctcccctactccacatggagaaaatcccttgtaggttgcaagggcagtggccgggtggaatccctgctagggacagagcaggaaggcctcgcagcctcaccaagcagcagccctggggtggagctgcgtttccagggttaagcggaccaggcaggagtagcggttactcaagagcaggtcacaggcttgggttgtgagggtcaggagaggccaggcctcctcgagcaaggtgggggtcccagggtcaggtcaggtgcagatcctgtggcagccacgtctttccatgctgggcctgctgggccccccaggcttcctgatggggtccccagttaggagctgcctgctcagggctgggaggggaggagcactgagctgcagatagagggcagagcccacagtgggcagggcctgccctggtgtgtaggtgcctctgaaggagaggagggcctggggactgagagcaagggtcagggcctctctttggggaggcctctcactgtaacaggactggtcaggcctgagaggagggcactgggttccctcttgggtcttgtcctttagtcttggggccctttccctccctgcacgatgagtggtgggcacagggcacgggctgatgttgatggagtgatgggagggaactggcaggggctgggaaaagcaaggagggaggaagaaaaaagtgggggcctcatcttccctcagagaaagggcaaatctggttttggagcaactgaagagagaaaagtccccagggaataaacacaacactgcacccagtggagcatttacccatttccctcttttctccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 784 - DNA, 15800 bp, Homo sapiens
aggggcagaggcggggccgggagcgaggcgtagggggtgtggccaaagcgcagtagggggctctcgcggttggtaagggacgttcgggaagagtcggttgggggcgggaaggggctgagcgggggtcctgggagggttcaaggggtccaaaggggaagggggtacaggggccaggtgaagggacagatgaagagatcagaacagccttagagctcacgggctaactgggtgaagcctcgggtatctaggggagcagtggtgggagagtagagccggctagcgtacagggggcgagggcaggctattgagagatgggggtgagggtcaggaccagaataattccttcagaaaaaggtagattaggttgtaaaaagggacgggagtagggatcccagattcgggtaaaaaatagattaatgagggtgggagggtgggaggaagatcttaaagtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggtagaggcactgcccagaatcctgaaagtatgagtaaagcctcagagcccctctcagtctgtctctttcagtaaattctctccacttgatagttgcttgggttccatgaggaaccaggttgagacaagcaagtgaatttggggtatctcctactttggggaagtaggaaaagagctaagcatcgggtggacctggctataattcaaggattatgactttgttattgtaggggctttctctttggaaggtggcctgaaaattgaattggagtgtctttgtttctcctcttgtccaggggaacatagatggctggagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtagggatccatccacgccgttttctcaggcttgcttgctagtgacccttcctcactggaataaactccttaccctatttcggccctagtttccagaacgtactcatttttatgtaagcaattagttcctacagtgcataaataataaagcagtgtgctaagtgctagggatgaggataacaatagtgaataagacaaatcctgacttaaatttgtaattaataaggaatctaaaatcctaagaggggagatagattgaccaccagctgatggtaaagcatggtatgaggcaagatgaagaagtgcaaactagaggtagagacccagcactgtggcagtgtgggttcattctgatggaagaaagcctttacagaggacatgctgtgggagctggccatgctgtcgtattatctgtaaacattcttattcttgtttcatgtgtcttttcccagatgtactgggatatcattctgccattttgctccagaataggattacattagaagaagcagcatgatgaagaaggaatactagactgggtgtcaggagacagagactctatttctagtttggctaccagctagaggacatttggcaagtcacttaatttccctagcctacagatcgctgctactaaagaaagaaagaaagagcgagccagatatggcggctcacacctataatcctagcactttgggagctgaggcaggaggatcacttgagcccaggagttcatgaccagcgtgggcaacaaagcgagactccgtctccacagaaaataattagctggctgtggtggcatgcatttgtagtcctagctactcaggaggctaaggtggtaggaccccttgagctcagaagttgaagactgcagtgacctatgatccagccactgcattgaggcctgggtgacacagtgataccctgtctctaaaaacgacaacaacaacaatctcttatagtcctgggtctcagagagctgcctcaggagccatgttccaagctggattaaacttcacgtgacattggtagacgatttctctaaaggctggcactgtgttatttatgtactgttctctcagactcctcataaagtatacctaacactcaataaatgccttttttttgagatggagtctcactctgtcgcccaggctggagtgcactggggagatcttggctcactgcaagctctgcctcccaggttgacgccattctcctgcctcagcctcccaagcagctgggactacaggcacctgccaccatgcccagctagttttttatatttttagtagagatggggtttcaccgtgttaaccaggatgatctcgatctcctgacctcgtgatccgcccgcctcggcctcccaaagtgctgggattacaggcatgagccaccgcgcccagccaataaatgccttttaactagcacctggcctcaccatattgatactggaagcttacgacctctctatgcccattcctccctcaaacttcttgcccttaaattagaattgagaagtccctgtgtgttcttccaacctttccacttaaaatgtgtggcctaaaaataaaaaaataaataagacaaaaaaaccaccaaaaaacaaaaagaatgtgtggcctaatgatatacacatttgatgttgaatcctcctgtatgtagctctctctagggagatcatgttccacgatctcagccagactttaggtcctgtgagtccaggcactggactcaacatgctcaatagggctttgatgaatgatgatgatgtcaatgcagacatccccataccccagcttcagcacccccttcacctccccacacggaagcagaggggtcctcttttccttctcctggctatgtttatgccctcaactatccttccagcactggagacaagtctcacctgcactaacctgtctttgaaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcaggtgaatgcaggggtagaaaggattcaaattcataacggagagctgggcagtagcttccaagcaaagaacaggtattgcagaaaagaccctccatgagtagtgagtagtagagtgatgagacctttggtgaaaataaacacacatggcctagaaagatggagaatttgggtacttttatcttaattcaggttgcacttttcccccaagactcaggtggcctcccaccacttgaagccctgcttccctttctagtaggaaatagtttgcctccctactttactccaggtaccaattcatcaggggtattgtggagggcagtgaggaaggtgggtataagggggctatggtggactgggagagagagattattcagtcctcaaactcagtacttactctttgccatctctaagactcagtgaccaaattagcctgagtcctgccttcgtggatggaactgacagcctcgtgggggatatacacatccacatttaatttaatcataattaattgcaatcaggaggaatgccttgaaggagaaggactagaaagcactaacttagtctggggttcagggaaggccactgtaaccagttgacatgtcaaggaaagaaaccatagccctgggcgcagtggctcacgcctgtaatcccagcattttgggaggccgaagcaggcagatcacaaggtcaggagttcaagaccagcctggccaacatggcgaaaccctgtctctactaaaaatacaaaaattcaccaggcgtggtggtgcgcacctgtaatcccagctacttgggaggccgaggcaggagaatcacttgaacctgggcagtggaggttgcagtgagccgagactgtgccattgcactccagcctgggcgacagagcaagactctgtctcaaaaaataaaataaaaaaggaactgggagaaaacaagggagaattcctttataaccttgtagtgggcaaggcctttctacctgtgagtcaaaatccaaaatctagaagccataaaggaaaaaattgatccattgactttataacatgaacattaggaatagccaaaaagaaaaaaaaaagctatatttatagctcagatcacaagaaaagggtaatatccctaatataaaatgtgtgcctagaaattggtaagggaaagaccagcaatccaatcagaaaatggacaaaggagatttatgaaagaaacttagaaacaagaagctaggccaggcacagtggctcatgcctgtaatcccagcactttgggaggccgaggtgggcggatcacttgaggccaggagttaaagaccaacctggccaacatgaagaactctacaaaaaaatacaaaaattagccgggtatagtcgtgggcgcctgtaatcccccagcttcttgggaggctgaggcaggagaattgcttgaacctgggagacagaggttacagtgagctgacatcacactccagcctgggcagcagagcgagactaaaaaaacaacaagctaccgtttgtgctgaataggagttggccagtgaagaggcgtgtgaagtccagtggtagctggaagacacttggtgggacaacaggtgaaggcggggacaggaggccagaaggctggggcacagagatgaggggcactgagtgtgctgcagagcccagggcccagggcacaaggctttggccacttcagaacttgctactttcccataagagcaatgagcaggctgggcacagtggctcatacctgtaatcctagcactttgggaggccaaggtggaaggatcatttgagcccaggagtttgagaccagcctgggcaacaaagcgagacccccatctctattttatggaagaaattagggctgggcatggttgctcacatgtgtaatcctagcactttgggaagctgaggcgggtggatcacttgaggtcaggagttcgagaccagcctggccaacatggtaaaacctcatctctactaaaaatacaaaaattagctgggcgtggtggctcatgcctgtaatctcagctactcaggagggtgaggcaggagaatcgcttgaacctgggaggcagcgtttgcagtgagctgagatcgtgccattgcactccagtctaggcaacaaagtgaaactccatctccaaaaaaacaaacaaaaaaaaattgttttttcaagtaataagcaaccgttgaaaggttgttttttttttttttttgagatggagtctcgctctgtcgcccaggctggagtgcagtggcgcgatcttggctcactgccagctccgcctcccgggttcaagtcattcttccgagtagctgggactacaggcgcccgccaccacgcccagctaattttttgtattttaatagagacggggtttcaccatgttagccaggatgatctcgatctcctgaccttgtgatccacccacctcggcctcccaaagtgctggaattacaggaatgagccactgcgcccggcctgttgaaaggttttaagcagggaaataacatgattagatttgtattttatgtctaaaaaattttgtcatttatgtcccccaaattaattttattgttgtatggagacagggctagaggaggcagaccaggaagcagggtgggcactttgccctcctttccagtccatcccatgactcttggtggctctgacacccctgcaaccctttgaggtgccatgagcaaaagacacaaaattcctcctttcctggagctttccttccagtgtggtccgacagatagtaacacatacacataagcaagatatggtcagtgctaagtgctcaggaggacgtgaacagctgatggggcagagtagggtggggagggacggtattagagggcccagtgaagccaccctgaggaggggctatcgcctggggtctgtggagcaaggaggggccgctgtctggttctcagcagactccccgtggccggagcggggagcagtgggagagcctccagggtgagctcaggaggtaggcagaggccgggtcccctggcctgcaggtgtggagagacacctgggttttgttgtgaatgctgtgagaagccactgagggtttgtaaagactagttaggagatggtcgctgttgcccaggcaaaagatgagggttggtggcagtggagacggagacagagaggtgaagatatgttttgggggagatcggacaagaactcctgatgggttgtggggcagctgcggagagtgagttgccagctctccatttgctgtgcacagttggctgattggttgggtcattctctaaggtcacagaaagtgggagtgaagggaacaaggaaggcctccatgtggggtcgagcctctgctgagccccctcttctttccgcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgaggtaggtgggcggacgccgacgggagcccagcaattagtgatgtggtggatctgcagggcgccccactgatggctgtcccattcccaccccaaccctagcaagacccaggaagacttggaggctcaggtgaccctggttgagaatctaagaaaatatgttggggaacaagtgccttctgaggtccacagccagacatgggaactggagcgacagaagcttctggaaaccatgcaggtgagggtgcaggaatgtatctgtgtgcagacttagggatcaggttgggaggcaagcgtggcccttggaggagcgtgtagagcacagcctccgggagagaaggtggtacctaaggcggcatggaggccctacagaggggctgctttcctctgcccgcagcacttgcaggaggaccgggacagcctgcatgccaccgcggagctgctgcaggtgcgggtgcagagcctcacacacatcctcgccctgcaggaggaggagctgaccaggaaggtacagcccaacccccagacccctcaccctcagccgcatcctgcatctactgtcccctgcctccctccctgtgggcaggaggggtcaatgtgccccagaacctgcttagatctccttcctgtgaactcctcttgctgtagctcatgttgcccaggcaggacagaggagaaacaaagatgccacctccttcctctcctcccccaggagcccacacttttctcccactccttctccctcaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtcactgcactctcttttctcccggtattccctcccagcaccttgctccttccatgaaggtggcatccattcaaccagtgtttattgagtggttgccacatgctgggcacacagccctgaacaaaactaaaatgtggagcttgcattctagaacagagacacagaacacgcaagtaaacagataatgttgggtaattatatgtgcgatagaaagattgaagccaggtgcagtggctcacacctataatgcgatcactttggtcttgaactcctgacctcaggtgattcacctgcctcagcctcccaaagtgatgggattacaggtgtgagccaccgtgcccagtcaagtaatgccaacagtttgggagaccgaggcaggtggatcactggaggtcaggagttcgagaccagcctgggcaacatgtgaaatcccgtctctactaaaaatacaaaaaattagccggtcatagtggctcattcctgtagtcccagctactctggaggatgaggtgggaggatcacctgaggctgggaggtcgaggcgaggccacagtgaactgtgatcccatcactgcactctagcctgggtgacaaagcgagatcttttctcaaaaaaaaagaaagtagtaagaaaaattcaaaagataatgtgacggagagactgtggggtgagtcagcctcaggtaggatgctcagagacagcctctctgaggaggtgacagcatctgaggagagtggcatggtcagttggtgggtcttgtggggtgggtcaagggctattcccatctttgagtgggcacatggaatgtggaacatggaacactgggctcagattccatcctcagaacctaagcttctgtctccctgcgtggcattcattctttttcttttcttttttttttttttttttttttgagaaggagtcttgttcttgtcaccaggctggagtgcagtggcctgatctcagctcactgcaacctccgcctcccaggttcaagtgattctcctgcctcagcctcccgagtagctgggattacaggcacatgccatcacgctcagctaatttttgtatttttagtagagacaggctttcaccatgttggtcaggctgatcttgaacccctgacctcaagtgatccatctgcctcggcctcccaaagtgctgggattacaggtgtgagccaccgtgctgcaacccacccccgtcgcccgccccccctccccccagcccctgcatggcattcttacagagatctctgcacctgccactttgcttccagtgcccccctcatcttttagctctagagggccctgcctagctctctctcctcccccaggtggcctcactccaggaaaaagtgacatcccagagccaggagcaggccatcctgcagcgatccctgcaggacaaagccgcagaggtggaggtggagcgtatgggtgccaaggttggtgtcagcctactagagactcggggagggcaagggagcccctgttccggggctgcagccaggacttagggagggaccctgtcctttgctgcatcctccccagggcctgcagttggagctgagccgtgctcaggaggccaggcgtcggtggcagcagcagacagcctcagccgaggagcagctgaggcttgtggtcaatgctgtcagcaggtatcagggatggaggggtgggtggagtagtgtttctgccacctcaggttcctgggcaccttgttgctgaggatcctcaggcaagaggggctggaaagtggccactggaggctacagggctgggcagatttagctctatcaatgttcctgtgttcgtttcttttcctggggaagccccttctgcattcatacctgattgcttgttatgaatttcccgttgcatgtttggctggaggtgaggccttgcttcctcctgcagttcagtctagtaatggcttgagctaaatagagcacccgggaggatctttacttgcagtattgttcaaggatggagagtgtagacacttcatcttcctttttttttctaaaattttacgggcaatccgtttcactggagaaaaatttagtctatttatttatttattttgagacaaagtctcgctctgtcacccaggctggagtgcaatggcgcaatcttggctcactgcaacctcacctccctggttcaagtgattctcctgcctcagcctcccgagtagctggattacaggcatcctccaccagtgtcctccactacacccggctaatttttgcatttttagtagggacggggtttcaccatgttggccaggctggtcttgaactcctgacctcaggtgatccacccacctcagcctcccaaagtgctggaattataggtgtgagccactgcacctggcctagtctatttatttaaagctatatacttacttgcttattatatacttaacttgcttactattccatctaaaatgtaagccagttagtttccttctaaatcaattgccagcctttgtctctcctaccaacttcctagttgtttcattacctacaattgttgtatgaccttcagaaaaacctctaagaaaacagcaaagcttctttgtgctggtgatgacttcccctcagccttagacactgaggtacccaaggcaggtagttctttttttttttttttttttttttgagacagagtctcgcactgtcacccaggctggagtgcaatggcacgatctcagctcactgcaacctctgcctcccgggttcacacgattttcctgcctcagcctcctgagtagctgggattacaggtgcacaccaccacacccggctacttttttgtatttttagtagagacagggtttcactgtgttggccaggctggtctcaaacttctgacctcgtgatccgcccgcctcggcctcccaaagtgctgggattacaggcttgagccaccgtgcctggccggcaggtagttcttagcacagtctctggcttgtaaatgtttattgttatcgtgaggctcttcttgatgggttaatttagataaagataatttttggtttagcgaaattaagatgcaggatgagtccttgcccatcacttccttctcttggatttgtaccttagggactaatttagctttaaaaattatgaaaaatttcaaacttgcacggaattaaactagttataatgacctaccacccaggttcaatccatcgcgggtgccccctacctccaggagaacagaaagatgcactgtggacagggtttgactttggtaccaggcgatcacagaaatggtctgtgtaatgatgcatttgccgaaagtcctccaggcttaaagcagtccaaactctgattgttgctgggtttattagattgtctctaggtaattggagactttaataagggctgtggtaggtgttggaagcatctactggaacaatttccagatcaaagtgaactttgctgtgctgctggggatgcagctgcaagccttcatcatcatgtgtttttctgtgggtgcagacctggactctcctgaggaaaccccagcccggccccagacactccttggcctcctcctggggcctgtttaagctgctcagttttcatgagccaggttggtcctacttctggcacagccagctggtaaagcatgtggacctgcccgtcattggtgctagatcgacactcctgggcttggagaggataactttgttttcttttgtttttttgagatggagtctcgctctgtcacccagtcttgagggcaggggtgcgatcttggctcactggaacctccacctcctaggttcaagtgattctcgtgcctcagcttctggagtagctgggattacaggcatgagccaccatgcccggctaatttttgtgtttttaagtagagagagtttcaccatgttggccaggctagtctccaattcctgacttcaggtgatccgcccgcctcggcctcccaaagtgctgggattacaggcaggagccactgcccctgatcagagaggataactttactctttgatacacgatagtgagcaaaacacagttgtgagaaataagcttaacaggttgcttaaaaagatagtcatttaatgcattcttggggcaagggtcctttagataattgacggaagctgtgcgttctgtacttgtataatgggacaggattagagggagttgtctatacaaggcacagcaagtcctttgggaatgaggggaggcatggaggatcagtgacttgtgccctctccagctctcagatctggctcgagaccaccatggctaaggtggaaggggctgccgcccagcttcccagcctcaacaaccgactcagctatgctgtccgcaaggtccacaccattcggggtgcgtaggacaactgcgagccacgtcctgcccccaccccaccagctcggactttcttcttcctgacccagctctctctgatcccacatccattcaccttcctcctttcaccagtccttgcatctctttttcccttactccctgtccccactttctcccatgcaaacttcatctctttttctccctgctttttcccctccaggcctgattgctcgaaagcttgcccttgctcagctgcgccaggagaggtgaagtttgggcactttgaggtggatggggctttagggcattggctgctgggacccccaaaaccatgaggactgaggtgggatgggggctttgggatcaggcagctgggtgatttcttctgactctttctcttccccgtcccagctgtcccctaccaccaccggtcacagacgtgagccttgagttgcagcagttgcgggaagaacggaaccgcctggatgcagaactgcagctgagtgcccgcctcatccagcaggaggtgggccgggctcgggagcaaggtacacctggttgccagggggtggagaggatgaggaaaaacccggtgtctagggtgctgggagaggcctgacccagcaccccctccttttaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaaggtgtcgagagggaaatgggtgcttcccttggagggtggggtgggaactgcgaatcaaagctcctgctgatatgccccgtctgcactttcaccccagccctgcaagaaaaggtggctgaagtggaaactcggctgcgggagcaactctcagacacagagaggaggctgaacgaggctcggagggagcatgccaaggccggtgagccttgccagggtggatagggccttccaggaagaaggaagtgttaagacataaggttattattttcccctcaaagtgtgttcaaagcttcattacaggaagtaatgaaggtatccaggagtagcacagatgaattatcacatcgtgaacacacccatgtagccagcaccagattaagaaacagcatatggccggtcgcggtggcttatgcctgtaatccaagcactttgggaggccgaggtgggtgtatcacctgaggtcaggagtttgaggccagcctggacaacatggcgaaaccctgtctcgactaaaaatacaaaaattagctaggcctggtggtgggcacctgtaccccaagcttacttgtgaggctgatgtgggaagactacatgaacccgggaggtcgaggctgcagtgagccaagattgtgccactgcactcaagcctgggtgatagagaaagaccatgtgtcaaaaaaagaattgtgtaatgaatgtatcttctctaactaaatatagcagttaacatttgccacatttggtctcttatctatatacacacatatttgtacatcttttgaatcactttaagttgtaatcatttaatgttttgttgttgttgttgtttgagacagagtcttcctctgtcaccagctggagtgcagtggcatgatcttggctcactgtgacctctgcctcccgggttcaagccattctcctggctcagcctcccaagtagctgggattacaggcgcccaccaccatgcccagctagtttttgtatttgcagtagagacgggattacaccatgttggccaggatggtctcgagctcctaacctcgtgatccgcccgccttggcatcccaaagtgctgggattataggcgtgagccaccacgcctaagtaagttgtaaacataagttgttcagccgcatctcccaaagccagtaaattctcctatatagctgcaatcatcacactttaagacagtgaacactaattgcacaaaatctaacccagttcatgttcagatttcccctgaggaactccaggatggttcagggatgaggaagatacttaggttcagattcccaggctcctagagcatcagcccacccctccaactgtacagaagagacagatccacagagcagaacagcctccccaagccacagagttggtgacccagcgtttgttcctgtcttcatggtgcctggctgcctctggcctgactcacacctgcctcctctgtgccttggcctctctgtagtggtctccttacgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggtaggagacaggagggcagacaggcagacactagggcccatcctgggctggttcctgggctagaggtgtggaaagaggatggtgagggaggctctatccgggctaggtttaaccctctccttcccaggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaaggtcttgggccaagcacaaagggacaagggacaaatgcgcgcacttcaggaatctcctcttcagactctcgcatgatgagtgttgttctctgcggtccttcgaggcccttagcctcttttagcgatgcccagcttggaccaaagagcctcctctctcccattcctcatttcctgtgccagccctgtttcctctgtaaccacgagcaccttcccttgtctggtgctcatctgctgtcttccttcccagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 785 - DNA, 3091 bp, Homo sapiens
gctgccgcagcctgcgccatttccgatgccaggcaccctcaaggcacagaggctggggctcatgttgggggcacttggcctctccaggcctcgaaggcttctcctgggctgacgcgagctggggaacgggagggacggacgtgggagcgagaacgtcacactggaggcagctggtggcacgatgggggacagagtgaaaggtagcaagtcaaggtgaactgaaggatgatcagagcggagggaggctgtggacaggggcggaggctgtgggaaggggacccgtgctgcgcagcggggctagggaggttggacccgctgaggcaagggcacattgaggagaagccacaaccagggctcccgctgcctctgggagggctagggccacggccaggctgaagcctccctcagaccttagccgcctgaggacaaggaggagaggtgagcacgaggggacagacagagcccagagtccctgtcaccatctcttctcccaacccaaagcaagatgcagtttccatgacaacctggccggccagagagggggcaggggactgcagaggaaactttccacatcagcagggagaaagagggtgtgctgcaggggaaaggggggcacgcagggttcccagaacccccggtcaccatgctcactgtgctggacccgggaaagtggacagagcacagggaagggttctcccgcctccactcccgcaggcccacgcccccacgctgggcctgcggggaagggggaagactgagcccagaggctcaagggtcagatgtccaaagagcagcggctgcccaggccttgtgcagcgggcagcgagcagcccagggagccaggccccagacaccgcactcagggccatggccgacaggggcccgtggagggtgggcgtggtgggctatggccgcctcggtgagtccctgaccatccttggcctccttccccaaaccccttcctaaagctcccaagactctctgccctccacaaacacttttttctctctctatctgcccctggctgtgtctctgggtctgcccactgcacccccaccccaggtctctgtcctctccgtctctgtctcccttctctctgggcctctgtccaccccactgtgtctctgccctgcccccatctctgtctccctaccccgcaatctgagtctgtccccacctcctctctctctgggtctctgtccccacctcctctctctctgggtctctgtccccctctctctggatctctagccctctcctttccctctccccaggacagtccctcgtctcccgcctcttggctcagggaccagaacttggcctagaacttgtttttgtctggaatcgtgacccaggacgaatggcagggagcgtgcccccttccctgcagctccagaaccttgctgcccttggggaaaggtcagtgaccttgccatgggagagtggagctccctgaagctcctgtcctggctctcttagccactgtgtgatctcaggggttccctgaccctctctgggccttggttcaagcaaatgtgaaacaggacgaacccattcatctcatttcgcctcccaggtcagggagaagaagggcagccctcagtagactcggagggaaccttggggagaagaggcctaatacctctccaagaccctccgccctctttcccctctcccaggcgccctgatctggttgtggaagtggcccatcccaaaataatccatgaatctggggcacaaatcctgcgccatgccaatctcctggtaagccccaccccaaccatttacgcagagccctgccccttctgtcttggtctcaccccaccctgaagtggatatccttccctgacctcaaccctcccctccttcatccaccccaggtggggtccccctcagctctaagtgaccagaccacagagcggcagctcttggaggcctcacagcactgggaccacgccgtgtttgtggcccgaggggccctgtggggcgctgaggacatcaggagattggatgcagctgggggcctccgggtgaggcctgctgggctccccaggaaccaggggaggcctgcaaagaccccactccccctaacccgggctcttgcttccagagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccaggtgagcagagctaagcagggtgttgggctgagtccaggctctccagactgactgcccctcttgtcccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcagagcctcctgggtgcggccaggcccctctcccccggccctgggctcctgtgttctgcagagcttgggggtcccgggctctcactagttctgcagttctggttctgtatttgttgacctttctttctttctgacctttatttccttaacctctctccatgactttgaatcctggcactgtagatgtctccatttgtgcccgcctctgatcgagactctctctgtctctgtccacccccagggctctgtcccgctctctccgggtcttcctccaccgcccccctgccctgtcccctcctcccaccactgcctcccccaggcgtctgtctcctcatctctcctctgtctcattcgctcattcccctctccccgcagcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccgca

SEQ ID NO: 786 - DNA, 13701 bp, Homo sapiens
agacttacatatatatgccaggcacagttttgttgttaggaatataaagatgggaaaatcttgattcgtgtgtaggggtggggatggcaaaagatactccaaaagataatttcaaaacaggtagtaaatgctatgatagagtctaggtaactgctcttgttatctggaacctacttaaaccatggatggtgtcttagactgcttctattgctgtaaaggaatacctaagctggttaatttaaaaagaaaagaggcttatttggctcatagttctgtagattatataaaaagaatggctccagcatctacttctggtgacggcttcaagttgcttccattcatggtggaaggtgaaagagagctggcacgtgcagagattacatggcaagagaagaagaaagcgagaatggagagggggaccaggctctttttaacaaccggctttagcctggagcggtagctcacacctgtaatcccagcactttgggaggccgaggcggatggatcacgaggtcaagagattgagaccatcctggccaacatggtggaacccatctctactaaaaatacaaaaattagccgagagtggtggcgggtgcctgtagtcccagctactcaggaggctgaggcaggagaatcgctttatcccgggaggcggagggtgcagtgagccaagattgtgctaatgcactccaacctggcgacagagtgagactccacctcaaccaaagtaaataaataaatgaataaatcagctcttgcaggaactaatagagtgagaaccttactatgggggacaataccaagccattcatgagggattcaccgccgtgatccaaagcttcccattaggcccacctccaacattgggaattgaatttcaacaagaggtttgggaaggcaaacattcaaactattgagaatgcaatgcctgtggcgtttctgtggtcatgaggtggcaaggaatgtttggttgcctttacttcctggagctgaagattcagttggtatgacttcaaaaacataccacatatgtggatttctagaccagtgctatgcaatataacttttgtggatatttttgatgtatacattgctcggtacagtagccactaaccacattagctattgagcactgaaatgtgactattgcaattgaagaattaagtcttttatttaattttaatttaaatagctacatgtggggaatggctaccatattggagagtgtagttctagaatatcaagtggttgctatagacacaagctgacttcttcgtagctcctctctcttccctcagagccactgtctcaagactctgcccttcttcaagagaagagcccagaagaagagagaatgactgctaggccctttatggctggattcagggtgagctggattttcttttcatttcctgaaatatcttatattttctactttcattctggtggtttggggcccaaaaaaacttcaattcagtcacttgaattccagatattttattttctaggaaccaaggcctattctctttgatcatgaattttataagattggttgtctattgccacctgccttcccatagtgtttttgtttttgttgtttgtttgtttgtttgtttctggtaactagcatagcatttagtaactagcatttgataactagcatagcaggtaggctctcaattaggcattgtctgtggtattcagttcttcagcagccttgtctaaccaaggagttaaggaagaattcaaggaaacacacacatccattttaagtagtaaagagaaaacatcccataggagttcagagaaggagagtgtgatttggaggattttatgaaggggtggaattttggtgtgcactgagatatggttgcaattttgtcaaaggagaactgagggattttaagggaagaaaatataagacaaaacttagaggtagaagagaccgtgtcttctatgggcaatgggtagtagccatatattgaaaattttaagggtgaaatttgctgtgctaagtaggactaagggtttgactttgttgtagagctgattgtgaattattagaaactttgggaaaaaaaatgccatgacacagcttgttttggtaaggaacagtaatggtttggtttagatttaggggatgaaagagaaaggaattaaaagtaactccagttaagagaacctagaatatctaagaggaataaggtgctttggaagagacaccagtgtgctgtggaggggacataggtgggatactaattggggtgagttagcattgtaaatagattatgttaaggtaataagacaagttgaaaatgtcataggatccttgggttattgcttcgccagccagaagcctctatggccggcagctccttctgcctgagtaattgagtattggttttaccactgggctcgttccacccactcagcctggcaggctgtgctcaactcacactactgtctcagatcccacatctgccaagggtgagccacacagcaaggggtgtgtgggcaagtgagcatggggtctggccagtgagcacaaccaagcatgctggctgctgtggtggtgcaagcagctctgcacaaggctgcagctggaacagatataccgcatgcaatggaagtacttccactgtgggcacccatgtctggacaaggggaaagcaatggcttctggaagcttggagatgccaggagccacagagccccaaagagggtgtcatagtgctggctcagggagtctctagatctaggctcacttaagggctacagctcttcttttcattgcctgcaatgtggcagatggagaggcgtgtttcaaccctgtttgtgttaaagctttttcagtccttccatttggcaggtcccaagtttttggcccatgcttggtccatgtccaggaagaatgaggtatgtggacaactggagggtgagcaaggtggagaggagcttcattgagtgacagaacagctctcaggagacccaaagtgggtggcttctttccacagacaggttgtatccatgagtgtccagctgtcagcagagaggagacctgcagtgggtagctcgtttccgcagttaggtcctccccatgtctgtttgaatctgactgagtctgaggtttttatgagctcagaagggaggaagtgcgtgctgattggtccacggtggccacgggtggctggaagaagcaccagaagttctcacttaaggccaggctgtggattgcagccagaactgacagcccagcccccatgtgttaggccatccctggctggagggtggggcttcaaaggggacccacccctttccacccaggagcctgtatgcctcctgtcaccatcaattatgtcctccatggtgcccaggctgtttgtgctgggcctgaaggcccacactgagccaccctcaacccggctccagcctccttcccatgctcttcagtgcccaaagtctggaggggggaaaggtggcaggggctggcatgtcagcgctgccctgagcacacctggtcaggtcgtgactgcacccaggctcagcctcaactttgctgtaaaatcagagtggatgccaggaccagggagatgccaagcagtgggagcaggcactttggagcctgtggaggacagggcttccagggcccgcaagagcacagggatgcccaggttcacagccacagctgggcagctgcagctgttcctggaagagtggggttcccgccccaccaactttcatgttgaattataatccccagtgttggaggaggggcctggtaggaggtgatagatcataggggcagatatccaccttgctgttcttttgatagtgagtgagttctcacaagatctggttgtttaaaagtgggtggcacctgccctctctctctctcttcctccttctccagccatgtaaggcatgcctgcttccccttcaccttccaccatgattgtaagtttcctgaggcctccccaggtgtgcttcctgtacagcctgtggaatggtgagtcaattaaatttattttctttataaattaacctggtcttaggtagttctttgtagcaatgcaagaacagaccaataaataatatacaatgtatttatgtagcgagtgtattgtttgtctttcttactatggagtatgctctatgtaggcagagtttttttctttttgttttgttttgttttttagtctctttcactgttatatcaccgtgcctagagtatttagcatatagtactcattaaacttgtgttgaataaatgttgaatgatttaaaacaattaaaagtttatgctctccaacctcaaaatgcctcctcgataatcttggcagtccctaacacttctgtggaaaacttaatttgctatattaattttaatcttcatatggctgaattttaaggttttctcttaaaaatcttaaattttcttacagacttttaaactacgtttttagtagctgctctagggattacaatatatatcgttacttcttcacaatcttcttagatttaatgtgtcacttcacaaaaagtggaagccttgcaactatatgtgttcaattatgacacctcgttctttttgttctgcttgttgttctgtgtgttacatctacatatgttataagttgttcaagaaaatgttatgtatatattttaaatagttatatatattataaagaaataaagacaaaagcagccaggcgtggtggctcatgtctgcaatcccaggactttgggagaccaagacaggtgcatcgcttgagctcaggagttcaagaccagcctagccaacatggttaaaccctgtctctactaaaacttaaaaaaaaatacctaggcctgttggtgcatgcccgtggtcccagctacttgggtggctgaggtgggaggatcacttgaacccagggtcagaggttgcagtgagccgagattgtgccactgcactccagccaagatgacagagaaaaacctgtctcaaaaaagaaaaagaggaaaaaaaaataaagataaaagcaaacttttaaaaacaaattttaatttgcccaatgatttctaaatgctctttatttctttatttctttttgggaatcagaatttctatctggtgtgatttcccttcatccagaactttcttaattatttctgcattaatcaaacaaaattcacagtggcactccatccatttagccactctagccagagtccagaaatccatctttatagtccctttcccttcatctgtgtatccaggttgccatcaaaccttgtcaaatttatttccaaaatatatttcaaatctatcacttctttctatatttactcactttatctttaattcatgtccttatcatttcttgcctagattcctggagcatccacacaaatattttcccatgtctattctggcccttctacttctacttactccacctactgccagaagggtcttttgcagctctcaaatttgattttgtcacctttttgcttacgactcttaaatggctccctaatgctgtcaggataaagatgccatactttttgcatggcctgtgagcctcatgtggctggcctctaattttcagtctcagttcttccccctttcttcctgtataccttctttgctctattcacattggccttctttcaatctctcttcctccccattccccctgtcatgatggtgccttcacacttgctatttcctctgcttggtgtggttttctttacttttttcaccaaggcaatgcctattcatccttccgaaatgagttcaagtagtgccttctgatatgaacctccactaacacagtgaccaggtcagatgcccttattaaaggttctcatgaaatcatgtgactcttttttttgagacagagtatcactttgtcacccaggctggagtgtagtggcgcgatctcggctcactgcagcctctgcctctcgggttcgagcaattctcctgcctcagcctcccagatagctgggattacaggcacgcgccactatgcctgactaatttttgtatttttagtagagacggggtttcaccatgttgaccaggctgatcttgaactcctgacctcaggtgatctgcccacctcagcttcccaaattgctaggattacaggcgtgagccactgtgcccagccatgtgactcttttttaaaagacatttgtaacagttacaattttatatttgtgtgtgattgtttggttatcacttactagacactcagctctatgaaatcatgtgctatttctgatttttgtttagcattgtattttcagtgcctagcacagtgctcgataaatacatgttgaatgaataaatgtttattagttcaaaacaaaagtattattcaaaacaaaagtatcctaaaaacgctttgagggagaaaactaatcagtaggcattgcaataactgtaaaatttgcttttttataataaaagtgatcaactttaaatataaatacttgactctattcaactttgtactctgtaaactcaagaatgcttcccaggaaaagacttttctctgtttttcaaaatttgataattcacatactttgtcgatctatcttcctttaacaaaccttatatttgctttataataattgatgcatttgagtatataatacatgtaatacctgatactttgtaaattcttttgcattacatgaataatgtttgtgtttaaaagaaaaggctttgcagcatattttagatcctacgtttctgccccaatagagactaatgaagagtcacgtattcatctatgacttattgtacccatactatgtaccaggcactcaagcatgtcaaaacattattattgaatgacaaataatgtaattcaatatgaatagcaaataatatcattcaatatgaataacattcttgttattcattctgctctttcactaaaagtaatgttaacttttagatagtgcgttctatattcttggctctgttctaggtgctttacgttaactcatttaatccttgtaataagcctgagatgtaggacttgttattgtccccattttgtagatgagacagagtttaactggccaagattctatagttggtaggtggtaaacctgggatttgaatctaggtctagctctagagtctacactcttaaataaggtttactacccactaaacagatttcttgatctcttcatgggtctccctagaagtttaaaaaagactacttatgggccgggtgcaatgactcaggcctataatcccagcactttgggaggccaaggcgggtggatcacctgaggtcaggagtttgagaccagcctagccaataggccagcctggccaatatggtgaaaccccatctctactaaaaatacaaaaattagctgggcatggtggtgggcacctgtaatcctagctactcaggaagctgaggcaggagaattgctcgaacctgggaggcggatgttgcagtgagccaaagattgcaccattgcactccaggctgggtgacagagcgactccgactcaaaaaaaaagactgcttatgatctcttttgaagtccttcttgtgttctatttcctctaggaaacctttccttattcaggctgttttactttaatgttagcacttattgttttaactatactatttgtcattggtttatattattatattatttacctactttatgcatacaaatcgtttttcttttttctttctttttttttttggagatagggtctcattctgtcaccccagactcactgcagcctcaaaatcctgggcccaggtgatcctcctacctcagcctcctgagtagctgagaccacccatgtgtgccatcatgcctggctaattttttgtattttttgtagagacagggtttcaccaccttgcccaggctggactcaagtgatctgcccacctcggcctcccaaagtactgggattacaggtgtgagccaccatgcctggcatacaaatcttttttgcccaaaattttaagataaaaagcaaggataatgtctcaaatttattttatagtgccaagaaaattagattataatgtgtaacacacagtgagtgctcaacaaatatgtgatgtaacttgatactctttctttcatttcccccaatttggttaccttcatctattactttggatgcaaatcagtataattgcttctggtgttaatgcaaatatatttggtttttagttaccaaagacgttggaagaggtggctatggacatcacctgggagaagtggaagcaaatggacactgttcagaagtccatatacagaaacatgttggaaaaatatagaaacctggttttgctaggtaaaggttaaaggttactttctttctgcatgttagaatattttcatgcagtgttttgtcatctttagttgttaatagtcatggcaagcgtaatgtggtggctcagaatgtgggttttggagaggagacctgagtccaagtcctggctttgctacgttaaaaacccttagggttttaaaaaccttttgaggccattcgccatataaatagggctaaaaataaaatattgtaaaatcctaaaaaaaaaactgtttcttcaggatttcttgtaagagacagaataaaataagtggttggcataaaagccctgatatagtataaggacttggtaaatgttagcgttgctgcttttcctgttattattgccactattgtgtttattattatttgcatactttactgcatttggcttggatttgaaggatcaggttcatttctgagttcagaaacaactgtttctcctccctgtttatgacaaaaggtgtgacccatgcagatttggaaagtgattgctaggatttactttactttcctgaattctgaccctgtaatttgtgtttgtctctcaccattgtattgtaaatatacttatgaaggacatgactccttttctttgagaatctgaggacctcttcttagccctcttttatctttgcgggtaaaattgatccagttcactgtcttttatgaaatcatcttttcatgatgtgcatgacagtgtaaagctctgattcatctaatctcctaagaactccatgggttcctttcatagtttttgttcctgcctcttaatattagatgtctataaaatgtcatctctatagtggttatttcagtttacaggttgaatattcctcttagtatttatgtctataattatttaaaaagtagatattcactatcaaacacttagttttccaaatataggatattggcttgaccaacatagagaaaccccatctctactaaaagtacaaaaaattagccaggtgtggtggtgcatgcctgtaatctcagctactggggaggctgaggcaggaaaatcacttgaacccgggaggcggaggttgcagtgagccgagatgacgtcattggactccagcctgggtaacaagagcgaaactccatctcaaaaaaacaaaaaagatcacattgtcagcagtatgtagtactgaaaaggcaccaaacaagaagcctaccccttatgtcacacacatagtaggacttgggatttaagctcaggatattctgagtctctagccattatctttttactatattggactgcttcttggggcagcagtagagactaagagtttggactctggagtttgacttatgtgtaccttagacaagtaacttcagcattctgaacctcccttgaaattgacattctattatctcacttataggcttgttaggaagatttgatatgttgatcttgtaagtcagcccagcataaactcaattaatattagctataaaccaaaaacttcatcaaagttctttccctttttctaagacatgaaatgataactttgaagacaacatgtgcagacaggagaaaatagataaagaatgtacagcactgctattaagtgctaaaattagaagttaaaatagtaagtagtaggaaatcagggaaactggagagttaggaatgttgtgggactagtgtcatttgagtggcgctccaaagtagtgtcaagaattagatgggcaaaagaaagaagaaagggctttttgtgcaggagaagcaataatgaagtattgtttgttgttattgtttttgtttttgcttttcttttttttatagaccagtgtgataaataaattagagttaaaatgagaaatgagtgttgaatgttaggagtacagctaataaaatcattaatttttatgtgtaatatatgccagaatctaggggacacattgaaaacagatggtttagtaaaaatctacatattgaatggagagaccctcacctcaatttttccttctactggacttctacatcctactccctttcaggtagaaggttaaagtgattcattctggggaaactaatcagcctaagataaaagaactgtaggtgccaatatttgggcatcctctaataaatcagccaggtcccttcccagtcatcctgcaatgaaacccattataaatcatgactttacaaacaattttcagtcatcatattaatacaataactctctctgaagaataaatccagagtgaaggactactttttaacatgctgatgaagaagagctatccttttttccctatgctttatgttacttgcctctttatccatgactgaaagtgaaaaataatgtagatttgtcattagaaagacctaataattattttttcatttcaaaagagtaaatttctcccttttcatcctttcctttgtccttaaacctagagtttatggtctttttatatcaagtgtaaagcaataacagcagttacctgacaaagaataattagctaaaagtattactttgtacaagtactaaaaaatctaatataaaagcttattgaaaataaaaagctcttagtattttttaagataatagtttcaatgctgagtaagtagttttctcataggataatttctaaaagactatttctttctgataacagttttcatttcttaatccctgctcattgtttctcttttctaatattcgccatttagttttttccctaatcattcttctcacctgacagaatgtttgcttcattcccattgattgcgttatgctctgtatcagacactttcactccactagtatttccatctcactcctccctagattactatcttatagtcccagtattttatgttctcagtatctgcaatttcattattccattcctaatataccagcttcttttctcccaacatttggcacatagtagagtcatatttttatgtcttttagatgggaagcttgaacgtggggccaagacatcaagagtagagcagcaggacatttcaaaagaagattaatctcaaagattagagatggaagaacttgcaaagagaaagtctgtaccggaagaaatctggaaatctagaggccagtttaagaatcagcagctaaacaaggagaataatctagggcaagagatagctacctgcacaaaaattcctaccagaaaaagagacatagaatctaatgaatttgtgaaaaattttactgtaagatcaatacttgttgcagaacagatagatcctatggaagagaattgtcataaatatggtacatgttgaaagatgctcaaacaaaactcagatttaattatacaaagaaagtatgatggaaaaaaaaaaaccttgtaaatatagtgaatgtgggagaaccttcagaggccacatcactcttgttcagcatcaaataactcattgtggagagagaccctgtaaatgtactgagtgtagaaagggatttaatcagagttcccacttaagaaataatcagaaaactctttcaggagaaaagccctacaaatgcagtgagtgtgggaaggccttcagttattgcttagttcttaatcaacaccagagaattcacagtggagagaaaccttatgagggtactgaatgtggcaagacattcagtcgtagtacataccttactcagcatcaaagaattcacactggtgagaagccctatacatgtcttgaatgtggaaaggcttttagtcagaacacacatcttactctacatcagagaatccatactggagagaaaccttatgaatgcaatgaatgtggtaggtcctttagtcagagtgcacatcttactcaacatcaaagaatgtatacaggagaaaaactctatgaatgtaatgaatgtgagaaagccttccatgatcactcagctcttattcaacatcatattgtccatactgcagagaaaccctatgaatatcatgactgggaaaactttcagttactgttcagacctcattcaacatcagagaatgcacactggagagaaaccatacaaatgcaatgaatgtgggaatgcctttagtgattgttcatcccttattcagcatcaaagaactcacaccggagaagagccttatgaatgtaagcaatgtggaaaagcctttagcagaagcacataccttactcaacatcagagaagtcacgcaggagagaaacagtataaatgcaatgaatgtgagaaaactttcagcctgagttcattccttacacagcatatgagggttcagactggagaaaaaccctacaaatataatgaatatggaaaagcttttagtgactgctcaggacattttcagagaactcacactggagagaagccctgtgaatgtaatgactgtgggaaacctttcagtttctgttcagccctaattcaacataagagaattcataccagaaagaagccctgactgtaccttcataccagtaaatgcactgactgtggaaaagccttcagtgattggttagcacttgttcaacatcagataactcaacactggagaaaaaccgtataaatgtactgaatgtggaaaagccttcagttggagtacagacctcaaaaatcaccagaaaactcatactagtgaaaaatcctataaatgtaatgaatgtagaaaggcctttagttactgctctggtcttattcaatgtcaggtcattcatactatagaaaaaccttatgaatacggtaaatgtggcaaagcctttaggcagaggacagaccttaaaaaacatcagaaaatgcataccgaagagaaaccctatgaatgtaatgaatgtgggaaagcctttagccagagcacatatcttacaaaacaccaaaaaattcatagtgaagagaaatcaaatatacatactgagtgtggggaaaccattagacaaaactcttcttttttacaacaataaaaacctcacactggagagattctctgaatgccttaagaatttggttaatatggagacccttcccagggaaacagaaggaggatcgtgaaaactgttgactacttagaatgatcacatggtttagtggagagagcatgattctgggttttaaaagtcatggatctcaatctcagctcctattactaactagatcttttactttggggtaagtcacttcatatctttaggccttaatttcctcatctgaaaaactggaaggcctgacttgttgagctttaagatcctcaattattatatttactaggaattcaagtttctatagatgtggttcagaattgtgacttatttattgtacatcaggtgtgattcacaagtgagcttgtagtagttattaaggagtcaataaagatatgatata

SEQ ID NO: 787 - DNA, 1897 bp, Homo sapiens
ccgggtctcacctggctgaatgtcggcttgttgtgaagccgggagcaccggtccccgtgccggcagaccccgatcttaaagtaaaaagagcagttaaccctggaaaaggtgcaaagacaaaggtgaaccgagggccggggaagctgggcaccccagaaacaccgccccaccacccaggaccccagtaccccggccccgaccccccgagagtccactcccagcgcccgttctcacttgtccttctcagtcccgaatatcgaagctaaatattcagccatttttacccaagccctccaggtctggctgctcttacgtcacttccgttgcttaggagcactgggaagtgtagttcgttgccctctccaggcgcttaccaagcgctcggaaacgccccagggcgcttgcgcgtgggaggcgcgcgccctccccatagactccccggtaggagttcttttaacagcgcatgcgtgcagtgttgcctcgcccaaagaagactacaatctccagggaaacctggggcgtctcgcgcaaacgtccataactgaaagtagctaaggcaccccagccggaggaagtgagctctcctggtgagttgggggtcgtttcgcccaccctagtaaatataaagagctctttaatccagccagcttactagtgggggtggggatgccctgctttcagcaaaccgacctttacatttatctctgatttgttctaataggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggtaaggcagatcgctagggtcccaggagaagagaggggactggactagagcacccgagggaagagggcctcggggcctggattcttaagtctaagagatgaaggacctgcgaacgccgactcctggatttgagtggggagggcctgggtcctgaggaatgaggaagctggggcctcaatttctggatcccaagagaggagggggattgagggcctggactcttgggtcctgtgaaagagatggttgaggaatcagattcctggatcccaaagaggagccagattcctgagtccctgacaacagaaatctccatttgaacttgggtgtgggagagtttcttccaaatagatctcggtgggagttggagaagatcttcattgccttatgaggttttggggtttgtttgtttgtttttctttctccctaggggggtttgctttcctgccttttctctggttggtcaacatcttctggttcttccgagaggccttccttgtcccagcctacacagaacagagccaaatcaaaggctgtgagtctagagcacagaggagggaggccagtggcaggggagagggggaagcggggaatcttggtgggaagggacaatggaggatccaaaatgttggggctctgggtgagaagggaaggctggtctagggaagtctggagagcagccggaggccaacccttccagcttctgtttcccatgacagatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcgatactga

SEQ ID NO: 788 - DNA, 257460 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtgaggagagggctgcaaggcggcggcctggaccacgggcggctgcagcgggggcgggggtcggcgcgggggtctgcgcgatggctgcccggggcatccgtcccgcgcccggcgcttgtctccccggccgcccttagcccctcgccgcgcgcccgagagacggcagcggctgcccctctgccttgtccttcccgtcctcgggggtggcggcggagtggcgggcggacccgcactgggaggccgggggccgcggtgggccgtggggtggcggccgcgggacgggcgtggggatgaatgggcgccgcggccccgccgccgagcgggctccctcctctcgcggggaccccgggcggccgctccttcccgggctgacctcgctgccctcggccgccggcgaggggcggcccggcctcgcctcccgccggcctcccggggacccgcgttggcgggagcggcgccgcctctgcctggagccccggctccttcctcggcccctcgctcgcaagcctgcagaatcctgggtcagtgaagggcaggcaatgccgttcggccccagggcgcgccgcggggccgcccctgaaggcatttaaaggggagcgtcttccgcgccctgtgagcgcgtccccgggtccgccgcgtcccttcccttcttacgcaccgacacggttttgtggtgtggacccaagacacaattgcagtcccttgcttgcacgaatgcaatccgaattcccaaaaaaaggaaaccggcgaggaatcggccgcaccttcctgcgcttctgcttgccttgggattagaaaacaacttcggagattacatttcctatgggcaatcttttgttgtgattcagactcaagaaggctttgctttggaagaaatagattagcggcttctctgtggagttggaggctatagagatttttatagcctcttcaatatgaaagtttcctctagaactttgccatcatcagtgctattctgagggcagcagcaacctggaaatttagatacatgcaggctccggccagatgcgtttctttgtgcttgtctgttggcattcttctcttgctgctcctcttgatcaaaacgtacagataataaaggcaaggccaatgaagagggtagataataacagcaaatcccatacaaacaaatgcctctagaaattctcagttctgtcagcggggaggcagttttgctaatcccgtggaacggatgaaaagaaaggcacagagatctcatggattatgtagtggacaggatgtgagggcaggaactggggccaggacccagcaggccagctggtttgcatggtgccactctaaacccccaaaatatgaataggaggaatgtatttgttgggatacctttatttttagatgactttaaggttgagagtgcagaagcttaaacatccttcatagttattatttcttagtttatctctgagaacaaaatatgtttctgtttaaaatttcttttactggtgtgcttgaaacgttattttgatgggagtttccttgtaagtaaaaacattgaaaaatacatacatatgaaagaaaaatccttagtgcagatgggtttgtaaagaatccagggacttttaagtcatataaattaagaagtgagggacactaatttgatgatggtgttaaaattatttcagacacctttaagtagtccagtggagatcatttctgatagtatgatctttttttaaaaaaatggtatttctttatctaggaatgcttctgttgaaattgctacggcgcatggtaccgtcacaaaactcttttattattctgcctgagtaagagaggaaatgaacaaatttttaatgtactttggaaccctgcggattgcacagatactaagcattgtgaaatagggcataaaatgagtggtagcaagttagttctgtgaaatgtttgtcgctgttagcatttttttttttttttggcagtcgactagcaattttcttttccctaaagcttatcttcaatattggtagtagaacctctgctcaagtttatcttttccccaagtgcctagactgggacaaactatcaagcctcctgtaagagattaaggaggagctgctggtaaattcctttcctttttttttttcttgaggcagggtctggctatgtcacaggctggagtgcagtggcgcaatcttggcatactgcagcctcgacctcctgggctccagtgatcttcccaccccagcttccagagtatctgggatcacagatgcacgccaccatgcccagctaattttaaaattttttctagagacagggtctctctgtgttgctcaggctggtctaaaacgcctaccttaaacgattctcccacctaggcagcctcccaaagagctaggattagaggaatgagccaccatgcttcgtccaaattcctctactctaaattatctttttaatttgctaacatttgtgagttgtagagaattgatgacacgagagttgggattatattatgcacctcaaattcttctgccatagagctgttcccttctgaatgatcacttcctcctgaatggctccacttaactggttgggtttcttaaagtgtgggcctcagatcacttacatcagcattaatggaggcacttgttaaaaatataggttttgggcatggtggatcaaacttgtaatcccaacactttgggaggctgaagtaggaatagcttgggcccaggaatttgagaccagcttgggcaacacagggaaacctggtctctaaaaaaaaattttttttaatattctgggcttagtgactcgtgcctatattcccagcttttctagaggctgaggtgggaggatctggttcgcttgagcccaggagatggaggctgcagtgagccatgattgccctactgcattctagcctgggcgacagagagagcgagcctgtgtccaaaaagtaagtaagtaaataaatacataaaaataaatacgggtttctgtcacctcgcttcagaatcagacagctagaggtggggccctggaattggtgttgttaatgcattctccaggaatttctcctgcatagggaagttggaaaccactggcttccttctctctgagcatctcctgagactagctcctgaagtggatagaaagtttttcaagtagcagattaagttttatcccttaggctgctaataaaaaacaattgactgtgattgcgtaattttacctgtcgtacacctttcagaaggcagaggctttggttcacccctctacctccagggcctaaaacagtgcctggaggaactcaattaaacatttgttgagtgaatacgtgaattacattgcagcgaggccaatcttttaaaagttacttgtcaaattaatctatcagttagtggcatattaaagcccagcatattacaaaaaaattttttttagtagtcactgattttataaattaggagccacaagcactataccccagtgacttctgtaagtttggttagtttagaaaggagagagcctttcccaggcgtagtgtgctcaaggtgattagccagaaagaagattcagaacaaagcatttgcttagagagtcaaaatgtaaatttaagtcacagtgtagtggtaaatcatatatcaaacttatatttggtatattgtcttatatcaaaatatcattttataaaccataagtccaacatactgctataaaaattggtttctagcaaatagagaaaattgttatgttttccaatttcacttttcatactaataaaatttgacctttacaccttcttttcaagagttcaccacagggcaccatagatattatgtagttaagagctcaaactttggagaatattgtgtttgaccacacatagtcagggagtttgatctaacctctcaatgcctcatttctcagctgaacatggaaatagtaataataaagttcacatacttctaagtgcttacctaagtttttgagacacatccacttaataaatggtagttacagtgatgataaagaattggggtgtataaaaatacctaaaactcaaaagctaacccatttaattattgtactactggacttttatgatagtaagtagaaatctgttgcttaaaaaagaagtttctttggtggtgtgcgtctatagtcccagctacttcggaggctgaggtgggagaatcacttgaacccaggagatcaaggctgcagtgagctatgattgtgccactgcactctagcctgggtgacagagcaaggccctgtctcaaaaaaaaaagaaaaaaaaaagtttattgctaactccttggtactatgtataatttttttaattgaatgactagactaaacattgaaagtatttaataagctatcaaatatgtattaatataagttttgaaaataaatactaaatctcctgatctcttttaggttaaaatatagtttatgatgagcaactaatattctttgtatttaaaaagataattgttttatggtagaaaaattgaaatacagaaaagtataaagtagaaaactatgaaatacccgtaagtctactacctgcatacatatttcttcaaatccttttgtgtgtgtgcatatggctattcatatacaatttctggtaacaaaaatgggatcttgctatacatatggttgtaacctgctttttttttgcttaacatcttgtcatgagtgtcttttcctatatatatattgcattataacaattttagtaaccaaataatattccgttttatggatctatggtagttttttttttaatttttattttttcagacggagtctcagtctgttacccaggctggtgtatagtggctcaatcttggctcactgcaacctacgcttcccaggttcaaatgaatctcttgccttagcctcctgattaactgggattacacatgcctgccaccatgcctggctaatgtttgtatttttagtggagatggggtttcgtcatgttggccaggctggtctcatgctcctaacctcaggtgatccacctgcctcagcctcccaaagtgctgggatcacaggcgtgagccaccacacccagtcatggatctctggtggtttagccaatttatttttattagacattagtttgtttatttttcctccacggttacttataaccctgcagtgactgtccttctacatatgtctctgaatgtacttgtgagattattttcattaggataaatttctacaaatggaatttgcaggatcaaagcctatgctaaattttaggattttttaaatccgtatttccaatttgtcatttagaaagattgtatcattttatactcttaccatggtatatcagacttccagtctcccagccccttgtaccttcccccattttatggaatgacttaaccagtgacaaacctagtgaatttttgcttttaggaagaagaatggactgttagtataatgtgtttagtagtgtgatatggaaactcagaaatcttgtgcatgggtaatagtgatagctaatgtcgattaagttcttttgcagcatcttatatacattaactcacttcacaaaaaactctcatcttacagatgccttggaaactagggtaccagcaattagagagccagcaagtgtctgagcagatttttactgtagagtccaaaactcttagcctgtttcctagacatgttttataggcatttgggtactttttatgttctcgattgctgttgtggagtaactaagaggttctctgacatgtactaatatataaactgggtggggcacaaatttgaatccctttcactgaagagttggtcacataagttagctcagaaattagctttgggaccggtgctgtgggtcactcctgtaatcccaatacttgagaggccaaggtgggagcattacttgagcccaggagttccagactggccagggcaacatagcaagaccctacaaaaaattttttaaaaagtagcccagtgaggtgatgcccacctgtagtcctagctactagggaggctgaggtgggaggactgtttgtacccagaagttggaggctgcagatgccacagcactccagactgggcaacatagtgagatcttgtcaaaaaagaaaggggagggcagggcaagagagagagaaaagaaaggagagaaagagaaagagaaggaaggagaaagaaagaggagagagagaaaaattagcctcatcaactgtccagcattcatccttaaagtagtcttgttatcctttactctgtagtggttttcctaaagtacccctgcatgaaaaacaggattagagtgctagagaagactagtgaaatttgaaaaggcagttcacttgtgatgtggacttgtcttagaaacgcaagactgtacagaagtgtgatgagggagacagctgggtgtgtgtgtccaggtagttccatgttggcgagtttggagatagaaagtggcctaaggaagtttacttcctgaatgtgaatgttggccactttggagatagaaagtggcctaaggaagtttgcttcctgaatgtgaaggcctcagtgtagagagatatcatccactgggagatcactgaaaagtaaaccaaaacatttttattaatacatgggatggtagaatgtcactccagttttgttcctaaagttcgtagctctctaagaaagtgaattttaagcaagttaatctattttaatgcatcactgctctttcggtgtttttctagtagaattaatgataggtagcttgctttattagcttactgcccagagagaacattggtgaaattgttttggcttcagctctctggactgagtttggctgcctagctcagttttcagttggtcaccaaaacctgtcattgtttttgtgtggtatggggtctgctggagtcatgtggtagtgcgtttggcccttcattgagtggtggagccaggagttgagctgagggctgtggcagaattttgaattcaagtgaattcgaatgtgaaaataacaatgtctggccgggcgtggtggctcacacctgtaatcccagcactttgagaggccgaggtgtgcggatcatgaggtcaggagtttgagaccagcctggccaacatggtgaaaccccatctctactaaaaaatacaaaaattaggcgggcgtggtggcgcacaagtgtaatcccagctacttgggaggctgaagcaggagaattgcttcaattccctgcttgaacccaggaggtggagatttcagtgagctgacatcgcaccattacactccagccttggcgacagagcgagactctgtctcagaaaaaaaaaaaaaaaagaaagaaagaaaataacaaggtcatagcaacacagcaagtggtcagaattttacccttggtggttaaaattaaacatcctctttttaatacaggaggacaatgctcttgctcctctgttgcactggtgagcatttgatgtgttcctccttgcattatgtctgcaaatcgttctggtgtctggtggcatgcatttgcaagacatggatacagttcatggacgtggacgaggtcagctggcttttagtgtcaggctttaaccaacctagttaagaaggacgctgactcttaccataaaagcactgcaacaagattggaattggagctccaacgaattggagccattcgttttgtgtgtgtgtgtctgtttgcctgtgtgtgtgtacagggttaattacttctctgcaaggcaaatttcctgaccggttttattgttctaacacagacaaaatgttgtgtaaacacatatatcattccagtgtgttatctataataggagtgttcattgtggatccagtgtttcacaaaaatcaattcatttccgctctgaacttaagatagtagattttaaaaccaagttatctttcaatttctgaagttatctgaaactcagctgccccagtcttgcagaattggagaattgcattttggccactgatgaatgaaagctatatagctagtaatgagagaaaccttgaaaaattgacaagaaaatgagtgccattcttggtatatagcagatttcaatgaatagtagttccctttgcctttatttttcctctttcctgcacttaatataaagagctaatattaaagtcattaaatgagaatagatctgtattataggtagcactgcttatttttagaccccttcagatacagttattacaattgttgttttaatattctttaaatgattacaggaggaagaaacttggtagcggggttaccaggatgttagctccatgagggcagggagtgtatcgctgttgtccagggggctagccccaggccctagagcagcgcctgctgcctggcagacacgcaagggttatttgttggtttattaaatcaaggagtgtttgaggtccttcaagcctggaggcccgagggctctgagctggtacagagcaagtgctgggggcaagagagacaggtggggagtgaaggagagaggcccacttgggacttgactctgaatgtctgggaagtaggaagttaatgtaagttttaagcaggggagtcccatgatgtgcttttgtttaaaaatctccttctgagtatcatgtgggagtggattggaggatggatagagaggaacattccattgactcggcttccagctgtctatggatgttgacgtttctacctagccttctgctttatctttgtgatgaggataatgtggtgtactttgtgaggtctcaggaatggtttgagatgaatggtaatttgtgtaaactttccggagtttctctgaggaaaagagaaccccataaaattattactattgatcaaatgaaatagcagtgtaagacaaagatcaagaattatttagctttataaacaaattaattgaggttatgaatataggtttctataggagagattttgtttcctttttttagtgaaagaaatcttaaatgtatgggaatgaatccttaaaatagcaggcttttgcattgtctatagaagctgttctctttgaggaagatctgttttgtaaaatgctgctgttgtctgtccaatctggagttttaattagtatcaaagggagggaaatcctgcagtaatcgtaaccttactttaattcttagttcaattagttttaaaccacagtcattatctgttatctttagttgttttgatcttggtagatgaagtgattaatattacagttgtgatttggtaatttaaaaaataacatgttttttcctactacaaaaggaatacatgtttattgaagaaaacttttggaaacatatataaggaaagaagactaaaagcctaccaagatcttaccatccagtgataatgactgttaataccctgtgaaggtcaacatgctcaaattacccagcaggtgcctggtgtgaagctacttagcccgggagagttgaaggcctgttagggaccacgagcactgaaggtggcaggacggtccagggccagtcaacccagacctttgtggttctgggaggatgcgtcctggtgttactacaccttatagttatttaggagaatgtgggtttaatatgaaatcttctgatttttatgtgggccacactttttattgttaacacactggggttcaaagcatacctgagggctggattcagtcttcgttgccttgccagtttgtagcctcaggtacgtacagttttgtagcctgtgtttttcacttaatgtgttgtatttgcagccttttttgctacatcgtcatatatgtaatcagtcacttattgctggacctatagattctttgtctttttgctttttaataaagataggtaaaattcttggaccaaaagttgtttgtaaagcctttgcagcataccgctctcagatgcattccccctatcatgtaaaaggtacttgtttcctgttctcttaccaggactgggtaaaaccatctccaaaaacatcttagccaattttatttgttttaacttgcattattttctgtattaccaatgagtgtgaatgattattaaatgcctattggccttacacaaatttatttggtaaccaacttgtcttgctggaactctaagttccagcaatgttttggtcttgcattcaatgcttctcagtctttgtgattccagataatattagtactgtgttagtagcaataattagtactaattgtaggcatcgttccccaaaactgagggcatcagtatctttggcacaactataatccacttaaagtactgtgactgggaagttctttttttttttttttttgacagagtcgtgttttgttgcccaggctggagcgcagtggcacagtcttggctcactgcaacctctgcctcccgggttcaagtgattctcctgcctcagcctcctgagtagctgggactgcaggcatgtgccaccatgcccagctaatttttatattttcagtggagacggggtttcgccatgttggccaggctgatctcgaactcctcacttcagatgatctgccctcctcagcctcccaaagtgctgggattacaggcgtgagccaccgcacccagccgtgattgggaagttctgagtttagttagctgttcagtgaatgtttgagtacacgctgtatatgcctggcattgctctaggtgagtagccttgaaccaagatagaatctcagccctctaagacttctatgcttttttaaaaattctcgagtttttcatacagaccatcatgtttataaaggaccattttcattcctagaatttataatttatttttaacttgtatttctttcttttttttcttttttgagacagagtctcgctctgttgcccaggctggagtgcagtggcacgatctcagctcactgcaagctccacctcccgggatcatgccattctcctgcctcagcctcccgagtagctgggactacaggcatcagccaccacgcccagctaattttttgtatttttagtagagacggggtttcaccgtgttagccaagatggcctcgatctcctgacctcgtgatccgcccgtctcggcctcccacagttctggaattacaggcgtgagccactgcgcccggccaatgtctttcttttttttgagatgatgtcttgttatatcgcccaggatggtcttgaactgctgggttccagcagttctcctgtcgcagcctcccaaagtgctgagattataggcatgagccaccataacttgtatttgtttattggcatggaacttctaaaacagtgatgaatgcttgttaccctttaattccttccttctttccttcctctttctctttctttctctctttgtctcttctttctctcttttgtctcactctgtcacccaggctgagtgcagtggcatgaccatgattcactgtatccccaaccttccaggttcaaggaatcctcccacctcagcctcccaagtagctttgactacagccacagccacgcaccaccacacctggctaatttttttttttttttttttggagagacgatctcgctgtgttgcctaggctggtcatgaacttctggactcaagtggacctctcgcctcagcctccccaagtgctgggcttacgggcatgaaccgctgcacctggcctttgattttttaaattcactttaattatcttaagttctgttatactctagactcttagcaagagtctagaatcaacgttagttattagttccgtattttgattatgagacaaggtacaaagctgagactgtgtgatgagaacctttggaatgtatatctgacccaacacagatcccctaagtgcccttcaacctacacatccaatttcttcctacctccttctctacacaaaagacataatacattgaactcgggttgggcacctgaccaacctggcccaatcagtgttcgtttcttccctggaaatttgaaactaggctcaatagagaaggatttggccttaatatgctcaaggaccctaagtaaaggattgggagttataagcagttatgttctgctgtctggggactaagaaagatgatttatggatggggagaataaagtaactgtctaaagagaagcagagagaacactacctgactctctgacagcattaagccactctcttccagtctgttcttggtccagctgcattctcgttcttgagttcttaaggttacctccttccccttgatttaggtagctggagtttctgttactgtgaactaaacattcttctcattcttaccacaatattctttttatgatactaccttgtctctttttttttttcactatgtctagggacgttgtgaatttgttattattttctccatataataacatcaacagttaaggatagcaagaaacatggaagtaccaaaatttaatctaattcaggcaatcacaatttgattggaaaggccattttacaaatgcggactctggctcggacctgttttaaaccggtgtagatctctagctgagggaaaacaggaaggaagaaattttgaagttacttttaaatgttgcagaatttcagtggtgtcatttcctttcacatccatataaaatgttgacctcctgcaaaaaccaatactagggacattcacagtgtacagtattatgtgcatctgtatagggggtgagtctgaattctgttcaagtgtgtagccactgaaacaagattttttttttgtttgaggcagagtcttactctgtcacccaggctggagtgtgcagcggtgcaatcttggctcactgcaatctctacctcctgggttcaaacaatccccccacctcagcccccagagtgggtaggattacaggcaccaccatgcctggctaattttttttttttttttttttggtatttttagtagagatggggtttcgccatgttggctaggctggtcttgaacgcctgacccaaagtgatctgcctgctttgacctcccaaagtgctggaattacaggcgtgagccactgcgaagggccttgaaacaagactctaaagtgtactgtcgaaataccaagaagttgaatcacagaatagtttacctggggctgggcttagttcttagattagctttctgtgtcgtggtgatgtcatgtatcaggaatccttaacttaaaaaaaactcagtgataagtttaagtagtccactatctaaatgcagttgggtggggaggtggaaaaagtgatagggagagaaaaaagaggattgtaggagagagaaggaagaaaaaggaaggttgctttattgccacagttttctttattcataattgtatttgtatgagctttttcatttccaagtggaagaagcacagcattgaaatgtagtgactcacatacctgtcaagtccaaggattctgattggcctggcatgatcgtgtgtctgaacccatcatatgaccaagggaaacgtgtactctcattggctctcctgggccttgggtctaccttttcccccagttggtgagaccagtacctaaactcgtggaattaacagaaagcattaaagagaagtaggatctgtcaagaggagaaaaaaacgctaggcaggcaaaacagatggcctttactcagtgtatgatcagtgtcatacaaattaataattaataattgaagttacttttaaatgttgtagtatttcagtggtgtcatttcctttcacatacatataaaatgttgacctcatgcaaaaaccaatactacagacattcacagtgtacagtgttgtgtgcatctgtatagggggtgagtttgaattctgttcaagtgtgtagccactgaaacaagctttttttttgagacggagtctcactctgtcacccaggctggagagtgcagtggtgcaatcttggctcactgcaacctctacctccagggttcaaacggtccccccacctcagcccccggagtaggtagatcaggtctgtggcgtgccacttgttttatttatttatttatttgtttatttatttatttggcagagtctcactctatcgcccaggctggagcgcaatcgtgcgatctcggctcactgcaacctccgcctaccaggttcaagcaattctcctgcctcagcttcccaagtagatgggattacaggcgcctgccaccacgcctggctaattttttgcatttttagcatttttagtagagacggggttttaccatgttggccaggctggtcacgaactcctgacctcaggtgatccacctgcctcagcctcccaaagtgctgggattacaggcgtgagccaccatgtccggccttttttaatttttttattttaatttttagattcagagggtacatgcacaggtttgctatgtaggtttattgcatgatgctgaggtttgggcttctaatgaaccagttgcccaagtagtgaacatagcaccagataggtaggttttcaacccctgcccccgttttggaatccccagtgtttattgttcttaattttgtgtcagtgtgtacccagtgtttagttcctacttgtaagtgagaacatgcggtatttggttttctgcagaagctttcttgaccttctccttttatctctgattgtcagtttcctcttagtttcatttctttccataagcagctgtgacctcagcatgggtcatttcagctatttccttgccctgttgctctgttacatttaggacttcccaattccctttgagggcttcttatccttaaaatgttgctgtcgccagggcttttcataccctcttttgacatttcactggtcttccacggcagtcattttcactgtatttatctgtctgtacctggagcggtgtctttttttctaaccctgcatcgtgtaatgatgatgttctgataggtgattttgtctttgtgcaaacatcataaagtgtatggttgacctttgaacaagggagggattaggggtgttggtccccaacacaggcaaatccacatataagcagggctccgtggcccttgcctgtaatcccagcactttgggaggccaaagtgagaaggttgctcgagaccaggagtttgagaccatccaagcaacaaagtgagactcccatctctacaaaaattttaaaaatcagctgggcatggtggtgtactcttgtagtcccagctactagggaggctgaggcaggaggattgcttgagcccaggaatttgaggttacagtgacctgtggttgtgccagtgcactccagcctgagcgacagagccagattctgtttttaaaaaaaatcatataacctttttgactcccccaaaacgtaactactaatgacctattgttgaccagaagccttactgataacatagtccatgaacgcatactttgtatgctatatgtatgatatattctattcttacaataaactagagaaaggaaaatagtattaagaaaattataaggaagataaaatatatttactattcattaagtggaagtgggtcatcataacattcttcatcctcattgtcttcacgttgagtaggctgaggaggaggaagaagggttggtcttactgtctcaggggtgacaaaggtagaagaaaatctgaatatgagtggacccacacagttaaaactcatgttattcaagggtcaactacttatacaaaccgaggtggtatagcctactatacacctaggttatatgtatagcctattttgctccttggttacaaacccctacagcctgttactatactgaatactgtaggcagctgtaacacaagtatttacagtggtatttgtgtatcgagacatatctaaacatagaaaaggcacggtaaaaatatgctgttacaatcttacgggaccacgattgtatgtgcagttcatcattgactcaaatgttactggctgcatgactgtacctactggatccattgggcgcttaaaacttcaatacatctagagcattgctcacctgccacctttcttctgaccaacctcttcctctgtctgtatatcccatcttggtgaatgatactattatctatccttttgttcattgtttcagcagttatttattgattacttactgtgtgtcagatagtctgtggtataattttatatcattttgttcctgattcctagcacatagcttccaaaatctttggaatttcctgagtggtgggagtgtcttcttattcataatgagtccttttggatcttatctgagttcatgctaatgaactggctcctggggatgaggggctggacaccctcagaattgggggtggtccggaggaagcagtcaggaaactgcaggattggagggttggaactttcagccctccgccaccaccagctccagggaagagagagggactggaaattgagttcagtcacgtggtcagtgatctacttaatcatgcctatgcaatgaaattgcaaacgaaagccctggaactgtgaggttcggagagctgggttggtgaacccatgatgtgcagaaaggtgagtgcctatattgcacagaggaggagagggcatggaagctctgtacttcctctcccccatgctttgtgcagtgagtctcttccatttggctgttcctgagttgcacagagcttttccatgttcggtgagttgttctagtcaattacttaacttgaagtggagttaggggaacccctaaatttgtagtcagcctggcagaagtgcaagacttgaggctggcatctgaagtggggaagtcttatgggaccaagcccttgatttggggagtctgcactaactccggtagtgtcagaattgaaatgaatggtaggacacccagttagtgttggagaacattttttagaactcagtctgcctatagtatttttgaatactgtgtctatacacagtatagacttagtacctgcccttaagctagataggtgaacaagcaattataatttagctttgtaagctattcatggactaagtcagcagcctgtactttttttttttttttttttttttttgagataaaatcttgctgtgtcacccaggctggagtgcagtgagatgatcattgatcatggctaactgcagcctcaacctcccaggctcaggcaatcctctcacctcagcctcccgagtggctaggaccacagttgtacaccaccacacctggctaatttaaaaaaaaatttttgtagagatgggatctcactggtctcaaactcctaggctcaagcagccctcccacctcagcctcccaaagtgctgggattagaggtgtgagccactgcacccagcctggattctatctgatgctgaagtcggtggcttgattctgtcaattcagcctctgaaaggtcgtttgaattcaccctttctagccccactgctctggtcttagtccaggcctttatatattttttcactttactactttgctcttaatggttgctgcttcctgactcgtctggcttctctgttccacttcattttacactcacatgttgccaaaataatctttgttatgtgctgctcccacaataagatctttccccgtgcttttatctcctaaggtggtggacctcaagccttttggtatcaaaacccttgtgtcctcttaagtgattgaggtccccaaggaacttttcttcatgtggatttttgtcttatcattgtctgccagattagaaattaaaaccaagaaatttacacttaaaatagctgtaataaacctattacatgttaacataaataacatttttatgaaaactgttcacaaaacaaaaaaatttagtgaaaagtggccttgttttacattttttgcagatctctttcatgcctcactgaataaaaagatggctgaattccataactgctcctgtagtcagtttgttgtgaaacgttgttttggttgaaatagttgaagaaaatctggccttatacagatatgtagttggaaagaacaggagtcttttagtggcatttccagaaaattgtggttattttgtgatactgtaccaaaacttgacactgggtagtttcttaaggattggttgcagtgtagaatctgaagtcatataagtgaactttttatcctctgttacaataaaatctgttgatccatcctatactttgaatggctattttacccctgtttgatttgaccaatacatacaacatcatgtattggtcatttggaaaatactgggtcactgagttatgtaaatcttacaaatgttgacacatttcattaaacaatatcacaaaatcgtgtttgttatcaccacccatcttattagaaaattctttaaatgttgagaagcagtctagctcataatggcagatacaagttttccaaaattctaattttcaccccaaattcaaattttatcatgaacagcaagtactgtcagttgtttttcttgcagcatcaggcttgctttatttttgagaaactgtgccagatacccaaatctgaataatcatagttttttttggttgttgttttgccaaataaaaatcgagttcctgtaaaaaaaaaatggctagtttagctcacaactcaaatgattgcacagtgattttcttggacattgttgtttggtgtagcacataaatgctttgagtatctagtcatacaagcattaagcatgtgtactcaagggctgagatttaataaagtaataatttttcatgattcatcaaagacatcctgttgtaaaactgacttttttttttttatgtgagtgtttggcagtgaagaatccagtgaccacactggtacagtttggtgccactgctaaggtgggagcagttttacccaccattgtttttgtatcagtgtaaataaaatcacagtgaaaagagcaggtcttgcctgagtaccatcatgatgatatggtttggctgtgtccccacccaaatctcatcttgaaatgtagctcccataattcccatgcgttatgggagggacctgatgggagataactgaatcatgggggcagttcccccatactgttcttgtggtagtgagtgagtcttaggagatctgatggttttctaaggggtttcccctttcatttggctctcatttctctcttgtgaccgccatgtgagacataccttttgccttccaccatgattatgaggcctccccagccacctgtaactgtgagtccattaaacctctttttctttataaattacccagtctcggtgaaaatgaactaatacacgtaagaattttgaccatctgaacccccatgaaagggtcttaggactcccagggatccacagaccacaagagaattgctgccttgtaggataaaatctaaaccttcactcacagtttagagtgcattatgctgtatccctgttgaccttccccttttcctcttctatttctcttccatctggatctcaccatagaatgttcttttgtcactttagctttacagtttatttcccttctgcctccccctatctgtcccttatcctttaggcctaactgggtgttactgaagtgaaaatacccgtacctgccgcagctatgagtcattttccctttgatttccagcactgaacttttggctctacctctttccatctattttctagggacctctgatttaaagttccgaatttacaaatcccatcataacaggaaagcattttacatccctcttgtgacttaaacttaatttatactaatatttttcattttgaaccttcttatacctaattaaatgaaacatttgagcaaataggtgatggggtattgccttttttggggtcttctgttctgtcagaaatggtattatagttaggtctagcccagggaaaaaactgatttcctttaacagttatttgaatgatacccattttcctaatcaggaaggtttcttggtattatctaggtactgggttttatgctgccaagttcatcagttaaatggcctttagataaaggacaggttggagttgtgctcagctcatataaaatgtgctttagaaggacttctggtattatctgacccacactgcccctcatgtcacacatgtttctgcacgtacacaggatgagtactgagtacccttcatgtttcagggattctgcaggtctttcacatatgccatctaaaatttgtttttcacaattttgtgaactagatgacaagatccttgtgttacagatgaggacctcgaatttgctgccatttgtgtaatgaaaatataaatggcatagtgagtagctgaacttaaataaaaaatcattgacttaccacataaataatagtattataacattataaaacaagatttggtataaatgagctttcatcagtatagacacatctcaggcattagtctaccttgcctagaaggagcaggaattatttattgagcactgttttggatatatactgaagttccctcaaattctaatgtctcataactcttcaggcagttatagtaattgctggatataccaggaagttatgcctgtaattactgctcagaaatgaaatatgtaaactctagcattatattcatactggttttattatgagatatattaccttttagatttcttataagatctattttttagatttagcttacaaagccattaactgttataaaattatactgtaaattataagctttagttagatgggccgttaggcatagctttgctggcaactgtaaccttttatgattgcagtcaaaatgtaatccagatgctcttcgtaatagaccattgagtcagaatatcctgaatattgttttgcaggttcaaaatgttggaagagatctgaatcaggatgataaaatgacattcacccatctgattttgggcttacttctttgtgacatacctaacctggtgattaaattctttttttttttgagatggagttttgctgttgttgcccaggctggagtgcaatggcacgatctcggcttaccgcaacctccacctcccaggttcaagcaattctcctgcctcagcctcccgagtagctgggattgcaggcatgcatcaccacgcctggctaattttttgtatttttagtagagacggggtttctccgtgttgaggctggtctcgaactcctgacgtcaggtgatccgcccacctcggcctcccaaagtgctaggattacgggcgtgagccaccacacccggcctctgatgattaaattctaaaaccaagagttatttaaaagattttgtagacagtgggggttggaacttgaaagtgacccatcagctatgtagctactagcattttcctaaaaagtcctcagtgaggcagctggacaaggttgagaggcaggcagcatagccaagggattctggagccaagctgctcagctactgtcttagcccacttcgtgttgctgtaatagaatatctgaggctgggtaatttataaagaaaaaggtttatttggctcacaattctgatggctaggaaggtcaagttagagcatccggtgaggtcctcaggttgctttcactcagtgtggactcctgaatgtgatgtggatgtgaagaaactggaatcctcatacattgttggtgtgaatgtagcttggtgccgctgctgtgctaaggggagctagagagtgcagaggtcacatggtgagagaggtagtaggagcgggatgggaaggggccaggttgttaacagccagctcatgtgagaactaagagtgagaactcactcactcttggggagggccttaatctattcatgaaggatccaccccatgacctgaaaacacctcccactaagccccacctccctacactgccacagtggggaccaaatttcaacctgagatttggtggggacacatagcagttactagctgtgtaaccataagcaagctatttaacttttctgtgcctcagtttcctcatctgtagaatgaggtcgatcacagttcctgtctcataagattgttgtgaggatgttaaaacagcgcagtgcctcactaaatagtaaacactgtataagaaatgattgttattattcttatcacctgtgatccaagcctggaatttataatttaagatacgaatgaagttattatatgtagttttgttaccagttgattatatgacctctcttaatttctcagttgctctttccatcatctggaagcttcgccatttgttttaacctttgaagagatgagaggaaaagatgcatgataggcttaaattgctctcatctacttataaaaaataattagacataacgtggccaggcgcagtggctcactactgtaatcccagcactttgggaggccgaggtgggtggatcacgaggtcaggagttcgagaccagcctggccaacatggtgaaaccccgtgtctactaaaaatacaaaaattagctgggcgtggtggcgggtgcttgtaatcccagctactcgggaggctgaggcaggagaatcgcttgaacctgggaggtggaggttgcagtgagccaaggccgcaccattgcactctagcctgggtgacagaatgagactctgtctcaaaaaaaaagaaaaaaatagacataatgcaagataacgtcattaaaaagtgggcaaagacctgagtaggcatttttccaaagaagatatccaaatggtcaaccagtacatgaacagatagatgctcaaaattgttagtcattagggaaatggaaatcaaaactatgagaataccactttacaaccattagtatggctatcatttttttttaaaaaggaaaataacaagtattggtaaggatgtgaagaaactggaatcctcatatattgctggtgtgaatgtagcatggtgccacagctgtgtaaaataatttttcagctcctcaattagatagatacagagttatatggcttagcaattccattcctagctatataccaaaagaaaacaggtgttcaaacaaaaacttgtacataatattcatagcagcattatttaccatagccaaaaggtggaaacaacccaaatgtccatcaacttttgtgcatcagtggacaatgtggcatattcatataatgggatatgattcagctataaaaagaaacgaatgatatatggtacagtataaacgtaccttgaaagcatgtagaataaacatgaaaacatgtataacatagatgtaccttgaaaacatgctaagtgaaagaaggcaatatactgtatggttcctttttttttttttttgagagggagtctcgctctgttgcccaggctgaagtgcagtggcatgatctcagctcactgcaacctctgcctcccaggttcaagctattctcgtgcctgagcctcctgagtagctgggattacaggtgcccactgtcgtgcccagctaattcttttgcatttttagtagagacagggtttcaccatgttggtcaggctggttttgaactcctgacctcaagtgatccacctgccttggacttccaaagtgctgggattacaggtttgagccactgcacctggcctgtatggttccatttatatgaaatacccagaataggcaaatctgtggagacagaaagcagatgagtagctggggcagagcataggatttctatttggggtgatgaaaatgttctggaactagatactggtggtggttgcacaacttcatgattgtctgagatgtcactgaattgcatactttaaaatcagttcaacagtaaattttatgttatttgtatgatgctgcaatttaaaaaaaataaatatttcgacatgacgttttttccaagtttaccttagttgtaattttgccaaaatactttcttaaaccattttattgtaattttaggctaagatcatttgcactttatatatagttgaatgaaatatatcgtagttgttttattctcttgtaaatctagaaaagatgaaaaatgaaagccatgagagttttaagtatgtctttgccttgtgcagatattctcaaagggtattgtggagcccttggggctccttatgaccttttcaaagggtctgcaggttcaggttattttcatagtaattgttgagagttatttgcttttcaaatttttatttatttatttatttagagacggggctttgctctgtccccagcctgcagtgcagtggtgcaatgacagctcactgcagcctcgacttctgggcacaagtgatcctcctgcctctcagcctcccaactgggactgcagggaggcattgttttacatttacatgccaccatgcccgctagtttttttatttttcatagagatggggttttgccacatgttgcccaggctgatcttgaactcctgggcttaagtgatccacccccatctcggcctcccaaattctgagattacagaatttgtaagcataagccaccacacccagcctatttgctttttttttttttaaactctttttctccacaggtgtaaagtgtagttttccaaacgctctataatatatgatggtgtagtctctttgttggctaatggtctatgtacttgtatatgtctggatttttttgttttttttttacaattctctaaggtaagctctttgtgatcctcaataatttttaagtgtataaaagagtcctgaggccaaaaagtttgagaacaaaatgtcttggtaaaaaatgtatgtgccaataatgaaaaagcatatacgaactacttgtattatatatttttgaaaacagaaggaaaataaattgtaagccaaatgactcttttggctgcttagcttttatcatctttactgcttcagaggttactagatttggaaccaaagtgtactttttgggatgcggtaggtttctggttttaaaaaaggatgtctggtattgattaaatctatagttttgaactttctaatccagcagctctgtggagtaggtactgatacttggattttataaccagggcacaaaatggttaagtaacttatctgtggtccgacggctagtaagtggcaggtctggtgtttggatccatgaagtctgtttcctgagtctgcactgttcacagtatgcgatctatgtaataccgctccttatgtacattgtataataatagctccctgggaatgtatgtgtgaagttcccatttggaaggctggcatcgtagtactgcactgatagtggtggcagtgattgtgaggtgggttgggttctggtgcctatggcaggggctccagcaagcagatggttagaagacagatagggagcaaggataggaggatgggctgctataggggccagacctcctgcccaggatatttctggtccagttcgaaagttggacctttccttcctagagattggctccacttatggctttataataggacctcttccccttctggagtcctttggagcaagatgcattttcacagttttctcccaacctctttacttgagtctagcacttactgcctttgaacttctctgagggtttttactaccaactagaaatgaaagaaaaagttgaagagggagatggtattcaaaagataagtgatacaaattggagtcttttaggattcatattattgaaacgcaatttgtcaacctccctaagagggtcacatcactgtggtgtgggcccccccaaggcatgtcatcactgaggttaggatgggctctctgccatgaggagtaagccagtgcctccagctactggctagaaacagggagtgttgtcaggagatctgcactggggctgaaggacatccccgcctacttcccttttgctcttcttactatcagtctttactaccgcagatccctttctagggtccacgacctttgctggggtaaagtgggatgcagggatggggcctggggatgctctaggcagtttgcatgaaggagtggctccattggtgttaaagattaggccttctgatactttcttctccacttgtactttgagttaaaggctcttacctcaagagattttctttactctgtggccatatctgtaactgtccttaactctctgtgcatggcagccccaaaccttcccagtggaacagtgcaagctcagagccttgcaggtcagtgaccccacacttggcacaggaattccagggaaaagtgtgaaagggcagtaggtggctcctccgtcctgcttctttgaaaacctctgacctaaaaggtttttgaagctgaatatttaaagaaaatatgtatgagattgtagagatagatgcctaggcggctgaaggggatgtggcaagtggatggcctccctcagggctcctttccacctgtggtggccacaggttcaagactcctgtccaaacattctggtttgtttatgtgttccagaaacagacagagaagaaggtattgtattttttgagacagtcttgctctgttgcccaggctggagtgcaatggtgcgatctctgctcactgcaggctccgcctcctgggttcaagcgattctcctgtctcagccacctgagtagctgggattacaggtgtgcgccactatgcctggctaatttttgtatttttagtagagatggggtttcaccacattggccaggctggtcttgaactcttggcctcaagtgatccacccgtcttggcctcccaaagtgctgagattataggtgtgagccaccatgcctggcccaaactggtattatatctgcatgaaaaagggtcactgtgccaatacttttttcatttaagtttttttttttttttgagacggagtctcgctctgtcacccaggctggagtgtcgtggtgcgatctcggctcactgcaacctccgcctcccgggttcaagcaattctcctgcctcagccgcccgattagctggaattacaggcatgcgccaccaagcccagctaatttatttgtatttttagtagacatgggggtttcactatattggccaggttggtcttgaactcctgaccttgtgatccacccaccttgacctcccaaagtgctgggattacaggcgtgagccaccgctctcggccctcatttaagttttaatatgtttgtgggtagaaaacgtcttaattttttttttttaatctcagaaaatgacatgtgttggtgttgagatctctcttgagtggcttcatcatttgttcgtatgcccaatgtagaaccttattctttatcctgaattccttcctcccccttacacctgatttaattgtgcactattgatctggcttagttctggaacttctctcactctcactcaggtgttgccctagactcataggtgctctctctccagccagttttgacctctccatatctttttccattagagcagtagttgtcaaactttttgattaaaactgagaggccaggtgccgtggctcatgcctgtaataccaacagtttgagaagcccaggtggtaggatcacttgagcccaggaccagcttggacaacatagtgagaccttgcctctaccaaaaagtaaaaaaattagccaggggtggtgacatgtgcctgtggttccagctatgtgggaggctgaggtgaaagcattgcttcagcccaggagttggaggctggattgagtcgtgattatgtcatgacactctagcctggattacagagcaagacactgtcccagaaaacaaaacaaaacaaaatctgagaaattacttattccctaatttatgatttggttattaacttatttaaaatgaaaaataaacccatgtaaagttagtatacatagctttttaatgaaaatcgctttttttttttcccaaaacaacaacataaaatgtagtcggaagagtggccatcgttcacttatgtgttgcagacctccttaatgtctgcctggatggaagagtttctcatccagtgcatacatgcatgaatcattgcagccaggtctcaaccctgtcagacaacactctctttttgtagtaagtctttggtaatgcttcttttattcttaagaaatgtattcatctcagaattcaaatgaaagtaacatactaacatgataatagttcagtgtgtcagtgttgtctcagctacactaggatcacatgctcactaggtcaggtgcactgagaatgcagtggctgcaaatgcacacggtagaggtacattacttggtgattcaaatatcaagaagggcattagatgtaatgacatgttctctaaaactgtgagcaacttttggtaaaatacaaaacagtcttttgatttatgtggtaattatattcctagcaaattgaatgtgtagtgaaacttggaaaaagtcttttgtgattctgtgtgaaatggaatttggttttaggttccgataattatacatggggttttcccctacattactatctagagaaacattcaaaagtcgtatgggacaattcctcatatgggactgttctgcacaacctgttaaataaatgccagtggtgcctcccagcgaatgagaccaccaaaaataccccacggattttcacacatccattagggaatggtacatacctattaagaacactgataagtggaatcttggctgtattttttttcttgttttttgtttgtttgtttgttttgagacagagtttcaatcttgtcacccaggctggattgcagtggtgatcttgactcaccgcaacccccgcctcccggattcaagtgattcttctgcctcagcctccggagtagctgggattacaggcgccggccaccacgcccgactaattttgtatttttagtagacacgggtttcaccgcgttggtcaggctggtcttgacctcctgacctcagtgctgggattacaggtgtgagccgctgtgcccggcctgttttgtttttttaagttggatgataatttaaaaaataacttacaatacagcctgaccaacatggtgaaaccccatctctactaaaaatacaaaaattagcaggcatggtggcgcacgcctgtaatccgagctactcaggaggctgaggcaggagaattgcttgagtgaggttgcagtgagctgagattgcgccattgcactccagtctgggcgacaaagcgagactccgtctcaaataaataaataaataaataaataacttacaataataattacttgaatctcaccgttaatcagtgttaatattttgttgtatatccatcttgtccttttttgtacatttgtagtttttttccattcaaaaatgggatcatttaaaaatttaaaaagagtcgatgtcttggctgggcacagtgactcaacgcctgtaattcccagcactttgggaggccgaggtgggcagatcacctgaggttgggagttcaagaccagcctgaccaacatggagaaactccgtctctactaaaaatacaaaattagccagcgtggtggtgcatgcctgtaatcccagctactcgggaggctgaggcaggagaatcgcttgaacctgggagacggaggttacggtgagctgggcaacaagagcgaaactctgtctaaaaaaaaaaaaagaattgatgtcttgatgctacttaattttatctaattcacgtgtttttaaaaatcataacaaaatcagttttattcttcattctatcatacaattagtacaatctcaggtaagatgcaaacaatgtatactcataagtctctttttaacatgaaaactggtgctacctagggaagtacaaatgaaaccacaatgaggtaccacctccaacatgttaggatggccattataaaaaaagactgaaataataagaattggccaggatatgaagaaaagggaacgcttgtacactgttggtgggaatgtaaattgatatgaagcagttatggaaaacaatatggaaattcctcagaacattaaaaatagaactactgtatgacccagcaatccctatacccaaaggaaatgaaatcagcatcttgggaagatatctgcactcccatgttccttgtggcattattcccaatagacaagatatggaaacgattttttttttttttttgagacggagtctccttctgtcgccaggctggagtgcggtggcgcaaactcggctcactgcaacctccgcctcccgggttcaagcaatttttctgcctcaggcacccgagtagctgggactacaggtgcgtgccaccacgccctgctaatttttgtatttttcgtagagatagggtttcaccatgttggccaggatggtctcgatctcttgacctcgtgatccacctgcctcggcctccaaagtggtaggattacgggcgggaggcaccacgcctggcggaaacgatttaataagtgtctgttgccagacaaaaaaaataaattggggcatatacatccagtggaatagccattaaaaaggtgatcctgtcatttgtgacaacatagatgaacctggagagcatgctgctaagtgaaataaactagaaaaagaaaagaaaaatattgcaagatctcacttatatgtggaatctgaaataaagctgaatatgtaagaatagagtggctgagtggttatcgggggaaggggaagtgggagatgtaggtcaaagttgcagttacataggatgaataaaactagagatctaatatttagcatgatgactctggctaatattgtattggaaaatttgctgagagtagatttcaggtactcttaacacacacacgtagctatgtgaggagatggatgtattacttctgactgtagtagccatttcactgtgtatatgtataacaaaacatcgtgtcatgtaccttaaattatacaataaacaaagaagaggtgccggtttgaaggggcgaggacagagcgtggacttgcggaaagttaggtggccttggtgatttaatctctcaaaccttcggttttcttatctgtaacacgtattagagaaactgtgtcttgtcggaacctacccctcagtgggggtaatcccagctgtttgtcctcagctcatttctaactgaactgcaggcttctcaagagcagccaggatgtcaccttttcatcacctagcaccagctcaggacctggctcattaatttattgaacaaatgaatgtggcagaaaatttgctattggtgttggactgtgtttaaactttgtttcatgtttatcatggttaaacctccatcagaggtaaacaactatgttaattattacatcaaacttctgtacatcttgccccaaatgggatcatttatttgttcaggataaaatgtttttgaagtttttagcacacctgatagttgtatttcttctagattgggcttggatattgttattactcaggaatctggttgaatgtttgattgtataactctgcctttgacatatgtaattaaatgagtttgtatttaatgtgttccttgaggcagccaggtgtatttacctcagaactgttgaaggcttgccatgtctctaggactcattggtacctttaaggcatctctacaggtatgattttcttttactgtggattctttttttctttcaaaagtttttcagctgttagatatttagcagctcagtctgtttgaatgatttaatgtgttactattgaaaattactttgaaatacaatttgactgttttcaagagagtttggattctgaaggcccacagcgtataggctgaaacagtggttctcaaatctagcatgcattcactggatctgggacaggatccaacagtttgcatttctaacaagttccccattaatgctggtgctgttggtgtggggaccagactttgagaactattgggctaaagtgtggaagacaattaaaaataataatatggaggggaaatggggcccagtgtgtttgggaacaggatccctttgtgctctccacagacaatagagcagtaaagaaaaactggttttggcacctgaaaagaaggaaaatagacataaactttagaaaatactgtttgatagttgcagtggtccttaaaattaagataggagaagagatttggaaataatttaattttaaaaagtttattttaccttttttattataggagtaatgcatgttcataatggaaagtgtcataaatacagaaacatttctattctaaaagagaggaaaaatttccccaaagtatcttctgacatttttggcaatgtccattcagtatctcttttatgtgtaggacttttgtttttgttttgccatgaaataaagtttttattgtcaaaataatatatgctcattataatgaaagaaaaagaaagatcataaaggacactcactctttccagaaacaatactgataacatactgaagtttattatttggtatctcttcatgtgaatatatccatttatgtgaattaccttgaccatatggttttataacctaattttttcagtcactatcttttcatatcattagatgtaattctgaagcatcttttttaggcgcagagtatcttactctgaaaaactttgttgtagctgatgctcttcatccactggcccctcccatttctcatttctctactaggaatttgtaggtcaaagagcatgtaaaaatcttgatatgggccgggcacggtggctcaagcctgtaatcccagcactttgggaggctgagacagggggatcatgaggtcaggagaccgagaccgtcctagccaacacggtgaaaccctgtctctattaaaaaaaaatacaaaaaattagccaggtgcagtggcgggtgcttgtagtcccagctacttgggaggctgaggtgggagaatgacttgaacccgggacggggagcttacagtgagccgaggttgcgccactgcactccagcctgggcgacagagcgagactctgtctcaaaaaataaaaaataaagaataaatcttgatatgtattaccagatacccacaaagggcatagaagtttctgttctcactagtagctgtgtgcctgtacccagaccccaagtctatgctcattgccggtttaataattgccagcctgataggtgaaaatagtatcttttcattcacttcttttactgataagaagcttaacacttttcttcatgtgtcagttggtcgtttaaatttcttttgaatttctgctcttgtccttgtcacattttcttttggggttaatcttttttcttgatttatatgaactcttcatacttagggacattaattccttacatcatatgcttcagatatttgtttccaaaatttcatttgcttttaaaactaacttgtggaattttttttctttcatagaagtgttttaagtgtttcatagaagtgccatccactatgattttccttttttttgtttttttttttgtttgacatggagttttgctgttgttgcccaggctggagtgcagtggcacgatctcggctcactgcaacctctgcctcctgggttcaagcgattcctgctaatttttgtatttttagtagaaacggggtttcaccacgttggtcaggctggtttcaaactcctgaccttaggtgatccctccgcttcggcctcccagagtgctaggattacacgcatgagccattgcgcctgtcctgattttccatttttaaggatttctgctcatggtgtcaaatgagaacatcccctgtcacttcaagattttacgaatattaacctgcattttcttctacaacactttctcttttttaaaaaacgtttttaaaggtggagttttgctaagttgcccaggctggtcttcaactcctgggctcaagcaaacctcccacctcagcctttcaaagcgctgggattataggcatgagccaccgtgcccagcctctgccacacttccatgatttcatttgttcactagggtcttcaaactgtctgtagtttgttttgatgcaagcaaatacatttattttagtgtggccaaatgtaatttacatttttaaatattgaattattttggttgcactgtgcaaacattaggcaaatttaggtataaagttggaaaaagccactaagtgtcacactgttctgaggagcactgggaattctgagaaggcttaaagagtttgccatggttttctgtccttgtgatagtttgttcggaatgatggtttccagcttcatccatgcccctacaaaggatgtgaactcatccttttctatggctgcatagtatttcatggtgtatatgtgccacattttcgacagaaaaccaaacactgcatgttctcactcataggtgggaattgaacaatgagaacacttggacacagggtggggaacatcacacaccgggacctgtcgtgaggtgcggggaggggggagggatagcattaggagataaacctaatgtaaatgacaaattaatgggtgcagcacaccaacatggcacatgtatacatatgtaacaaaacctgcacgttgtgcacatgtaccctagaacttaaagtataattaaaaaaaaagagtttgccatggaagtggaggtcaggagaggggagaactgagcaagtatgtgggtatttccagctcctacttctcccaagaactgcaggcttagatgggcagctgtctagtaggcagatcttcttgggcatctaataataagctgttcaaaattaacatagccaaagcagaattcttttttttttttttttaagacagagtctcacttatcacctaggctggagtgcagtggcatgatctcggctcactgcaagcctcgcctccctggttcaagggattttcttgcctcaacctcccgagtacctgggattacagttgtgtgccaccatgtccagctaatttttatatttttagtagagacagggtttcgccctgttggccaggctggtcccaaacatctggcatcaagtgatccacccgcctaggcctcccaaagtgctgggattacagacttgagccaccgcacccagcccaaaacggaattcttgatgctgtccccaccctaatgcgcacaccccagtcctttctcgtcttagtaaatagcgctgtcaaacacccatttaggcaggccagaaacttcaaaggtgtctttgattccgctcttccaccactttatatctactccatcatgaagtcttgtagactttctgtccagaatatatcctgagtctgaccactcctaatcatttccactgttaaaacattaggccaccactgtctctcatgtgggtgttattgtggtcttctggacgttgtcttggttccactttgtctctccctgtaatctgtttcacatagtagcttctacagtgtaaataagatcatattattcccttgattaaaacctttcaaagacttcccattacatttaaaataaaatccaagccttactataaaagatccacttgtctggcctctgtgcttctccagtttcttccttctgcactccccttgtctgctttgcggtagcctaacatgtctctttctatctcttgaacaggttcttttctttcgttgggtctttatacaggctgaacctcctctagaactaactagaagctacctctgatgtcttctcagagagactttccttgactatccccaggcacatgaagaagccccacacaccccctctagtcaccatctatcttgttaaccttacttattttcttaaagtggggttctgtatgtaaaatgatcttctttatttgtttactggtttattagctgtcttcctattcgagaatgtaagctcccagaggacactctgttttgttcacttctgaatccctagcacttagccccgtgcttggcccatgacatttgtggtaagtactaggtgaccatttttggaactgttcccaccccacggcctgcattcacactttaatcacagcagctcagcttttatatcgtgagcttcagtgggaggttttgtttacagaaagttttcttggttgacaaaagcctgaagatgattttcttggaagatgaggatttattctaaggatatgtgaggaagcaaagtttttgttgttgttgttgttttggaggggtggtgggggatccgagtctcgctttgtcatccaggctggagtgtagtggcgcaatcatggctcactgcaacctctgcctcccgggtttaagcgattctcctgcctcagccacctgagtagctgggattacaggcatgcgccaccacgcccagctaatttttgtatttttagtagagacagggtttcacggaagcagagattttctgtcagtgttccatctacttcataatgtattgttgatatggttcttgattttttaacctgaaggcataagcatgaaaatagcataatgatttttcacagttcctgtccaagagtactttttctttacatgttgaattacctaccatagattgttttatcctataattagaaagattatgagattacatcatcttatatttacccttaaagagtgtttcccgaatcataagccaaagcctttgtataaccttattatgtaaatatttatgtttcaggtgtgttattccctttgtgtgtgtgtgtatctatatacatatatatgcatagtatttgtgttctcttattcctatgacattgtaaacgttctagttgatgatgtctgtgcttccattgcaactcttcactgcatgggtactctgatgtgtatggcttgctgctccccagatattcgttgactttgtgacatctgtcctaggacaatttcactattttagtttttggctactcagttaattagaaatgcatctcagttgtattttaagttattgctttctacattttaatcagtaaatacaaagagattgcctttagtttttgttatgtgtattttcaggttatgttactgggagtacaaagttttacaattgttgctttctttgtggattataggttttaggaaaataaaatttatcgtattgacagtttttgccttgaaaggcttattaaatttagcagtcctcccttttttgtgtgttttttgatccttatcctttttttttttttttttttttttgagacggagtctcgctctgtcacacaggctggagtgcagtggcagagctcactgcaagctccgcctcccaggttcatgccattctcctgcctcagcctcccaagtagctgggactacaggtgcccgcccccacatccagctaatttttttgtatttttagtagagacgaggtttcaccgtgttagccaggatggtcttgatctcctgacctcgtgatccgcctgtctggtcctcccaaagtgctgggattacaggcgtgagacaccgcgcccagcccatccttttgtttttaatctgtcattttattttaggtgcatttctagttcgcttggcctgctgtctttttcataacactttattcctatgtaatagatataatgttcttttgcattttattgtttctaaagcaaatatcttctaattaagaaaaataacttctagttaatttatttcaaggggaagcagtgggggttttattcctctggatgtttgttgtcttgtgtcctgtggaatattttctttctgtttttgttcttttctttctctaactcaggacagtgctgaggaatgttttcattggtgccgtattttctttttctttcttttcttttttcttttttttttttttgagacagggtctctgtctgttgcccaagctggaatgcaatggcgcaatctcggctcactgcaacttctgcctgctgggttcaagcgattctcatgcctcagcctctcgagtagctggcattacaggcatgcaccaccacacccggctaatttttgtgtttttatagagaaagggtttcgccatgttggccaggctggtcttgaactcctgacctcaagtgatccacccacctcagcctcccaaagtgctgggattgcaggcgtgagccgatgtgcgtggcctggtgccatactttctgcatttttctttaaggaaggttccaaatgtctgaagtccaccaaatgtctgaagtcctgcccagacttttggagagaaaacacagcaaagcaatcagtaggttaatgactgcatggtttctggaccaaattatcctcatctaccacttagaacattaagttgtaaaccagagtcagcacagccagggtggagattacttatttgtatcccttgctcgtaggttatttaatattctctgttgtgtcaaagtttagtcgggtatattaattagtcagcttttgctaaattatgttgtggtaacaatctccaaatctcagtagtttacgacaacaaaactttgtttctcagtttaaggctctttgtgggcttcatgccatggtagaacctcaaaagtggcatgtgccatttcaactcatacttcattggccaaaagcaagtcacgtggtcatgcagggcctcagtaagcaagaaatatttacccgcccggggatggacaggtaggaaagggtctgttaaggaagggcagcaaatatttggataacagtactatgtgtttgtatggagcgatatttaagaaggtttcctaggttttttgaggggtattgaagctgagaggttgggggcaggcaggaagctctgcagcctgtagcctatggtatcaagcttcatgagaacgagaattaactagttacatctttattaccatttttggcatctctgcagacagtggatctaatgcatgatagctgattaataaatgtttgttgaattaatgaacaaaatagcaagaaagtaacgtattctgaggcaggagaattgcttgaaccaggaggcagaggttgcagtgagctgacatcatgccattgcactccagcctgggcgacagagtgagactccgtctcaaaaaacaaaagaaagtaaacagattattttcatgctatttgatgcctccgcttagtttggaaccagtttttattttattttattttattttattttattttattttattttttgttttgtttttgttttcgtgttttttgagacggagtctcgctctgtcgcccaggctggagtgcagtggcgagatctgggttcattgcaagctccgcctcccgggttcacgtcattctcctgcctcagcctcctgagtagctgggactacaggcgcccaccactatgcccggctaatttttttgtatttttagtagaggggtttcaccgtgttaaccagggtggtcttgatctcctgacctcgtgatccacccgtctcggcctcccaaagtgctgggattacaggcatgaaccaccgcgcctggccttggaaccagttttatagagcagttcctacaatagctccttttatatttaaaatgaaaagtgctttcttgggggtcattttgccataccaaaagattatgtgcttaaaaaaaaaactacatactaattacagaaaaaattttaaatatgcattaaatacaagcaagtagaggttgtgttctatttggctactcaggacaactattggtgttttgttatatatcctcctatataattcctttctttcttttcttttttttttttttgagatggagtttcactcttgttgcccaggctggagtgcaatggcgcaatctcagctcaccgcaacctctgcctcccaggttcaagcgattctcgcttctcagcctccctagtagctgggattacaggcatgcgccaccacgcccggctaattttgtatttttggtagaggcggggtttctccatgttggtcaggctggtctcgaactcccgacctcaggtgatccacccgcctcggcctcccaaagtgcaggggttacaggcatgagccacatagtgcccagcctctttcttttcttttctttctttttttgagatggagcctctctctgttgcccaggctggaagaatacagtggcaccatcttggctcactgtaacctctgcttcccgggtacaagtgatgcttgtgtgtcagcctcccagtagctggcactacaggtgtgcaccaccacacccagctaatttttgtatttttagtagagacggggtttcatcacattggccaggctgatctcctgacctcaggtgatccactcacctcggctgcccaaagtgctgggattgcaggcttgagcccttttttttttccccatatggcttctgaacattgtttatatttattgtcacactaggatcacttagttttgtacttttagtagtatctattgctttatttgttatgttgccaatcggcagttgtaaaggtcgtagatgaaatagacaagtatttataagattaattttatcttacccttgttctctttttctcttcttgaatttcctccttcaaatatatgaactatttacttaaccaaacactctctttctcttccctctcaccatggcaagagtgaaagggaccagaatgatgaaaggtagacagttggcctgaggaaataaggtgccttggcgattctcagactggataatcagctcctggggaatcaggcgctgacttttttttttttcctcctgcttttactcagagatcatcttttcatattttgggatttgtgcagtcatttcaatgatctaaaagtgaagagcttgataataagttgattttagtcctactgtctttttgtgacggatgtgctagataagcttaatgtgagtcattcaagaaccaagcccctgtttgaacctgtccattgagggccctgtttatcagaggttgaagcattttttagctagcagctgatcttgggtaagcaagccattgtacaagttccccatgcctagttgttttgcatcattaatcatcttttcttcaagccatggaaacatggctgagtcttgagtcatctggctcttcccagtgctggaaatccaccctgctgaggtgaatgtgtgaaatattttttgttctcggtagagatctgagaactggtttgtctcctgcaatgaacagattgaattccttataaatatgttactaaaaggtaccttttgtgtccattttacagatatctgacatgattatttattaaactcctttaaataactcctgtgcttaatgcagtttccaaatatttgaaatactaaatgtagatttagggaactcagtgaccagttttcatttgcattttgatgaatttctctattttaatatttgtagttgctatccattttagaaatatccactctgccaagtaggttgggaatgtgtgcaagaatgacagcttaaataatgtgcttgtttgctattggagccgatgcccctaagtaaagctaccagataaagagaggaaagggggaaaaaaggaggagaatgaagccaccgtgtaacatctgttagagactcaatgtgagccctgtgagttagtcttcatttcccatgctatgttttatttttatttttcctgttccattaaagcatttcggttaattctgtataagtagaatgctgataactccttagagaaatgtgattcagtaataaccttgtttccatgtgactacttatctaatctgccatgcatctgctttaaggaaggtgtccattagggtcaactcacaggtcagacattaatcttaattgtcaaatgtctcaactcattgctagagactaaattgatcttgatggcactcatctgagtaccgattcacactaaaagacagtcaaggggttgttttcctttgtgtgttgtaattcttagcaggatcctaaaaatgaaagttttaaaatgtggaatagcatgattaatgaggacatttattaaggttaaggcagtttaaaagttcagtttaatctaaggttagcttgtaggaactgatataagagatagttaaaaatttgttaagctttacttaaaacctgtatttgggggtagaaacagttttcctagggtacttataatttcctttaattatctcagaaagagggtctcttattaggatgagggaaaaaaatgacccgtcattcttttaaatcaggtttaatttattcctgatatttatatgattcttatatgtcatgtaattcttatgacatataagagagaaaacattaatctagagtaggtaatttcctagttcagcttcttccacttgtgtgaactacagaagaactgaagagtaattgtaattgttttataactttaaagaatttaagagattaaattgctgtccttgtgaattctttgttaagtaactctcaaagaaatagtcaagttaaaggggatttactttctaaaactagctttcttttctttctgtctaaccttttattatgaaaaatttcaacatctacaaaagaaaggagagtagtatcattacccagctacagtcactgttaactctcagctaatcttgtctccatcctgccaccctccactccagattattttgaagcaaattctagacatcacttccttttattaaagcaagttgcgtttcatagtgacaatagaaaccatttactcttggcacaggtgctaaggtctgaatacaactttaaggagacagtgtctgcattgaagagcttatgttttaagaaaggagtttatgttttcactggatatactcggcgttcagggaatcagagactttcttcaagtttcccttgtcttttaaatagggacgtatttgcaagttcttatctgtttggaaattcctgtagcaagttcaggtttagtcattctgtactgctttggtggtgccttatctaaatagtattgaaaggaagaaagaattatttcaccaagagttggccttgaaaggagttagatgtattgggtatatttaggaagtaccccttcaacgctgtaataatataccaacttttaaagctacctcataatagctcttaaaaacacatttaaaacacttagaggtgatcctttttcctagccatcagtgggacaaattaattcctttttgagtaaaaaaaaaaaaaaaaaaaaaattctctttttttagtactcaagatcagcaagtattggttgactcattctttgttgttaaacctcttggtttctcaggccagtgtgtctttttgtatactttgaccttgcactttaaactgaattccttttgtcctttgagggaggcataaagctgtcagttcctgttggtgagtgtgggaaattgagttttcactcttctctataatttctgcatttcaagtggttttaataataatcataactatttctcaattttacttcttaaaaaagtagattcatcagactgaattgaatatttgttttccttctaaagctgaagccaattttgccatacttgtttgtgcattcttaagagtttagtacttaagcatagaaaactgtggggttcacatttatattttgctttattacaacttagaaggtaattgatgacttggctctgtggtatgctcaaagtgctggactgagctagttcaagaatgtcattagcagtgaatgggaaatatgtgtctacttttcttcagtagctaaacagaagtaattatatatttacattctacctatttcatagggatgttgttagaattactgtgattagatttttttttttaatttccaaatgtatttaagcttctttacagataggtgccatatcaaagcaaggtgttaatgtcatttttctcaatttgtgtttttgtcactagaaatatatatatattgctttttctcttttcctggtatatttttctgataaatgttttgaaatttgttatcttaagtttttcatagctggaatgctagaaaagcatttatgtcctatttttagtgcaagtgatgagtctggctgggtgggtaagttaatggcaaggtaattgaactgtgctgagtgctcgccgatgtatccttctggcctctccattttcagggtagagttactgtttacagtgacatgtttcacagtctgtgtgaccagccagtgtgaatcagttcgtctattgcctggctttcttgagctcaatttttgtctcatttcccctttccattttatatatcacatttcaagatggatgatctacttgtctaaccactccagggaagattggtgccatctaataaagtcaaaatgaggtcctgcatgttacctggcataaattagagaattatagaatgaatgtgtgaacagatctgagactagagctaggtcacgaaactcctcagtttttttgggttctcattatgtgtttatggatggaattgttctctttatctggtttgggtggttttgtttgtcagtggccaatgtggtggatatttcaacacaatttggacatgcttcctatatattttgcagaatggtctttttcttttggttaactttataactaatagttaaagaattttcaagcctcagctgggtacggtggcccatgcctgtaatcccagcactttgggaggccaaggtgggcagattacctgaggtcaggagttttgagaccagcctggccaaaatggtgaaaccctgtctttactaaaaatacaaaaattagtcaggcctcactccagcctgggtgacagagcgagactctgtctcaaaagaaaaaaaaaaaaattatttgggcttggtgacgtgcacctgtaatctcagctactcgggaggctgtggcacgagaattgcttgaacctgtgaggcagaggttgcagtgagccaagatcgtgccattgcacttcagcctgggcaacaagagcagaactccatcttaaaaaaaaaaaaaaaaaaaaaaaaaaaaaagaattttcaagccacattaggatgcttatcggcatgagttttacataataagacaatctgaaatgtatttgagttttgatgtttctaatctgtagaacttgaaggcctaaggattttgtagttttttagggaacagcattcctctttctctcaggtgatctatgttatgttgacctactcaaacatgttaactttgaaaatgaaccaacgttcaggaacaaatgaaatgacattttcaggacagcattccaaatacatagttagggacagttgttcgtagcttctggagtgtttgaaaatggccctcatatcatacaacttgaattggcattcattgacaatcactttgcttttaaaagatgcttaacaaagagttgtaagtaacatactttgagactgagtaaataaaataaacatgcgaacctttgatgttaagctgagtttgtttgatttttcaggctgaatatacaaagactgtttctaggaaaacttgtgctttgtacagatagaggaacctcctaagaattttgattgtggcttccaaaatagcagatttctagaatatgattacctactttatctaagatttcaaaaagctgctttgtctattttatgatataaagttttcaaaaaatcatcactgttttgtttgccttttttttttttcttgaaaaggcatgtgtttaagcatcagccttattagctggactgttatttcatgtatttctgttagaacgctggataatggacttgaaacttacatggctaatataataccatgaagtttaggaaactaagggctcatttctgttgtattccttggaacgtatgtgggttcaagatcaaaatcattatttcttctttgttttggtatttgtctctttcgggaattaaaatttgttcccaaacattcgtaggactacactgtagcaggaatctgaatagaaaacactccttgtttagttctgagtttatgtggatgaggactaagtgaccattgaaggtggaagggtgatcacagagattactcagaacttaatttattaattctaaaatgcgttcattgaatacacatggtttgtgtgctttttatgggccaaaccatgtaacagaggctgggaatgcagttcttgctctcaggggaatgtagtcttgtctgagaaacagacaatgaacatcagtttccaatagatctagttgtaggcttagagcatgcagagggaacaacagaaaaaatccactgagaccattctggggtccaaataggacccatggcccaagtttagaatggcaagaaagaggaaagacagagggagcttgggcagtgttctgcaaaggataaattcagttctctaagaatagttcactagtccttttttttttctttttttttttgagatggagtttcgctcctgtcacccaggctggagtgcagtggtgcagtggtgcagtggcacgatctcggtgcactgcaccctctgcctcccaggttcaagcaattctcctgtcttagcctcctgagtcactggaattacaagcacgcccggctaattttggtatttttagtagagatggggtttcaccgtcttggctaggctggtcttgaacacctgacctcaggtgatccacccacctcggcctcccaaagtgctgggattacaggcatgagccattgtgcctggcctggtcacttgctcatagttattaatctgaagaagttctacagtaaatcaaatgttcaggattgcctaatgttgacttactgatttagaatatcattctcttggtatgcttctataaactaccagtgctcaatttttcttttcaattttgaacttgttgatggacagtgtctacagtctcttgacagttatgtaatttgtgtctatttaggtttaagctgtcaccttcccaaatgcggcatctgtgtagccccagagggagcattctaaaaggtaaatctgagcctggcgcagtggcccaggcctgtaatcccagcactttttgggagctgaggtgggaggatcacttgagtccaggagttttagaccagcctggtagcaagaccctgtctctacaaaaaataacaataaataaaattaacaggcacagtgatgtatacctctagtcctagctaccgtagaggctaacatgggaggattgcttgcactcaggagttcgaggctacagtgagctatgatcgcaccactgtactccagcctggtagcaagggcctatctctaaagaataaaaaatagactaggcatggtggctcatgcctgtaatgctagcactcggggaggctgaggccggtggatcacctgaggtcaggagttcaagaccaacctggccaacatagtgaaaccctgtctctactgaaaatacaaaagttagccgggcatggtggcgcacgcctgtaatcccagctactcaggaggctgaggcaggagaatcgcttgaaatcgggaggtggaggttgcagtgagctgagattgcaccactgcattccagcatgggcgacagaccaagactctgtctcaaaaaaaaaaaaaaataattaaaaaaaaaaataaggccgggtgcagtggctcacacttgtaatcctagcactttgggaggccaaggcaggcgaatcacttgaggtcaggagtttgagaccagcctggccaacatagtgaaacctcatctctaccaaaaatactagcctggcgtggtggtgcatgcctgtagtcccagctattcaggaggctgaggcaggagaattgcttgaacctgggaggtggaggttgtagtgagccaagatcacacttctgcattccagcctgggtgatagagcaagactctgtctcaaaaagaattaaaaataaatgaacaaaaataagccaggcgtggcccggtgcagtggctcaccctgtaatcccagcactttgggaggctgaggcaggaggatcacgaggtcaggagatcgagaccatcctggctaacatggtgaaaccccgtctctactaaaaaatagaaaaaagtagccggtcatggtggcgggtgcctgtagtcccagctactcgagaggctgaggcaggagaatggcgtgaacccgggaggcagagcttgcagtgagccaagatcgcaccactgcactccagcctgggcaacagagcgagactccgtttcaaaaaaaaaaaattagccaggcatggtggtggatgcctgtaatcttagctactggggaagttgaggcaggagaatgacttgcactggggaggtggaggttgcagtgagctgagattgcaccattgcactccagcctgggcaacagagcaaggctctgcctcagaaaaaaaaaagtgtatatatatatatacatatatatatatatatatatatatgtatatatatatatatatatatatgtaaaagttaaaaaaaaaaaaaaaaagacccatttctgccgaaaatctttcagtgactccatcaccccaatgggccatgggcaagtcctgtttccactctcacatccttgcctttgggattgttttcattcctgctgagtatttaccctcacctggaaagcagctgtgtgaacttctcttcatccttcgtaggctggtggcctttcttccatgctcagttaatcagtttctcttctctgcttcctttgttctttggcctgctctgcggtgttgtatgaaacacactgtgccagaattgtttgtttactttctgttcctgttctaaatatgagctctttgaggcaggacctgtgtctttctttggacctttacgtttgtcgcagtaactgtcatataataaacagtcaatacttgatttaagctgagcaatgtaacacttaaacattaattttgttacatttactggattataatggtgactgaaaaaaacatttttaagttttttactccacctgggacaattctaactaagtgttttacttatgttaaaactcatttaattatctttgttaaagaattactctgatgcttgttaaaatagttaggaagactttattcaagactattgcaatggcggggagagatccagctcaattctgaatccagcaaggacaaatagagaattacagtcaagtagcagaatatggtcagtgaatggtaaattgctaagtggagacatcaaggtcagtagatcttataaaactggcttagtctgcttgggctactgtaacaaactactatagactagatgccttaagcaatcgaaatttatttcttatagttctggaggctaagtctcagatcaagatgccgacagatttagttcctggtgagggccctctttgtggtgtgcagacagtcaccttcctgctggcagaaggagagatcatctctctgatgtctgttcttataagggtaccaatcccattcatgaaggctccactctcatgattttaattacctcccaaaggctcgctttccaaataccatgaccttggggataagtgcttcagtgtatgtattttgagaggacacatttggtccatggcactgacctaacaagattgttgccgaaggcaggcctagaatgtatacatcaaaggtgggggtgaggaatttgatcaaatatcaaaggtgatcagatatctcagatgggggtgattctcactaaactgacttagcaggattgtttgtaaaactgagttaggtaggctgaagacaggaggggactggaggaggttgcggcttcgttgaggagggctcagagaagcctgagtttggtcaaggagagggtctttgtcactgttaggagccttttaacttaggtgctaattatactagcattttatagacaaagaatctgaagcttagaaagaggctaagcaactcacgaggtccgtaccagtaagcaccctacctggattctagctggcgtgctttctgttccataactttaaagcattgatcatctggaccctgcctgtgatggctcaatttgcttttgctaacctgctgtgagaatcagtgggagtttgcctctgctttaaaattactcatggtcttgctgcccttagtgctgtcaatcctgtgatttccactggagcaacatactcaggttacaacactgggtaacatttacattttagcagctttcttgaaatttaaaatatatgtgtaagtatctcatttatatgcatttctagtttctttatacaacagaataacttcttttacatcaaatttctgaatttgactaaatttagaaataatggaatctcatccattaaatatagtcatagaaggaaggaaatatgaaaattaggatttcagatgtttgaacataaaagataattttaaacattgtcagtaatctatttctttttttttttcgagacggagttttgctctgtcacccaggctggagtgcagtggcacgatcttggcttactgcaccctctgcctcccagttcaagtgattctcctgcctcaacctcctgagtagctgggattacaggggcatgccaacatgccgggctaatttttgcatgccaccatgccaggctgatttttgtatttgtagtggaaatggggtttcgccatattggccaggctggtcttgaactcctgacctcatgtgatccgcccacctcgcctcccgaagtgctgggattataggcatgagccaccgcgcccagcccagtaaaatctatttctatgaaaagctcttcaaatgtaggtgaacgctgtaagctttatgaatcaactgttttctaaatggtaatacatgaaatctgacaattttttatgtgattttattcaattttctaagaaaagtaaaaaatcagatacatagccgctcttctcttgggactagtcttgataccttttgtatttttatatagtgctttgctcatacccttcttgctgttttttgttttgttttgttttgttttgttttttttggtgggggggtgggggatggagttttactcttattgtccaggctggagtgcaatggtgtgatctcggctcactgcaacctccgcctcccaggttcgagcaattctcctgcctcagccttgcaagtagctgggattataggcatgcgccatcacactttgctaattttggtatttttagtggggacagggtttcactatgttggtcaggctggtcttgaactcctgacctcaggtgatctaccctcctcgacctcccacagtgctgggactacaggcgtgagccactgtacccagccccttcttgctatgttttagcctgcaatgctgttcccacttgtgtctatatagcactcctaatttaaatcatacacactgctattctgcagtgatttcttactctttcagtcagggttggtagcttttttctctgggctttcacagtcctgtggaagggcacagggttatcttatctgatacaatgtgtacgaaaggagtaactgtatcatagtaaaagttttatatataagtgaaaatatttacaacactttatccagcttacaagtttttgatatattttgtttctgtgtcttaaacacaatggacaaatacctcatataaagttttatatttttaattgtcatatatttcattatatggatatatcttttttggagacagagtcttgctcttttgctcaggctggagtgcaatagcacgatcgtagctcactgcagcctccaattcctgggctcaagcgatccttccacctcagcctcccaagtagctggaactacaggcatgtgctcccatacctagctaatgttttggtcttatttttgttacttatttatttatttttaaacactttgttgcttaggctagtgtcaaactcctgggctcaaggaatcctcccaaactttggctacccaaagtgctgggattacagatgtgaaccaccatgcctggctggatgtttcataatttacctaactgttcctatgctattgaacagttaagattatttaagtttttaattgttaaaaataaagtcatggtgaatgcctttggacatatatctttgtattttggattattttcttatggcagatttgcaggagttttgttattgggtaaaatggaaagaacatttttcctttattttttaagagaaagggtctggccaggcgctgtggctcacacctgtaatcccagcactttgggaggccgaggcgggcagatcacctgaggtcaggagttcaaaaccagcctggccaacatggcgaaaccccgtctctactaaaaatacaaaaattagccaggcgtggtggtgggtgcctgtaatcccagcgacttgggaggctgacaggagaattacttgaacctgggaggcggagattgcagtgagccgatatcacaccactgcactccagcctgggagacagagcaagagtgtctcaaaaaaaacaaaaaacaaaaaacagacagggtctttcactcaggctgcaatgcagtggtgcaatcatggttctctgcagcctccaactcctaggctccatcaatcctgcctgagcagttcctaggactgcaggtgcgtgccatcatgcccagctgatttctgtatttgttttttttatttgtagagatgaggtcttaccatctttcccagctggtctcagacttctggcctcaagcagtcctcctgccttggcctcccaaaatgctgggattacaggcgtgagccaccgtgcccggccacttttttctactcttgatatacttacctatgatacgctttccaaaggagttgtaacagtttgccctcccaccagtggtgtgagagagggtctctttgctctaacagtattaatatcagatatctgtattaaacttatttattttgaggccttacctctttccttgtggtaaactttctgaactaggttgacctaaagtaaactggtttagattcccaaataaaattgacaaaaactttataagatccattttaaaagttggagtgtcaaggaaataggaaaagctttgttagagagggaaatgttattcagtgaagtacatattgaatgtgtgaacttttcttcagtaacagttgttatcttttaaaaatcttctccatggtatttggaattttaaagcttaatacctctgctggattttgcaagcgtgaaactaaaacacagtgaaatttgaatgtgcaaacatacataaactggaattgtgaataaattagattataaaccaaacacattttgagtataagtgggcctttagaaagttttttatattatgggtagaaggtgaacctttctaaagaaaataagaaattgaggaaatctaggattttcttctttttattttggatctcagtgtgtttgtgatttttaacagaaacgttcttttctgtactttaatggtgcagccagatccatgtaaagaaaaggagtgaaatccccaggaaagatgaccagcagcaggattcttttcagcttttctccctttcctcaggcttgaatatatttcagtgcacctcaatcaagtgaagtgagattaaatatttgagtcatctgtctgttgccttctaaaatggtctggctttctgttggctgcagtctatttagtgttttagtgatgctaatgttattgaatggtttttagttctaaaacttctagtagtgataaatcttgtgcatagaagtcccctaggtcacttagcagagcgcagttggtttttgttaatgactgcattgtcctttgctctcattcgtgatacccagtgacttttcattgatgttgcagtaaggctttttttttgttgttggacttctcccattctttacacattggtaaataatcttcagctgtagcaggaggtagccagcatctatgtgtggatcagatttatcaatatgtacctgtgcagattgcctttatctcctgattgggcaaatacttaacagtccttagcagtctctccattgagttttccaccaactctaactggcaaaaggactcagttgtattggacaggaaaatcttattgtctttgctgtccattgtggcactaaagctgtgaagatgtcatacatgtgaagtattcactggattctcagttacttactcgttatcaaggcttacatgtagccaatttaattttgatgaatatgtttaaatgtagggcattttataattactggctcatggttttttatacagtatgtgcatatttcatttcttttactaccgtctttcagcccatatttaattcatccatttgcagctgttgcactgttttgttgaaactggcttaaaaatctggcaggaggcttccctactttcttgcccttttcggtgttatggtgttattttacacagttagtactttctatgtagtttcttctttcctaaagctgaagggccatatctctcaaacttttctctgcttacctttaaccactgttcgtgccgatgagctgataataccaggcttggttgctggctgtatttagaggtatacaatttaaatacccagagataaaggtgacagtagtaaattagtgcactgtattgtcttaagactaagtgtgatttcagttcttatgctacaacatggaagtttattttaatgttttcctttatgtatgggctttgcaatggttgaaacttgagtttttatttggaagttttggaagacaacttttagattgtctcttttttttttttttgagacggattctcactctgtcgcccaagttggagtgcagaggcgtgatctcggctcactgcaacctctagctcccgagttgaagcgattctcctgcctcagcctcccgaggcatacacgaccacacctggctaatttttttttttttttttttgtatttttagtagagatgggctttcaccatattggcccggctggtctcaaactcctaacctcaggtgatctgcctgcctcggtttcccaaagcactgagattacaggtgtgagccactgtgcctagcctagattatctcttctttagtgactgtatatatctacattacacagatgacaacattttgttttcctgtaacctaggccattacatttttttttcatgtgacaaagtgtttgcaattatttgtgaaattttaattttttcatcacttattaatttatatttgagaggactggaaagtatgtgagttgaaaatagtttaaacttatacaatctcattattaatttggctgttaatttgaatctattccataacttatatttaaaataaaattttgatttgaaaggctcttatctcaatcagtggttcttaaaattattgtttgctgtttagagttatattttttttccaggaagtacttttttagctttcaggaacttgatataatgttttattcttgatgacccactggaaaatagaaccttctagaagaaataaagtcactttattgaagctttatgaatggctctcctatctgcatctgtagggctctacaatctgatttttccaaacaaatagacaaactatggataataacttttcagatgttactttgcagttagttggtggtctggaagaagaaaaaagagcttcaaagaggggactgttaattccatttatctcttgaacaggaattgctttcctgtctttcattgctgtcccttatttttcacctttatgttgtagctaggttttggttttattagctccctgatgaattctctcttcctgccaatattaaagtaaggatgatttagaagaactgaggttaaaatctgcctattgaagctctccaggctagataccctgacatttctctttgtggaaagtaagcaggagtaaagggacaaatcgtccgaaatgccattgagtgttgccaagtgatgtgctgacagctgtacctgacagtgattgctggaccctggtcattcctgagtgtctccttttcacctcccatcccctgctgccactcccccctaacaacaacagaaattctgggaggaatgcctgttccctatttagaggacaacttgagtgatcatgatagtttgtcagatataatgtggacaatgacctttttcagttttagtaataagattcttctttttatcaggttctttatcctttatgcagttttaaaatattacttatgaacaagctgcatatcccttttaggtcatcttgttcttctacttcaaatagcacatgtagaagccacatttgaggctcagggcttcagacatgacaatagggcattgatcaggttggctatatgtttgggatttgtcagttcctttgtccattttttgtctcgctttcagtaccttttctctgtgttttaaaagggctttgtgtacctcttgcctttatgtgtaatcttacagggcagctttcttctttttcattcatttcctgctctaagagtcatctcaagataggaatctggtataagactcacttatagaacagggacataggctcttccagttgttttcattcattgcagattattttaaataagagaaaggtttccttgtatttttctttaatgttttccaattttgaattgttatagatgcaaagcctttaaaaggataatatgtggaggcagtatttgtttggggtatcttttaattgtttttctagatcaaggacagatatagatagattaatacctgaaacgaaaccctaacaactctcaaatatcagataatttttttttatgtttctgaggatgtttttatatcctttgagatatttaaaatatacacatttttatgtttctcccacatttggacatttctttcccctcaatgtttcattgatgccacatttctaccaattttaatcttgtattctatatcttactatcctatagtttcttcaagctgaaattagaccttttgagcaactttaaaacaaatttttaaaaatatttatttataaaagatcaattacacttattaccttagtaccataataaaaatctgtttcaaataaatgagtctgaagatgggaagggacaccattcagtgggtttagaaatagacctgttaaaatacaagtccagctggctgggcacggtgcctcatgcactttgggaggctgaggcgggcagattgcttgtgctcaggagttcaggaccaggctgggcaacatggtgaaaccctgtctctacaaaaatacaaaaattagccaggtgtggtggtacacacctatagtcccagctacttgggagactgaggtaggaggatggcttaagccctggatgtggaggttgtggtgaactgagattgtgccactgctttccagcctgggtgacagagccaggtcctatctcaaaaaattatagaataaataaataagcaagcccaaaggcaatttcattttattttatttagagacagtgtctgactgccgcccaggctgcagtgccagtggtgccatcatagctcactacaacctcgaactcctgggacaaaagcattttttcctgcctcagcctccccaagtagctgggattgtaggcatgtaccacacacccaatttttaagtttgttttttgtagagacagcatcttgctatgttgcccaggctggtcttgaattcctggcctcaagagatcctcctgcctcagcttcccaaagtgctaggagtatcggtgtgagccacctgccctgcttgaattgttttttttttgttgttgttttgtttttttttggagacggagtcttgttctctgttgcccaggctggagtgcagtggcacgatctcagctcactgcaacctaaacctccttgggttcaagcaattctcctgcctcagcctcccgagtagctgggattgcaggtgcccaccaccatgcctggcttatttttgtatttttagtagagatggcattttgccatgttggccaggctggtctcgaactcctaacctcaggtgatccacctgcctcggcttcccaaagtgctgggattacaggtgtgagccaccgcacttggccctgaattgtttaaatatgaagatgaagaggtctctgctgtccttactcctctggcctctaataccttctagccatcttgccttactttggaagggagggagacagatgtagttgttcacagttgagagctgctgaaacactgtgactttatggacagtagtagggagaaagcaagcctaatccgtttataaatgttccattatatacaaaataccctttctaccaacagtaggttcttaattactgacaccaggcatgctttggttgtgactccagcagcgcgggttggtggcatcttacactgaacagcctgggcctccactctccccttctgtaaattttgcctgtcactaattgtttgggcccagtttcttcatttatataagaggattataagatttttgtgaggggatggtcaataattaagtgaaaaacagatgatgtatgttcataatcaccttttagtctctaggtcattaagcctagattagcctattttggtgtattagaaatttgctgattatctggactatgtattagtagtacatgtagaagatttcttttttctgtgtgtgtgtgtgtgtgtgtgtgtgtgtgtgtgtgtgttttcttatagatgtggtctcactctgtttcccaggctgaagtgcagtggtgcaatctcagctcatgcaatgccaccaatccatgttgctggagtcacaaccaaagcatgcctggtctcagtagttaagaacctactgttggtagaaagggtattttgtatataatggaacatttataaatggattaggcttgcttaggcctgggttcaagcaatccttccgccctagactcctaagtaattggaactataggcacatgccaccacgcccagctagtttttgtgtattttttgtagagacggggttttgccacgtcacccagaacagccttgaactcctgtgactgttgtgggaaattgatctagactcaagtgatctccctgcttcggcctccaaaagtgctgggattacaggtgtgagccactgtgcctggcctgtaaatatgtttgaattacctcatttcatcttgcatgcttgttatttttaacatgccttttctccctttaatttttaaaaaatttggctgggcatggtgacgcacgcctgtaatcccagcactttgagaggcataggtgggtggatcacttgaagccaggagtttgagaccaacctggccaacatggtgaaaccctgtgtctgttaaaaaaaaaaaaaaattagccaagtgtggtggcacgcacctgtaatcccagctatttgggaggctgaggcaggagaatcacttgaacccaggaggcggaggctgcagtgagcagagattgtgccactgcactccagcctgagtaacagagcgagactccatctcaaaaaaaaaaaggccggaatcctagcactttgggaggctgaggtgggcggattgcctgagctcaggagttccagaccagcctggtcaacatgatgaaaccccgtctctactaaaaatagaaaaattagctgggcgtggtggtgggtgcctataatcccagctactggagaggctgaggcaggagaagtgcttgaacctggagggcggatgttgcaatgagccaagattgcaccacttcactccagcctgggcgaaagagcgaaactctctctcaaaaaacaaaaaaacaaacaaaaaaatttttttttttttttttttttttttttttttttttttttttagacggagtcttgctccgttgctcaggctggagtgcagtggcactatctcaggtcactgcagcctccgcctcccaggttcaagcgattcccctgcactcagcctcctaagtagctgggattacaggtgctcaccaccacacccagctaatttttatatttttagtagagatggggttttgccatgttggccaggctggtctcgaacacctgacctcaggcgatctgcccacctcggactcccaaagtgctgggtttacaggcgtgagccaccgcacctggccaaaaaaatttgaaaattttcaaacattcaggaaagttgaaagaacagcacaatgacatacttgttttaaaagaccaattacagtttaattatttgatataaagttaagttttaaattatgccagtaattaatactttagacattttattccacatggttaaattttacctttttaactattcaacttagtatttatgtgctagaacctaaaatccctaattgtttatgttttgttttgatttttattttttggaattgttgcatattttctgaataatcttcccatgtttatgatagcaaaacattggaactgaaataacaaatctgtttcaatatacttttttatcatgcaaaatgacattttaataaatattgttttagccaggcacggtggctcacgcctgtaatcctagcactttgggaggctgaggcgggcagatcacctgaggtcaggagttcaggaccagcctggccaacatggtgaaaccctgtctctaccaaagtacaaaaattagccgggcatgatggccggtgcctgtaattccagctactcgggaggctgagatggaaaaatcgcttgaacttgggagatggtggttgcagtgattgcagtgagccgagatcgcaccactgcactccagcctgggtggctgagcgagactctgtctgtgtgtgtgtgtgtgtgtgtgtgtgtgtgtatacacatatatacgtatatataaattgtatatatataaagaaagaatatatatataaagaatatatatgcgtatatatataaagaaataaagttgttttaaggatggtcattctagtttataaatacatgtttattagaggccttctacttatctatatcaacattagggattttaatgtaagtgccaaaattaaggatcatcagtattttttcttttgactttctgtaattggctcttttttcctgaagctgaaatgaagaaagattaaagacttcttaaacatattctagctttggtttaaaaatctgaacattatccaaacttgaagaaactatttacctgtttcttcattgcttaatacttagtctctatgtttttctattttttgtacctaaataaggagtgtttgtctcaataaaatatctaggtccagcaatatgtttagaaaggttttaataacttgctgaaagcatgcattttgtgtaaagtgtggcaaagaaggaaacaattgtactttcactgggaaaagactaaaaggaaatataaataccaagctgttgatagaggttgccttcggagagtggaattgtggatttttttttcacctatcttttcagttttctaaatttcccacaattgtcacctataacctttaaagggggaaagtgtaagcaatcatgatgtaggccctgttgtaaaacagaagtaaatgggactgtgcctatttgcctacttggtgctgcccttttccgtgtgttgtctcctcgccgaagagctccgggcccttagccctgaggtgctgcctctgcttggggctgagcttcctgcactcctgggtaactctcctgctttctaggccacagggccagggacctcagagagaagaatgcctttccttttctctaggtatgtttctgtttgttttcagcgtaggtgacctaccttatgctgctgaagtcccctcatagagatagaactgatttcgttcacttttttcttttcttaactgctctaggctttctgttagattttcaaaaaatgtgtgacttcctgcttacatatggtaaatgtttacacgtcaggaagcttttcctttttgtgtgtaagaagtagaagctcactggacttatatgtcagcattctattaatcttaattcccccattttgtttctgtgatctgctatgacattacaaaaaaaattggtttatctttcttctttcgttttccagtgcctttattgcatggaacagtatcccctgcacccacgcttcaccctggttagtttaccaggctaactactttgtgcctctttggtgaagttcgtattcctaaaagtatgaggttatcatcatgggctctgaatccagactctctcttccattgtttaataactgtataaactgtgttttagtctctggaagagggaatactaataatatttagtccatagctttgttaataggattaaattggctaatataggtcaggtgtacttgcaagcacttaaactttccattcgttattataagctattactattaaggatcatgccagtaaatcctcaccaaaattgacttcattattttggcataatgttattgtagactattatctttgattccgggagtaaggctaagttgtcatttgaatgagataaggacctcgaaatcagttgtaaagacaatcttggccgggcgcggtggctcacacctgtaatcccagcactttgggaggccagggtgggcagatcacgaggtcaggagattgagaccatcctggctaacatggagaaacccatctctactaaaaaaaaaaaaaaaaaaaaaaaatacaaacaaaaacattagccaggcgtggtggcaggtgcctgtagtcccagctacttgggaggctgaggccggagaatggcgtgaacctgggaggcagaggttgcagtgagccgagatcgggccactgcactccagcctgggcaacagagcaagactccgtctcaaaaaaaaaaaaaaaaaaagacaaaatgttttaatgaggagataaaaatcactgaaccagcctgttgtttttatattggatcagtatagctttgtaccgtacctggaaataaaaataaaaatttttcctgagtaaattaataagatgtaggaaagatattaaggtttatttttaagtaagctctaaatagaaatgataatctgattataaaaagaagaatatgaaaaatatttaatatgctagtgctctgactcaaaaattaaaacctacattttttctttattatttgttttttgagacagagtctcgctctatcacccaggctggagtgcagtggcacgatctcagctcactgcaagctctgcctcctgggttcacaccattctcctgcctcagcttcccgagtagctgcgactacaggtgcctgccaccacacccggctaatttttttttttgtatttttagtagagacagggtttcactgtgttagccaggatagtcttgatctcctgacctcatgatccgcccgcctcagcctcccaaagtgctgggattacaggcgtgagccactgcacctggctaaaacctacatttttttcaattctctttttaacatttgaaaattttgcttaatctaaaatatactccagaagtttaaatggaaagaccttaataaaatattcagtcaaatgctcttcctttagaaatggaggtactgaagttcatttctcctatcattctaaattgatgtttcattttgactatatatttagtgagttatggcagtaaaagcagctttaattttttttctgaaagcctactcatattggagccctttataacttgcctcttgaagtatatatatttattcatacaaatcaaacactgatgtctgtgaagtttcatatcatcttttatatttgaattttgttcatatacttattgtcacccaggctggaagtacagtggtgtaatctcagctcactgcaacctctgcctcctgggttcaagtgattctcctgcctcagcctcccgagtagctgggattacaggcatgtgccaccatgctggctaatttttctatttttagtagagatggggtttcgccatgttggccaggctggtctggaactcctgacctcaagtgatctgcccacctcagcctcccaaagtgctgggattacaggcatgagccaccaagtttttaattgatggcattttaaagaatacctcatattttatactttccagacattttccccacttatatgaaatttaaaatgagagtatagctgttatttgttacttggtcataaaggtatttggaaaagcactgatcttagaattttaataaaaggcatttattaccaaaaaaaaaaaaacactggatatattgaccttaaaatgagtaattagtattttccagtaaagcattttggattcaacatagactatgcttcaccctacctcacttctattagaaaaccttttttaaaaagaaattttctttttgtcagctttagtaaataatgtcattcaggattcctattcacaatctgagatctgccacttaacttgctcagaagccttacagtccacaccatttgttctatcctttcaattcaggttttatttgtttatttatttatttattttttttggcgtgctgttgcacaatcttggctcactgcaacctctgccttctgggttcaagtgattctcctgcctcagcctcccgagtagctaaggttacaggcgtgcgctatcacgcccagctaatttttgtatttttagtagagatggggtttcaccatgttagccaggctggtgttgaactcctgacctcaagtgatccacccgcctcggcctcccaaagtgctgggattacaggtgtgagccactgcacctggcctcaattcagtttttaacttgagcttaaacgagatattttttaaaagttaaaatctgtgttgaggcatatcaagaattgctatgtctcttgggggagagatgtgaattccatcaacatagatatgctagtttatagtgaactgttaggaatgctgtacccttgactcatacttagtcttttctttgtggcttgtggctctcttttcaacttcattaacatgtaattgaagtgtactaaatgcatatacttattttttatgttttttcaattttttattttttgtgtgtgttggggggtctcactatgttgcccaggctagtcttgaactcctggcctaaagtgatgctcccaccttggcatcccaaagcactttacagatgtgaggcactgcactttaaatgtgtatatttaaaaatgtacagtttggttagttttgacatgagcatatgcctgtgaaatcatcattcccaagagagcaaacacttctgttcccccaaaaggttcttgtgcctctctgttttgtgtcctttcttctcctcccatcttcaggaaaccactgatggggtttttgtcactataattagtttacattttctagaatttttctggaagtggaatcatagatatatacttcttttttaatctgacttctttcacttagcataataattttgagattcacgcatgttgttgcctgtgtaacagttggttactttttattgccaagtagcatttcattggatggatagatcatcatttgtttattcattgatcagttgattgacatttgggtttcagtttttggctcttaaaaataaagcttgatagtacatttgtatagaaatctttgtgtgggcataaattttcatttctcttaaccaaatacctagaagtagagtggctaggtggagtggtagctgtgtaatgttttaagaaaactatatttttaaaagtttgtacaattttacattcctctcagcagtgtgtagagctgttccacatcctcaccaacactagatgtggtcattctttctcatattagccattctagtggaaatatagtggcatatcagtgtgattttagtttgcatttccctgatgattaataatgttgaacatcttttcatgggtttattgcccatttctagaagttattttacatctcagccatttcctcactgagctgtcttattcttaaattgtaagagttctttagatattgtggatacaagtactttttctaatgtatgtgttgcaagtaagtgttttctttgtggtttgcttttttgttttcataagggttatcttttgaagaactgtttttttgttttttttattactttgaagcccagtttactaattttttcttttttgtttttttttgagatggagttttgctcttgttgcccaggctggagtgcaatggcgcgatctcggctcacagcaacttcgcctcccaggttcaggccattctcctgcctcagcctccagagtagctaggattacaggcatgcgccaccacgcccggctaattttgtatttttagtagagacgggtttctccatgttggtcaggctggtctggaactccggacctcaggtgatccacccgccttggcctcccaaagtgctgggattataggcgtgagccaccgcacccggcctaattttttcttttataaatcatgcttccttgtgttttgagaaattgcctagcctaagttcaggaagatattctcccatcttttaagatttttatatgaagcatatatggttttgcatttaggcctaggacccgttttgaattaatttttgtgtattatgtaaagtgtcagtgttggcttttctccccacctggatatccagttgatccactttgtttgttgaaagacttttttcctccagtgatttgtctttacaactttgccaaaaatcagttaaccaaacgggtaggtctttctgaactcttcttttctgttttattgatctgtctctttacaccaatcccaaaaggccttgactactgttgttttatagtaaatcttgaaatcagggtaaatctttcaactttgttcttttaaaaagttgctctgcttattctaggtctttactatcagcttgccgatttctgccacaaagcctgctgcaattttgattgggattgcattgaatatacaaaccctttggaaagaatggcattttcacagtatttaatctttcaacccatgaacttagtatcttagtaccatttatttaggtcttctttaagttttcttcgcaatattttgtagttctaagtgtagaggccttgtatatgtttttttgtgtgtttgtttgagacggagtttcactcttgttgcccaggctgggcctcccgggttcaagcgattttcatgcctcagcctcccaagtagctggaattacgggcatgtgccaccatgcctggctgattttgtatttttagtggtcaggctggtctcgaactcctgtcctcaggtgactcacccgccttggcttcccaaagtgctgaggttacaggcgtgaggcaccgcgcccagcctgtcttttgttaaatttacatttagaaattttacatattttgatgctactgtaaaacagttgtttttcttaattccactttccaattttttgcttgctagtatttaagaattcagttcattttaatacattaaccttttatcctgcagttttgttaaattcacttattgaatatagttattgttttctagattctctgggattttctatataaatagtgatatctgtaaataaggagagctttatttttactttccaatcttcatgcctattttttgcttgttgtttttcttgtcttattactttattgagtaatctccatatcagtgttgcacagaagtggtaaaagcagatatccttgtcttcttcctgatctcaggctgagaaattcagtctttaaccgttaactgtgatgttagatgtaggttgttcatggatcccctatatctgtttgtagaagtttcctactaattctaatttgctgagaggcatttttttttgtttttttttttttttgagacagagtctcgctttgtcacccgggctggagtgcagtggcatgatctcggctcactgcaagctctgcctcccgggttcacgccattctcctgcctcagcttcccgagtagctgggactgcaggcaccggccaccacgcctggctaattttttgtatttttaggagagacggggtttcaccgtgttagccaggatggtctcgacctcctgacctcgtgaaccgcccgtcccaaagtgctgggattacaggcgtgagccaccacacccggcctggttttttttaatcatgattggatgttgcgtttttgtcagaagcttttaaaaaaatatctgttcacatgatcatatgggctttctgctttattctgctaatatagtatattacattttctgaatggtttaatcttgccatttctaggataaactatttggttatattttagtatcctttttatataatattgatgttcaatttttaatttttgtgaatgatttttgtatctgtattctttagggatcttgttctattattttttgtaacgtctgtgaggttttggtattatagttgtatgacctaaaaaagtgaagtgggtagtgatctcctttttttttgtttgtaaaacttttcataatttttgtattatttcttctttgaaagaattcaccagtgaaacagactatggctttcttttgggggaagttttttgttttttttttttttcttttgagacggagtcttgctccgtcgccaggctggagtgcagtgctgcgatctcggctcactgcaacctccgcctcttgggttcaagtgattctcctgcctcagcctcctgagcagctgggactacaggcgcgtgctaccacacccagctaattattgtatttttagtagagacgttggccaggatggtctcgatctcctgacctcgtgatcccaaagtgctgggattacaggcatgagccaccgcgcctggccggggaaggtttttaatgataaaatcagcttctttaataaatataagagtattcacattctcgtatcaattttagtaagctttattttccaagaaatttgtttcttttatctacactgtcaaatttattggcataaggctttttactatttcttattttttaaatgtttgtaggattgatggggatgccccttatttctacgatttttttttctctctgtatctagctcgaggtttgtaaattttttttttcaaagaaccaaagtttgattttgtaattttctctattgtctgcatttttattcatcctgccatatcactgtaatttcctttcttctacttactgttggtttacatttctttttccaagtttttttctgttattgtttagattactaacatttaatgtaattatcggttgttggaattagacctgccatcttcctattactggttttgtttgtcctttctgtttttttttctttctttcttctgtttcttttttcttgacatctttggatttttaacattccattttcatttgcctcttgactttttggctatgtctttttctgtgtgttgtgtgtgtgtgtgtgtgtgtgtgtgtgtgtgtgtgtgttgtgtaattgctccaggtagtaaatatatttacttaaccttttattatcagcttagagttaatattttatcacttcacatagaatgtagaaggcttgcagccataaaagtccctttaccctccccccagagacatttatgttacagttgtcatatgtgttatatttatgttgaaaccctactacacagtgttacagtatttgctttcaacagtctacatattttaaagaccctaataggaaaaataaatttatatttactcagatgtttgccatttcttttgctctgctttcattcttaaagatctcagcttctctctaaaattttcatttgattctttttaaactagtttttctttctctgctgataacttgtatctttccatgcatttgtgtttgtgtttgcctcatggaaagtaggtgtaatggctgttctacagtctttgtgtgataatctcaacattttcattgtcttggagttggcatctgttgattgcaattttttttttttaagaatttgtcagattttcctacttctttgtatgtccagtagttttggattatatcctggacattgtgagtttcatgttgtatagatgttgtgtgctgttgtaatcctctgcagaatgctgtttgtttcagtaggtatctaacttggttagatctgccttggttatataccagactataaattctctatgctgtctgtggacaggggttcctttctcagttcagttttcaagaccagtgagtgctgtgcttctttgagcctgccgtgcatatccatatctcaggtgtgagcctaagacaagcgggagttaattcacacaatggcaggtcccatttctaccttctttcctctctggttttccccacactttacagcccacaggtgcctttttcattagttcctttaaccacaaagaccgtgtttctgttggagttttagtctctgcacctgtgcttcactgcatagctccctgactggggcccacctgtggggcagagttgtagagaaaagacaaaaaagaaagtttttactccatggaaaggaaactttttagaaactttttactcacctcccaaatctgcctgcttttgtctacttcttattgtcctcaagtattatagttacattttgtgttctgtctgctatagcagaagcagaactctggtttgtgacattttattttatttttatttttgagactgagtcttgctcttgctgcccaggctggagtgctgtggcaggatctcggttcactgtaacctctgcctcctgggttcaagcgattcttgagcctcaccctcctgagtagctgggattacgagtgcccaccaccacgcccatctaatttttgtatttttattagagacagggttttatcatgttggccaggctggtcacgaactcctgacctcaagtgatccgcctgccttggcctcgcaaagtgctgggattccaggtgggagccaccgtgcctgaccaggttttgtgacattatttaatgtgttggatatgtgattattctttttcaacatggtagcctttttttgtttttgtttttgagacggagtcttgctccgtctcccaggctggagtgcggtggcacgatctaggctcactgcaagctctgcctcccaggttcacgccattctcctgcctcagcctcccgagtagctgggactacaggcgcccgccaccacgcctggctaattttttttggtatttttagtagagacggggtttcaccatgttagccaggatggtctcaatctgctgacctcatgatctgcttgcctcggcctcccagagtgctgggattacaggcgtgagcaccactcccggtctcaacatggtagccttttacaaattactatatttttttcaaattgtagtaattcatacagcaagcatatataatggtaggacaaaacaccttaagccaagatgtcatctccatggtctgtccaggtagcatagaacacaaaaggagatgtgattgaaagatgttgcttcatctacatgtttctactattgtctggggttccttaggagccaaggagaacctcgctgtgattggcattggaaagacctgtggttggaagaaaattacctgggaacattccagcctcatcttttttttttttttttttttttttgagacggagtcttgctctgtcacccaagctggagtgcagtggcgctatctcggctcactgcaacctccggctctcgggttcaagcaattctcctgcctcagcctcctgagtagctgggactacaggcatgtgccaccacaccgggctaattttttgtttggtggagacggggttttaccgtgttagccaggatggtctccatctcttgacctcgtgatccacccgccttggcctcccaaagtgctggaattacaggcgtgagccaccgcccctggcccagcctcatctttaagccataatttggctattgtgttagtgaataaacctgaaaggtacatcttcattcatacataaacataatttagttttcattaggtagattccttgttcacatccagctgagaacatgacactaaagaaatcgggctttaattggggagggaaagagagagaacgtggagtccctttggttgtcacttaagagatacagatgaaggagaagtagagttggaggtcagaagggccagaaggtaaatgtagtctaatattagtcatagtgaggtgaaggcttttggagggtagagattcacctagggtgagaattatttcctaagttctagagtagcatggtaaataacaaatagtcttaggtgctttgtcaggaactgataatgactacaagtatatttgaaatcataagagttatatttatgtttgctgtgatcctctcatagtagctgtgaaatatttaaagtaaggcataaaattattatatctatatctatatctataagtaaaaatggtctattttaatgccttcagtatcatagttgagtattaagctaatgctaacttcataaaatcattttttcctaagataatttttgagatttataggaaggtagaaatgcatgcatttcctctggatttgccatttgttgcatagtattatgtataacattttcttaaacaaaaagcttaaagaaaatattagcaaatcaaacctagctgtgtagtgaaagaataacatgcatatatgaattggtctattgtacaaattctaggataattcagtatttgcaaatatgtcactataattcagaatgtaagtaaaggagaaattcattatctcactagatgcttaaagaaagcttctgaaaaaaatttagccatttcttaataaaattataaaaaataggaatagaaggaaactacataaatatggtaaataatctttactaaaatacaacaacaaaccaacctattaaaatatgaaataccaaaactgtcactgtgaaagtcacaggcaatacaaaaattattgctatcacaactattttgtatagcttagtattattgctttgggctagtaatgtaaggctaaattctttatttccagaaaatataggtctaggaaatctaaagagattcatatgtgagactattagcactaataagaaagtatggtaaagtagctggatacaaagaagagaaatcaataacctctttattttgcaacacagtaaaaaaatggaagtaaaactgaatgaacagaatgtattctcatatatattaaatatctgttttactatgcatttaaaatccagagcttaccatttttgggaaactctacaaaaagatatatgacatgttgattccaaaaggattttatgaggactaagtgagataaaacacactaaaatgttcaagagaattatcaaggttgcctatacaatatattgaatgagaaattgtcgaggaaaagaaaggcagctgcaatttctaaagggaatctacagtgagaagtagtctgattcacaaacctctggttaaatatggtgtcttgactacacttgttttctccttccctaaagtctgcaataatctcaaaggaagcttaaaaatgttaattcatagctgggcagatggggtgttgtcacctgtaatcccagctacttcggaggcagaggcaggagaattgcttgaacccaggaggtggaggttgcagtgagccaagattgcaccactgcactccagcctggggacggagtgagactctgtctcaataaataaataaaataataaaatacataaataagtgaaatcttaattcataaggagaaacataacagtaaaggagacagtgaccaaagattttaacaatttttcaaaacagaaagtgaatggagggagtagtaactgagttcacagagaaagataccacctaagtacctgcagaggtcagttatggagataacagcatgccccagggatatcttgagagagttccttgtgcttgggggctccacgtattccaaaaggctgaagtcagttttacagctcacagtggaaattccttaaaagtccatatccagatctcttagaccttcctctcctacactccagcagatgggtaactacttcagtcccgtctgctggggaaatgggaggagcgctagaaccggaagtgctccagactagagaggtgaagcacgggattgaaagtcaagtgagcctgtacaggtctgcacactgaagtgtagggccctacctccttccttcttcactcctcctcaaggcagcacttagatgagttgatcccttcacaccccacccagcagttcgttctacctggcaaaacttaacagcttcggtgaagaaacctccacattactgaacatttggaggtgtcccaatgaaaaggtaactcaatatacctgatcattttacagagaagcccatcagtcaacaagcttgccacccacgctgagcttgggcagttttttagtgcctcattattaaatatggaggcgcatccagggaccactagatatacaaggaaaaccttaaaagtgaaagagacgaccgagacaggcggatcacaaggtcaggagttcgagaccagcctggccaacatggtgaaactccatctctactaaaaatacaaaaattagccgggcatggtggggcgagcctgtaatcccagctactcaggaggctgaggcaagagaattgcttgaacctgggaggcagaggttgcagtgagctgagatcgcctgggcaacaaagcaagactccgtctcaaaaaaaaaaaaaagtgaaagagacccagtcaatgagccaatgaacaaaaaaggaacccagaggaatccaatgatccaagaaacagaagaacagagaacaagaaagtgcttttggaaatttaaaaatgtgatagttggaaaaaacttctgtggacaaattggaagatgaaattgagatgtattagggcaagagactcattttttttaatttaaatttaagattttaaatctgtgagtatttagtactcattctttttttttttttaatttttgtttttgagacagggtctctctccagttgctcaggctggagtacagtgacaccgtcttagctcactgtagccttgacctcccgagctcaggttattctgccacctcagcctcctgagtagctgggactacaggctcatgcaaccacgcctggctaatttttgtatttttactagaaacagggttttgccatgttgcccaggctgatcttgaactcttggactcaagtgatctgcccgactcagcctctcaaagtgctgggattacaggtgtgagccactgtgcccagtcaatactcatttttaactgtgcatttaccctgttaaattaaacgtaaggaaaaatattcactaaatctggatttttttgagacggagtctggctaagtcacccaggctggagtgcaggggtgcaatctcggctcactgcaagctccatctcctgggttcacgccattctcctgcctcagcctcccgagtagctgggactacaggcgcccgccaccacgcccagctaattttttttgtgtgtgtgtgtgtttccagtagagatggggttttaccgtgttagctaggatggtctcgatctcctgaccttgtgatccgcccgccttggcctcccaaagttctgggattacaggcgtgagccactgcgcccggccctaaatctggatttttgtttttagttagagaagaggactggctttttttcacatcggctgttgatgaataaataatgcctgatggagatttttggagcattagatttgtgtttggtagtctgggacagatgttagtgtaatatgcattgtttacaggatatggagttagcaggacagctaactccacagcgtttggtcaccaaacgaatgatatcgtgctaatcacgtaccctttctgattttcatttacctgatccataatatggggatggtaataatggtaacctatctcacagggctgtgatgatgagtagaagagataagacctataataaattacctagtataatgtgtagcatgtactaaatgctcaatgaaaagaagctttgattataaccatcaagtagatggactggtaattatagatggttaagaaaaaggtacagtcagccctccgtatccatgggtttcacagagtccataggttcagcctaccatagattgaaaacatttgggggaagaaattatgtctatactaaacatgtacagacttttaagcttacagaataacagttgtttacatagcatttaccttgtattaaatattgtaagtaatctagagattatttgaagtatgcaagaggacgtgcttaggttatatgcaaatactgtgccattttatatcagggacttgaggatccacggatttttttttaatccatgggaggtcttggaaccagtgttcctgggataatgagggacaactgtatacttaaaaagtaacacgtgaatgaatgaattccttaattgtagagctatgctctggctctagtattagtcctctgaccattaaagatagcatgttggtgtgtttatgattatacaggaattaagttttcataaacttaaatgttgcattttcacttacaggcgtcgattagcaaggtaaaagtaacagaaccatggctcagtttccaacaccttttggtggtaagttttcagaaatttctctttttaatgtactttgggaccagattttaaaaacttgatattatggcaaatttaaaattaaaaagtagagaaaataatataatcagcattcatgtattccatcatatagtttcattaattatcaactcatgcccaatattgtttcatctggattcttttggagcaactcccaggcatcatttcatctataaatattttagtatgtgtacctaaaagataagaaaacgtttaaagacataacttcagtaccattatcacatctataaaaatttacaataccgggccgggcatggtggctcacgcctgtaatcccagcactttgggaggccgaggctggtggatcacctgaggtctggagttcaagaccagcctggccaacatagtgaaaccctgtctctatgaaaaatacaaaaattagccgggcgtggtggcaggcacctgtagtcccagctacttgggaggctgaggcaggagaatgacatgaacccgggaggcggaggttgcagtgagccgaggtcgcaccactgcactccagcctgggcgacagagcaagactccatctctaaataaacaaacaaacaaacaataccatattattgtacctgtaaaatgttcgctacatctagtctgtaccttatagtctttggacatttccctgatagtctttagacatttcttgttatggtttgtttgtttaaattgggatccaaataagatacaaacattgcaattaggtcatgtgtttcccaagtctcttagtgaattttcccccactcctctgtttttttatcagcaagttatttgttgaagtgatggggtcatttacactttttcaaagcctggatttgaagcatgacatttttgtttgttttacttcagttaaactaaacataagtttgaaacatatcagtctgcataaaatgtgttttttgggtaatttttcctaatgttattaggaaattgttaagtgttcttgcttacacccaagttactttttaacaaaaatacttattaaaaagtacttattaaaaaatacttattaaaagttcatattaacggattactcttggaagctgtctaatcttgtcatgaagagagtaaaagtctccgtgggattctggtacagagatctgtaaacttttaaaaatcactagttattctattttatttttgtcccccttcttaattactgtacaatttctggtttttgtttatagttacagggatgaattctgacagggcagtgaaaatttcttctagaagttgcagaactgtaaggcctgtgaggaaggggtcatttctgtcttggacacccgttcatccccacagtaaatatttttccagtgactgaatggatttttactttatctgtcagtgtcatcccagacccggtagagaggagagatgcaatgtttagatgtttttgctggtgtgctgggcacattcacattttgtgtgaaacatacgtattgtgtattcccagttttgtggaaggtgtccgagcttttgaaagctttcatgtatgtaatctagaattattttagtcaatttgaggagacctaggactaaagtctgcaagatctcagtcgtgagtggacatctagtcagcctaagagctgaaactgaaggaaaacctaaaacccattctctttggctattatttcatatcaggacatcccctgcccttctttttttttaagtctgtttcctgcatactgagatacctgtttttaaaaacagctttagtgaaatataatttatattccataaaatttactagctttagttgtataataatttttagcaaattatatagagttgtgcagccatcaccacaatctaatatattaatattttaatcaccccccaaaagattttcatggatatttatcacactcaccttcttctttcataacttttgcctgtggcatttaaggcacttgagagtacagttttaggtttaagttaatttagtctgttgcttgggtttatgtaagtaaattattaatttactataatcttgctaactatgggattataaaacaagtttctaaaaaaggaatgtgtgcctcttcttttctttccctcccattctctctctttctgtttcttacattttgtgtcctgttttacacttttctaactttatatgcataacttccaaggacaagaagatgtgaatttatcaagtctttataatacattgacagaatcttgaagtgctgtggaaatagtgtgtgagagcattttgttttccttttctcactgaataatttgtttgtcttttctttggattttaggcagcctggatatctgggccataactgtagaggaaagagcgaagcatgatcagcagttccatagtttaaagccaatatctggattcattactggtaatcacagtcagcattttttcatttttacttatcagtagtgcagatgtctgtggaaactctatcatgcaaagacgagatgggcaaatatgaccaaggagagacatttacctgttttgccctaaccttgtgcctgtccttttacaatttttttacacataatggaatcataccttgtttgcaatttttagtgcatgtcaaaccacttgttttgtgcatgtaatttatgggaattggttaagatcaaaggaccaatggctcacacctgtaatcccagcactctgggaggccgaggtgggcagatcccttgaggtcaggagttccaaaccagcctggccaacatggtgaaaccccgtctctactaaaaataaaaaattagctgggtgtcgtggtgggcgcctgtaatcccagctacttggaggctgaggcaggagaattgtttgaaccctagaggcagaggttgcagtgagccgagatcacgccactgcactccagcctgggtgacagagcgagactccatctcaaaaataaacaaactaattttcctgtttgattatttttcagaattcactttataaaaagtggaatctttatttccaggggaattgttctgctaccatgcccagctaattttttcttcttctttttttttttgagacagaatttcgctcttgttacccaggctggagtacaatggcgtgatctcggctcactgcaacctccccttccagtttcaaacgattctcctgcctcagcctccgaagtagctgggattacaggcacccactaccatgcccagcttattttttatatttttagtagagatggggcttcaccatgttggccaggctggtcttgaacttctgacctcaggtgtcgttcttaatcattgttatttattctctgtaaatacttcagaagtacccagaatttggagtataggtattgggaatggcaaataactttttttataaagtgaaagtatgggtcatcagtttcctaaggatttctataaatgtgcttttgcacaatgggtagctgttcatatcttagttaatagcagattaattaaagtggaaaatctatgccaggaaatggtaggccctttttgagatgattttttgaattctaaagtcagtgctgatggattcttttactgttgcctatgggcttatccttggacttttataatgcactcaactggtatttatagtattaccagcctctttgtaaattttgtaattttgctattacaggatttctgtcagctgttgtttttttttttttttcctgaaactttttctgtttaatttacaggtgatcaagctagaaactttttttttcaatctgggttacctcaacctgttttagcacagatatggtaagttggaattttacatgaaattttacataagcataaggcaaaataaaatatcgttttgttctatttggtaatatgatttcttatgttataaaaggagaacatgtatctctagcctgaaatatcttgttacttcttaccagagagttatgtctgaaaagtgtctttctcatatggaactaaaacaaaacaacaaaaaaagtggtgacatttgaatgacaacactgtcaaaaagttgaatttccatggagacatctaaattttggtgttccttcaccaattagttttggcttcacccatatcacccacatttatttgaatgtcccacatttcttgctttataatggaatgattttttatctttcattgactgaagaataaaaggtaaagaaaatatttgagagttagtgcatggtaaatccataacattaatagataatagtgaattatttgactatcacaaataggcattcaatcttttaagccacaggaaatacagagagtataataaaaagggtggcaaatacagttttggattcttggctcatggctttggagagccatgctgaattctgttgtcctctaagatgtctcatttttttcaccaagggtgcttaatacttcacttccctgagttaattagtgatacgaaggcagctcgctatgaagaaagagcatgtaggctgggcgcggtggctcatgcctgtaatcccagcactttgggaggccgaggcgggcggatcacgaggtcaggagatggagaccatcctggataacacggtgaaaccccatctctcctaaaaatacaaaaaattagccaggtgtggtggcgggcgcctgtagtcccagctactcgggaggctgaggcaggagaatgatgtgaacccaggaggcagagcttgcagtgagccgagatcatgccactgcactccagcctgggcgacagagcgagactccgtctccaaaaaaaaaagagcatgtgatttgtagtcgtacacctgagtttgattcccaggtgtaccattttcagtgtctctgatttggagatacagttaccctctttgacctcaagttttctaatctagaaaataggaatggttatagttttgtgagagttgttgagaggattccagaaaaaccaaggacttattgtggctcctgtcacataataggccctcaaagtaaaacccaaaaaggtatcatctccaggggctgggtattctacataactgaattttccagctaactactttgtcctcttaaattaccaaacttttaaatttataatcttgtggaaattaataaaggttgatacagctttttgtttcttttaagcacagtctacagaacacaatctaagcttttcttgatgaaatgtcatcattatgaaaattagtaactgtcctgaaatagcaaaactttcacaggagattgtgtgtgtgtgtttgtgtgtgtgtgtgtgtgtatttggatatatttgaattgaaacgaaatgataccagatctctgtgctttttttgggtatctgctttattttctttttcctggttgtcagcatattggccgccagactgtctctaaactagtgtgcttgctcctctgaagccattctaattctaacttctgatctattagagctaaaaaatcagataaccaagcggttttggaattacagtttaagtaaagtaagatgctcagatgaagaaacagcctgcaagaaagaagtcatgtgcaagtgagcacagaagccctgttctgtcagttaaatgtgaaagtttaaacgcaagagacctgtggcacctttgtgaattttaacaagcttctgctttgcagctcatacatgatcatgtctcataccatcaggacctctcgctggaaccttcttccgcagacttaacttcctccactggattatgcttttgtgttatattcccaatttttcaaagttcatttattctttcaacattgaaaaattatttatcagatatctcctgtgggccagggactgttaagaggtgctgcggatatagcaatgaacaaaatagacagaatccattcttttactgaaacggcagtctagtggagggagacaataacaacacaaaaattgtcacatggtggtaagtgtggtggagaaaaataaaatacactctaatgaatttcattttttttcttctgttttttgtaaaggtgggatcttgctatgttgtccatgctggtctcgaactcctggactcaggccatcttcctgcctttgcctcccaaagtgctgggattataggtgtggccaccatgcctggcaaagacaactgtcttaattgaaaaaagtgacatttggctgggtgtggtggcccacgtctgtaatctcaatgctttgggaggccaaggtgggagcatcgcttgcgcccaggagtttgagaccaacctgggcaatataatgagccctcatctttaaaaaaaaaaaaaaaattttttttttttgtttttttttttttttttttgagatggagttttgcccttgttgtccaggctggattgcaatggcacgatcttagctcactgcaacctctgcctcccggcttcaagcgattctcctgcctcagcctcctgagtagctgggattacaggcgtacaccaccacgcctggctgattttggtatttttagtagagatgggatttcaccatgttggtcatgctggtctcaaactcctgaccttgtgatccacctgcctcgacctcccaaagtgctgggattacaggcgtgagtcactgtgcccggccaaaaaaattttttttaattagctgggcattgtggtgcatgcctgtagtcttagctgctagggaggctgaagtgggaggattgcttgagccctggagtttgaggctgcagtcagctatgattgtgccttctagcgtgggtgacagagcaagaccctgtctctaaaaaataaaaacagttgtcctaactttctaaactatttttacctgagtggcccaaagtcaggtttttataatgactatgtatattaattaaagatggtaatgtggcaatcttagattgaatgaatctttaatttttttcttacgttttgctaaataaatttgtgatggcgtattttactatcaaaaatgtctgtaactctcttttcccaaaagaaatgtctttgaaaagtcattggaaatttcatgaaccactgatatcctgcccagatgatggaataatgcagtgcaaattatgagtttagcaagatctgcctttcaactgagctgatttgatacttattcacatagtaaccctgagtagtacttgatctcttaaagcctaggtttttttgtttgtttgtttgtgtttatgttttgagacggagtcttgctctgttgctcaggctggagtgcaatggcacgatcttagctcactgcaacctctgcctcccaggttcaagtgattctcctgcctcagcctcccaagtagctgagattacaggtgcccacgaccatgcccgcctaacctttgtatttttagtagagacaggttttcaccatgttggctagcctggtctcgaactcctgacctgaagtgatctgcctgcctcggcctcccaaagtgctagaattacaggcatgacccactgcagccggccaagcctaggtttttaaaattgcaactaataatagctgatctaaagaagcagctccctccaacccccatactatttttatgttcttctgtgatttttctggtagggtcccagggtaagtccttactccttttggtagacggaagaatgggtttgactctgaagttttaggcagtccttgtgtcagtcatctggggaagaagataattttttgcttttttgtttgtttttgagacagggtcttactctgtcaccaagactggagtgcagtggcatgatcatagctcactgcagcctcaatattctgggctcaaacaatcctccggactcaaacaatcctcccacctcagcctcctgagtagctgagtctacaggcatacaccaccatgcctggctaatttttgtattttatgtagagatggggttttgtcatgttgcccaggctggtcttgaactcctagattcaagccgtctgcccgcctcagcctcccaaagtgctgggattataggcattagccatcacatccagcaaagaagagaagtttggattaagaattggaaactgtgtctagtttctctctctgagctttacttactttgttctggactttgtttcaaatatttgagtgatacgaactgatggacagtatatgttagaaacctttattatgttttatttccatgtagaaactatattccagttaactaatttgttaactttcaactgtaatctgttaatgctttggggactccttgtctctcctggctgatttccaattaagaatacaagaaaaccttaattctcggaggatggagtcaagtcagtgtgtgtcatgccaaattataaccgtggccaaagatggtacatcttcctagaaattgtcttattaataaggagctggaaggaggttggcagatatccttttggcaattgaagtgcttagaattttttcaactttgctatgatgtggaggggaggagaataaagcagtgggaatagacaagagccagaaggtacaggaaggaagaagagacggggtgaagaggctggatgagggctctggaatctgagacggagggccagcagaaatggagagaaaagagggagtgagggagcactacctggaaatgggccctgagaggaaagaagggagccagacacatgaaggcaaggattagatcaactttgtgatctggttcagaatgggtgtcagggcaaacagccatatagtcatagtttgtactttcttaagacactcctgagtatgtgtcagaagggccttcagccccaacaagatcaatttgctaaactcatacaaaaaaaaaaaaaaaaaagaataagcaccctggactcttgatcccctctcctccatccctcattcctgagtctttaccatccagtagctcatggcgttgaactaagatgacatcttagttacctggctgcccaaaccaacacctgggcaccgtgcttgatttccctcttttcttcaccctgcatacccagtccatcaacgtaattgcatttacggactttatccccaatctggccacttctttcctactgctaccatcctaacctgtcatctcacctgggcccactgttcgagcatctggactgggttctctctttcacacttgcccctttagagtctagtctccaaacagcagctggaattttttttttttttttttgagacaaagtctcactctgtcgcccaagctgggcagtggcgcaatctgggctcactgcaacctctgtctcccgggtctaagtgattcttctgcatcagcaccttgactaactgggattacaggtgcacactaccatgcctggctaatttttgtatttttagtagagacggggtttcaccatgtcagccaggctgggctcgaactcctgacctcagatgatccacctgcctcggcctctcaaagtgctgggattataggcatgagccaccgcacccggccaggaataatcttttgaggagtgcagtggtgcgatctcagctcactgcaacctctgcctcacagcttcaagtgattctcctgcctcagcctcccgagtagctgggactacaggcgcgcgccactatgcccagctaatttttgtatttttagtagcagggtttcaccatgttgggcaggatggtctggatctcctgacattgtgatccgcctgcctcggcctcccaaagtgctgggattacaggcttgagccaccctgcccagccttcttcctgttctttaaatgggccaggtttctccttgcctcagggtcattgtacttagtgtttcctcttcctataattcagttgctctagttcctcacatcgcaggttcattgcctttcaggtttcagttcatatgtcacctccccaaagtggcattccctgaccagctagtgtaaagtggtcccctctgcccacctctttccctttaccttggtagcacttatcaccatgtaaaataatctggtttgttctcttgttagttctgcttgcactaaaatataagctctgtggtgctaggaactgtgtctttttcatagatataaccccaatttccagatagatgcccagccccccactcccccctgccccataattggtttttgaatgaatgagaatgaatgactggattagtctgcactgctgctgggtctcacctccagcccaaggggcagcaggtgagagatgagcagcctgaggccaggctttgtggatgaactgggctcctaaaggaatctgtaggtgccaacactgcagggaatgaggtgggacaagaggagcctggcctcatcccttcatcctgtaacacacacaaagtagtttcagaattgttacattcacctccactacaaacaacaaatttaggcccagtgcagtggctcatgcctgtaatctcagcactttgggaggtcgaggcaggaggatcacttgagcccaggagtttgagacctgcctgggcaacatagtgagaccccgtctctactttaaaaaaaaaattatccaggtatggtggcacatgcctgtagtctcagctactcagaggatggggtgggaggatcacttgagctgaggattcaagcctgcattgcgctatgattgtgccactgtactccagcctgggcaacagagtgagaccctgtctcaaacaaacaaacaaataaaaaaaaaaaaaagaacctagtaagtagtgtaaaccaaaaagtatctgagacaagaggtctcaatcattttaggagtttattttgctaaagttaaggacatgccgggaggaaataagcacagaatcacagaaactgtgcttttctccaacgatgattttgatggcttcagtatttaaagggaacaggtaggctggagggcaaagagggaggatatggtaatccatatattgccagagaaaaggagcaggcaggggaatagtcagttaggtaatagtaaatcagtaaagtgctcagtaagtcggcactttacataagataaaatggaacataaagtagcctgtagaggtgtttgaccttttatttgtagctccctgcttaggaacaaagggactcagctttcagggactcagctttcagcttacttttctaccttttgcatagtgaattgaagtcctgcgtttttattttcctttcacagtagatttcaagattactttgtagttccttttgtttttaaacagaggacatataaagtactatgtgaagttacttggactaggcttttttttctacctcttacgtggatatgttagttatttataatatgattaggtttattttcatttttatttaatttagatatgcctcctcatctttgtggacttaattttattatttaaatacataacagattaaaaaggttctaaaaaccgaaactaacaaaaaggtgtgctcagacaaggtcactccctcttctatccctttaccctgtttccacccattgtattagtttcctgttatccttcatttatttttgttggaaaaaagcaggtacataatgtatataacgtgtatgtattcatatttaaattacttcctttcctccttacattaaggtaacctgctataaatgctctctgttcttttttttttttttttttttttttttttctggagacagagtcttgctctgtcacccaggctggagtgcagtgacgtgatctcggctcactgcaacctccatctcctaggtttaagcaactctctgcctcagcctcctgagtagctgggattacaggcacgtgccaccatgcccagctaattttttgtatttttagtagagatggggtttcaccatcttggccaggctggtcttgaactcctgacctcatgatccacccttctcggcctcccaaagtgctgggattacaggcgtgagccaccgtgcccagcctgtttttttgtttttgtttttgtttgagatggagtcttgctccgtcacccaggctggaggtgctatcttaggtcactgcaacctccgtctcccaggttcaagcaattctcatgcctcagtctcccaaatagctgggactacaggcgcccgcgtgcccagccaatttttgtgtttttagtagagacagggtttcaccttgttggtcagactggtctcgaactcctgacctcaggtgatccacctgcctcggcctcccaaagtgctgggattagaggcatgagccaccgcgcccagccgtaactaccatatttccataaatttcttagaattttcattaccagggattccccacagttatgtttattgagaaaagcgttttttgagtatcacgacattttcaactaaatgttgggattgtcgtatgtggtttaaagtcaagtccctagaacctcatggttaagtttcttctcctcacccatgaaaacacttctgtaggacacctttagagtctaattaagccattacctaaagtcttctcccctaacctactcattatcccacactggatattcctgtttctcaccagagaccatactgggcagtggtgtggggaacagggagtgggcacctgcctgactgattgattggttttagtgtgcatgttgatgttgatttttattaatgggaactcttccccaccaaaccgttttaaatagttgcgtatcttttaaaaaactacttagcaaaagaaggaagttcaccatttcattttatttacttagtttcctttataaaacctgaaaggtagtacaaaaataaagcaaccagaagccagtttcatttatgagcatagatccaaaaaagtcaaaatcttagcaaatagaatttcacaatgtatgaaaagaatacacaatgaccaactttatgccagaggtgcaagattggttcagagtcgaaaaattctatcaacattagtcattatttcagcagataaaaggaagaagaaaacttgtgatcggattggtaattacagattaggcacccgatgaaaaatacagtaaccatttctaataagtagaaaggaaactacttaaatatgtgagactactatccatgaaaagagtcaaactctgtaaaatatttgaaaaggtttattccaagccgaatatgagtcaccaatggcctgtgacacagccctcaggagatcctgagaccatttgcccaaggtggttggtatataacatggttttatacattttagggagacataagacatcaatcaatatatgtaaaatgtacactatttcggtctggaacaatgggacaactggaagcagaggcttccaggtcatacgtggattcaagagtttttaattggcatttcattgaaagagttattatccaaagagctggaatcaatagaagggaatgtgtgggttatcataagtggttttggagaacaaagttttgtcatgcgggtgaagcctcccggtagtagacttcagagaaaatagatggtaaatatttcttatcagactttaagagcctcctttatcagtcttaaggcctgtgttgatgctaatgctggtcagctgggcctgaattccaaaagggaggagggtataatgaggcatgtctgacttcctcttcccatcttggcttgaactagtttttcaggttaattttgaaatgcccttggctgagatgaggggtccattcagatggtggggggctcaaaattttgttttcagtttacattactttccagaaatcactaccaactgtcattctaaacaatgaactctattaaactattagctctagtaaatctactgtttcatttaaactcagaactgagcaagaacgcattcagtaatgtcttagaaggcagtaagaccaataaaaaagattggcctaaatattggaaaagaaagataatgctcatttttttctagttatgtgattgtatacttagtacacccaagagattttagttttaaaacattaataagaacttgtaggagtctggtaggatagctaaatacagcctaaataattttttaaaataaaaaatgttctctgtgcttgaaataagcacctaaaaatggaaatggggggaatgtttcatctaaaatctggcaaaaatgataaaattcttcagaatacatttagcaagaaaagcatattatatgaaaaaagtgatacaattttattaaaggaaatagtatatttgaacaaccggaaagattgtcttttctttggttgggtaaactattggtgcaaaagcaattgtggtttaatcaattctccaaaaatccccttctaaggcagtttttggatcccagtagggttgtttgtataacagataaaataatctaaatgttcataggaaaatagacacccatgaataaccaagggggaaaaaaaaccttcccagaccttcccggatcacaatataccagagagccagtgtgatcaaatcattgtaatattgacctggaaattgttcagtcagaacagatagtccagaaatagttctcacttcatatgaacatttgatacatgataaaaatgtatattagttcagtgagaagaagagggattgattaataaatattactgggaaagctaggaatccatgtagaagaaatgtgattggaccctggaataactcccccacccctacccataattattggtttaaggattgaaatgaaataaaataatacaatgttagaaaatcaaggactaacaaccttctaatcatatgataaaagaaatattttatatacaaaaatttagaatttttatgccgtacatatacataaatcaacaaataatgaatttttaaaagtctttcagcagtcagcagataaacagttaatttgtgatacactatgagctcttataaactaacaacaaaagacatgcaatatatagaaaatttggcaaaggatttgaataagcagttcatagaagtgcaaatccaaatggccacgaaatacagaaaaatgatgctcaggttcacaagtagtgagaagaattcagattctgaattctttgctgaagggcccatgactacaggagaatggggaactcctatctgaggcaaaaaggtttctgcaaccacagagctttgtttcctgcgttatgatccttattttctaaaatgtgccaacttttacaatcttgatcacttttagagatttttttatctttgtcttatgccatactttttattgtgttacatgttttctttctttgagttaattccagctatgcagaattgttttctgtgtaacttaattttcttttgtgaacactgtccggatatggctcagtctaaaagatcatggtattttaattgaactgtcttatttagatctttcaaatacatttttcataatattggtttaaaaaaatcctcatgcttttaatatctggattaaaagaaataaaatctgaataaaacttttttatgcagaagaggttaagtcatgaatatgcacagttttgatgatataatgtagtttccagttacaaggacaaacttttgcttacttgatcttagccaaaaggccgagaagcgattccttttgcttactcttctttgagaaaatactttacattaaagctcattacagtttgcacttggaccgtgtatatttgagtaccattttcaaatagcagacacattttgtaagctaacttacaaaattgttgagtgatatggggcatgattctaaagaaaagttagtttcaagagctttagaggtttagtagcattatagttgagtaaccctagcatagcataagtaggtagcatagcatactgtgtcatgttcccacattgaggtttgtagagctctacaaagaatgcaatctaagtatctctagcaatattaacattccgcttctaaatctttttcttttctaatagctttattgtgaaagaattcacataataaaatttactcgtttaaagtatctaattcattggttttagtttattcacagagttgtgcgacagtcactattagctaattttagaatgttttcatcacttcagaaagaaaccccttttgatgtctaaagtacaaatcctcacactgaggctgaaaattacctgctaaagtggcagagtgaaagatattttatgtttatataaaacttggccagtatttacaggctattccccatagtttggtaaacagttatgttttctgttgttgtctctaggggtaagagtgctaattattttgttttcgtgttggtgggagtggtggttttggaaaggttcttttatggtcacagttgttctcaggccatgctgttggtttgcagggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtaagtctgaaaatgaattggtttctgtattttcttgtatattttaaaaataaatgttttcctttttttccctctcggtttataacattatgaaattctaggaggtaattctgtctgaaaaatgatggccccctgcaggaagatagtgctggggagaagaaggagcatgttcacatttgaaccctgggatgtaaagtaatcaaaatgaaagcagagatgcaggccgccagtcaggggaaaaggaagaaacttacagtccgctgctgcagcttctgggtttttttttttttttctcttccattatccttcaggttgttgcatacttccttttgattttcggtttccataatgtctgtttctccttgtgcataaacaattcctttggattatggcatctagaaatatatatattttgaatcacagtactgagtcacttggccacattaaattctttcttagaacaaaatggaatagagaaaaaataaacattgttatcctgattaaaaacctaattccagccgggcatggtggcttacacctctaatcccagcactttgggaggctgaggcaggtggatcacctgaggtcaggagttcgagaccagcctggtcaacatggcgaaatcccatctctactgaaaatataaaaaattagccaggtgtggtggtgcgcacctgtaatcccagctactcggagaggctgaggcaggagaacctgggaggcagtggctgcagtgagccaaaattgtgccactgtactccagcctgtgcgacagagcaagacttcgtctcaaaacaaacgtgattccataaaaaattatctttcaaccaggtatttttcttataagctaattgattaattagttgactgagatcagtagttctgatttctgttctcattctagactttaggttaatttgaagatcacagtaataaaatctaacatctgattcatggggaggttctttaacagtttaaaacaaaacatgaaaattgtggctagagtttcttttcatctcttcatcctcagatagctgatgataggtgataaagtgaaatagatttcggagggggcagtcaacagtaattcagggtgtctctgatataattaatgataagctaagatacagaaatactctggttttacttactaggtttcctattaaaaacaatgtattgcctttcttttagtaagttttagccacaaggctggtttttgtaaggggaaaggttttggaagatttttaggcaaataggatagtggtccaagaaaagaaagaaaaatccatatatgagcaaaggcgaggaagagcagaagtgaacactgcagcagcctccacatgactggggccgttgtttgtcttgtccagtgtgtgctcacaatgtttagcctttagttaaccagctaatttaagtggaacttgctctgaatccctgaagatctctgtagccaatctttggtcaggacccaggcgttaaaataattcaagggtgtttggggtcgaacacagtggctcatgcctgtaatcctaatgctttgggaggccaaagcaggaggattgcttggtcccaggtgttggagaccagcctggcaacataacaaggcctcgttgctactgaaaatttaaaaattaaccaggcatagtggtgggtgcctatagtcccagccacttgggaagctgagacaagaggatcacttgagcacaagaggtcaagcctgcagtgagccaagatcacactactgcaccccagcctgggtgacaaagtgataccctgtcttaaaaaacaaaaacaaaaaacaacggtatttggttttcttttggctttcttccaatgctacaagaagaaatctcatagtggagaaaaggtcaaatgactagaggcaccccatttctcctttttctctcaaacctggggtcaataatttttcctgtaccatttaattcattttctcttattccattctgccatcagaatttcagttgtggagctattgctgatttagtttcaggaggttgtgaccttactgctgagaaagttttacagtcgttaagtaacctgctactgttaaacctgccaggatttctgacctaatactctgccaggcagcccatcactcttccccccagacttctccctgtctttcctcaccacattgatgttctcagtaaatgattttgatgaggctaaaccatgaaggatatcagaacataggagaagttaccagtatatgatcttgatcaagtttacttaagtattttctagttctacctctcagctcaatctagggtaaaatacatatatatattttatagtttgttgagccacttgagaataaaataatttattactattgtcattgttttatttatttatttatttattttgagacagactctcacttagtcgcccaggctggagtgcagtagcatgatcttggctcactgcaacctctgcctcccgggttcaagcagttctcctgtctcagcctcccgagtagctgggactacagggacatgccgcaacacccagctaatttttgtatttttaatagagacagggttccaccatgttggtcacgctggtcttgaattcctgacctcaggtgatccacccacctcagcctcccaaagtgttggcattacaggatgagccactgcacctggcctgctttctaattaatattgaaaattattggttaggtgtggtggctcatacctgtaatctcagcactttgggaggccgaggtgggcagatcgcttgcgctcaggagtttgagaccaacctgggaaacatggcaaaaccccatctctacaaaaaatacaaaaattagctgggtatggtggtgtgtgcctgtagtcctaactgcttgggaggctgaggcaaggggatggcttgagcccaggaggtggaggttgcagtgagccaagggagatcgtgccactgcactccagcctgggtgacagagccagaccctatctcaaaaaacaaaacaaaacaaaaatctgactctgcatttccttgcccttatatatagtatgtgccttcacatataatatttgatcacaatgataaccctaaaaagtatgcagactgtattagccctgttatataaatgagggaactgagattctcagaaattgaacattttgcttaaggccatatttctaacaaaggagatagaacctgtccaaagctaccatttatctaaaggcgagatggagtctcactctgtcgcccaggctggagtgcagtggcatgatctcggctcactgcaacctccgcctctcgagttcaagcaattctccttcgtcagcctcccgagtagctgggattacaggcacccaccaccacacccggctaatttttctatttttagtagcgacggggtttcaccatcttggccaggctggtcttgaactcctgaccttgtgatccacccgcctcggcctcccaaactcctggcattacaggcatgagccaccgcacccggatggctttaggttttttaaaattaccttctccgtgccttcattatcaccaaactaactgggtgacatgacgtgtcactcttccatggttccttgtctgcatgggttttttgttttgagacagggtctcactctgttgcccagactagagtgcaatggcacgatcatagctcactgtagcctccaactcctaggctcaagcgttcctcctgcttcagcctcctgtgtagctgggactacaggcatgtaccaccacactgaagtaattaaaaaattttttttatagatagagtcttgctcttttgcccaggctggtctcaaactcctaatctcaagtaatcctcccattttggcttcccaaagtgctgagattacagcataagccatggcaccaagcctcagatattttttaatgtagttgttaacacactatagaattaaggctcagactggagtctgaacaatgattttgttcaactcccctacagagaagagagaaaaatggggtgcagtgatactgtgacttgccttagagcaccctgaaaatagaattttctattgtaggaaattctatgggtagacttggtaccttctttcaccagtgtgcactcagcataattcttttgttctggacccagcttatacaggaggagtctgtttttcttttgcttggtttttgttttgccagagtacatggttttattggattaaaccagtgttttgtaagcccctactgtgtgtcctagttgctgggaacatgctggccagcaagacctcatggcttctaccactgtggatcttattttcaaattgtggggagcaaggaaataaatacttttaggtgagaataagtgcaataagttcattaaaacagagtaatagtagagagacagagagagagaaaccagtagaacaagatggccagggaagaattctttgagcagatgacttttggaactgatgtagatgatgagagccatgtgaagacctaggggagaggccttccaggctaaaggaactgcactggcaaaagtcctaaggcaaaaactagcttggggtttggaaggtgtgcgaggggcgtcgtagctgaagcatggggagaccataaggaaaagcaagcaaacaacagattaagcagaagagtgacgtggttgatagacttatctgtgttatctgaagactggaatgtaggggacaagaatggaatcctggagatcagttaggaggcttttgccacgggcaagaggcaatggtgatttatatctggtggtgataatcaatgtggaggacagattagattcattctagcctgtattttgggaaaaaagtaaaaaggacttgtcagtagattggaaataagaaatgaaaaaggagtattaaggcttttcacatgaataactagatggatggtataagtgtatactgagatggggataacaggaagaggaatggttttaaaggagaaattaagagttttggtgattttgagagtcctagtagatttccgagttgggatgttaaggagacagggatgactacgtttgactgaagctcagaggaaggatcgatcagctctggggcagtttggatatggagagcatgtcttaggggcaagcttagctataaggagtacagtgtagacccaagccttgatgtgatgtgacatttaaaggtcaggcaaaagaggagaagccagaaactgaggctgacaaaagtgaaatggcagaagattggtgtcctgctaccaagaaaaagtgtttcaagaaggagggaatgctccattgtttgagctgcttttgagagatggagtaagaatatggcagaacagtgctgattagatttgatgtgatgagcttttgagtgaccttgacaagcagtttcagtatagtgatagggacaaaatcctgattggaggcttggaagaggggagagaatttcaagaattaagacttacacaggaagaggtgatggcagccagaatacggcttctggtagatgtatttatttagaaagtcattcattcagaaaaggtagtcagttgtcaaaaggatgatagtctttttgcagtggctatttaaagcacagtaggccaggcacggtggctcatgcctgtaatcgcagcactttgggaggccaaggctggaggattgcttgaggctcctagttcaggaccagcctgggcaacatagtgagatcctatttatatttttttaatgtaagtagatagatagatagatagctaataaatttttccttttctgtaaaatggaaaaattattatgtaagagaagatttctaacaaatttggaagcttaaaagatgcttttaccagtctgatgattaaacagtatttttaaacttggccttttcctcagtgtctttttgaggttagcctccttttaggttaggggtctgcagcacagatggggtacgtgtcttgaaggttaactggttgcgcagtatgctgtgtcaagccttttgaaagtctgaatgatggctcatgaaaacttttggtttgtttccatctatttttatttgttgcttgagtagattgacattcttacttaagcaaaaaccaggatttggagtataattcagtatagttatcaaaagaaccaaatttttaaaaagaaaaacacattaaaaatatagttatcaaataatcttagaaaattttggaattctaaaactgacaaggtaaacctgatacatgttgctatgtgtggatatgtaaagttaatctgattccaaatgagatgtgtggtaatgtgcttgatagtgtgcacgtgaactgtaaaccagtcatctagatgactataattataaacttactcagtaaagcccaagttagaatttttttcttctctttgttggattttcagtgtctataaacattgtttttaaaaatgaaaataggccgggcgcagtgactcacgcctgtaatcccagcactttggggggcccaggtgggcggatcatgaggtcaggagatcgagaccatcctggctaacatgatgaaactccgtctctactaaaaatacaaaaaaaaattaaccaagcatggtggcgggtgtctgtagtcccagctgctcgggaggctgaggcaggagaatggcgtgaaccctggaggcagagcttgcagtgagctgagatcgcgtcactgcactccatcctgggcgacagagcgagattccgtctcaaaaaaaaaaaaaaaaaaaaaggaaatagtctgattttcttactgtataagtaatagatgctgcttgcgagtcaacaatgcaaaaagacttaaaaagtaaaaattactattaattctgttacccagtgatgaccactgtgttcaacaacactatttttaaaatcttttttttttttttttgaggtggagtcttgctctgtcccccaggctggagtgcagtggcaccttctcggctcactgcaacctccgcttcctgggttcaagcgattgtcctgcctcagcctccccggtagctgggattacaggcatgtgccaccacgcctggctaatttttgtatttttagtagagacggggtttcaccatgttggccaggctggtctcgaacttctgatctcaagatccacccaccttggcctcccaaagtgctgggattacaggcgtgagccaccgcgcctggccctatttttaaaattttacacaagtaatacatgctcttagtaaaaagaaatacaaacaaaacagaattgtgtacatttgtaacagtgcaggaggaagagggaagaattagggtacctggtgcacttgaaacaggagaaccccaaaatagctaacaggtatttgcaagaaagttcaaccaggctgagagcagcaatagaaataggaaagggttatgctctctgcagtactgagtgagtacaaaggatctgagagatttggagcagtccagcccctatgaactcaaaagactggcccaacaagccttccttttgggacagggcttcatactcaggaaaaatgactgggagtggaatcaaaattgagcagtatagggacatggatacaaaggaaagagatggtccagacaaaagtaggggaggagaatggagactggaattcctaagaagcaaggctcacataaaaatgagcaacagaaagtatcaagcaaggtcaaatccactgcagaaagtgtcaagcaaggtcaaataacacaaagttattattaggaaaaaggagaataaagggagaaataacacccctgtggacagtgaaagcacaccagtaaatcactacttcaaaacaagctcaaagagaataagaaaatgatacaagacttgaaagatgaaaatcagagtttttaaggctcataaataaggtgacagaaagaatgagaaataaaagaaaaattcattctagaaatgaggatgcaactagaagcaacacaggggatactaactgaagaaaaatagaagttacaaagaggaaaaaaatttaaattaaaaggaaatgaggctgggcgcagtggctcacgcctgtaatcccagcactttaagaggccgaggtgagcggatcacctgaggtcaggagttcaagaccagcctggccaacatggcaaaaccccgtctgtactaaaattacaaaaattagctgggtatggtggcacatgcctttaatcccagctactttggaggctgaggcatgagaatcgcttgaacccgggaggcagaggtggcagtaagctgagatcacaccactgcactccagcctcggggatagagtgagactaggtctcctaaataaataaaaggaaatggaaaagatataaaaagaatttgagaaacagtaacaagtatttaagacaaagaagattgaatgtatgggcagcaggagtccctgaggaagaaaactaaaccaatggaatagaacaaatgataaaaatgaattcaagacaactttcttaaaataagagattctaaactatatttaaaagagtatcatgtggccaagaatatcaatctaaaaagtccaacactaagatatattctagttaaaggagaaattatttagacatgtagaaaaagaaagcatatgacttacaagggggaaaattagattatgttcagatttttcaacagcagtgctttctgctagaagaaaatggagtaacatatttagaattctcagggaaagaacaagccaaggattttgtgtccagaaaaactgactttcaagtagaaaaaacagacaaaacgttaccaatttataaggcttcggggtatattaacatgagcctttcttaaggaatctattagagaatgtgcttcagacaatcaaaatagctagacctaggtcatcataaggactgatggtgagcactaaatatatagttagctgtagagctaagactgaaggaaggctgaggaggagagagtatcggatgtaattcccatgcactgtcaattggatacgataaaactttaaggggagcaggactgcatgcaaaaaaataatttaatgcattcagaaattagtattagtattgttattctgaaactgttgtctgagatatgtggtaaaaacaaataagtaattacggaatagtctaattctgtcattttctatacctttgaaatctgtattcttggtgtggaagaaaggagataacaaatataatagtatcaaatgtaatgaaaaagcagtatagtcttggatttgaattttcaaattgaaagtattaatatgaactcagaaggcgtctctcaccacaccccccattctcttcatctatccatctatttgtctcctagttctgttcactgaaaagactagatacaatcatctaccccagcagcactgagcatccttagcgtccagattgtgaacttgaaatatcatttctcaccaaaagaaaccagagtttcttggagaaatggctgaatccaggtctagatatgaaatgtgaagagcttgaaggacccatcttgtaatactggtcagcaaggaagttatcaaagcatagtaggaggatatcagaaattctcagaagccaacccgaagaggcttacattggccaaagagaggacagtttgaacttcaagaatgataatgtgccatgaattaaaactcaataaatatttgtaaatttatgactcaataatgatttaataatgtatttaacaagaataatttaccttaagaagatcctaagaaaccagttcattaccttgaaaacaggtaaagggaaagaatcaggcatttattatgccttttgtatatgagctgtacaactggatagccaactagtatatcctcattagaagcacctctttataaaattattacagctaataaatgacaaagacatagtaggattagaacatcactattttcaactccccataaatgaataaatataggcgttaagcatcaatgactgccaagatcacaaaaagacagctacattttgtgtgtttcctgtagtcttgccaaagagatccaccgtcagcttgatccattctttggatgtagctgcgtatttgcaggaaatacagaatatagagggaaatgttgaaccgcaccatgagaatgcaatcagcaaaatccagactgggaaactccacaggtcacatggcctgggtctttcaacagaaaagaaaatgaaaaggatggagaggggactgtggattaaaggaaacctaaaagacatttcagcagtgagatttccgaccatgcctgagttgagatgagcaaattcttccctcaagggcagaattgacagaataaccatttcagtgctctggaaattaaccaaaggtatataacatctgagaatcatttatgcctgaaaagctgctgagcttcagatatgaagcagaagtctgttgcattctttcctgggcattttcctatcccccaacacttcagcttggtaatgtggagggacaggttgtaaatattagcagtcttaactgctgtcactgaagggggcttacttgctttgggagtgggaagtcatgcctgtgcccagcagctttgtcagtggaaatgacaattctggccacagaagagcaggtatgaccagccactctattatcctgaactcgtggtcatggccagggcaagtatattcttggctgaggctatgcacatgtgtcgcggagaccagggtgggcccgagtcagctgcaaactcctgactagccctcaaactgcatgcacgtatagagaatatgcagaaaggccctgtgaaatgttaaagttgaggaagactttaaaatggtctgaactttgaatgcatttttgtgctgacagattgtcagagaaaggaagccttactgacttgaggtgtttgagcacaacttccgtcccatcattggctgactactgtgctacaaagatgcaggtgcaatccgtaaaaagccaggcttaaagataaaaacgaattttttaaaaacccaactgagcagaaccatcaggggctgcacaacaagggaagacagatttttctgaattagcctatgccggttactaaataaagatagaaacaacaaccttcagggggaaaatcagagccagagtagctacaatgtattatctgaatgtccattttcacctaaatttgagacattaaaaaataacaggaaagtattgtctcaccctcaagaaaagaggcagtcagtaggaactatctctgatccagctgttggattcatttagcagacaaaggcttcaaagcagcaattacgttcaaagaactgaagaactaaaggaaaacgtggaaatgaatcaacagacagacactctccaaaaaacaatagaaattacaaaaaagaggaaaattgaaattctagaaaagtatgacaattgatgtgaaaagttcaataactggccggccacagtggctcacacgtgtaatcccagcactttgggaggccgaggcctgtggatcacctgaggtagagagttcgagacccacctggccaacatgatgaaaccccgtctctgctgaaaatacaaaaaattagctggacatgatggcaggcgcctataatcccagctatgtgggaggctgaagcaggagaatcccttgaagccgggaggcagaggttacagtgagacgaaattgcgccattatactccagcctgggaaacaagagtgaaactctgtcacagaaaaaaaaaggaaagttcaataactaaggctgggagcggtggctcacggctgtaatcccagctctttgggaggctgaggtgggcggatcacccgaggttagaagttggagaccagtctggccaacatgacgaaaccccgtctctactaaaaatgcagaaattagctgggcgtggtggcagatgcctgtaatcccagttattggggagtctgaggcaggagaataacttgaacccgggaagtggaggctgcagtgagccaagaccacgccactgcactccagcctgggcaacagagtgaggccttgtctcaaaacaaaaacaaaacctgaaaagttcaataactaaaatgaaaaatttaccacagggtcttaatagcagattcaagatagcagaagacagagtcagtgaagttgaagattaatcaatagaaattattcaatctgaagaatatggaacaaaaagattgaaaaaaaataacaaagtttcagagacttatggaacaagaccaagtttaccaatatgtgtgtcatgggagtcttagaaggaggatcatgagagaaaggtacagaaaaatatttgaagaataaaagccaaacacttgccaaatttggtgaaaagcaatagtctacacaatcaaaagctcaacacacctcaagtagggtaaatacaaagagatctacacccagacacatcatagttaacctacggaagccaaacacagagataaaaccttgaaagcagcaagagaaaagcaactcatcatggataggggagcatagatataaataacagcagacttgtaattgaaaacaatggaggttagaaggcagtggaatattcaaaatgccgcaagaaaaaattcaacccaaaattctatattcagcaaaactatcatttaaaaatgaaggtgaaataatgactttttcaaataaacaaagactgagagaattcattgctactagacctaccttagaagaaatactaaatgaagactttcaggatgaaatgaaatgacaaaaggtggtaactttaatatatggaaagaaatgaagagcatcaaaaatggtaaatatgtaggttaatttagaagaccacataaatctatttttcttcttttctctcaagtttaaaagatataagattgtataaagtaataattataactctattattgggcttataacatattataatgtatgtgacagtaatagcacagaagaggagaaagggaattgagctatatttgtgtaaagtttctatattctgccattagaagttgattatgataaattaatttggagattttaatccctacaacaaccacatagaaaattacttttggatgcatacagtggctcagccctgtaatcccagcaccgtgagaggcttgaggccaggagtttgagaccagactgagtaacatagcaagaccctgtctctacaaaaaaataaaaacttagctgcatttggtggtgcgtgtctatagtcccagctacttggaggctgaggcaaaagaatcccctgagcccaggagttcaaggttacagtgagctgtgatcacgtgactgtacttcagcctgggtgagagtgagaccttatctctaataataaaagaaaaaaaagaaaattttaattactattattatgtaataatactcttttcagttagctctctcaggttgaaaagaaaatttacttttaaaaaatagtaaaggtcagacatggtgactcacgcttgtaatcccagcactttgagaggctgaggcaggacgatcacttgagcccagaagttcgagacgagctcaggcaacatagtaagacctcatctctaccgccccaccaaaaaaaaaaatacacgtatatatatatatgaaactgggtgtagggatgcacacctgtggttccagcaagttgggaggctgagctgggacgatcgcttgagcccagaaggtgaaggctacagtgagctatgatcatgccatttcactctagcttgggcaacagagtgagatcttgtctcaaacaaacaaaaatatttaaaaaaaatcaatagggggcatttaaacactaaaatttatttactccacatgaaagaaggtattaaagttgggacagagaaataaaaaagaaggtaagcttttttacttttttttttttttttgagacaaggatctcactgtattgcccaggctggagtactgcggtgtgattgtggctcactgtagcctcaacctcttcggcataagtgatcctcccacctcagccttccatgtagctaggcctacaggcgggtaccaccatgcctggctaatttttaaaattttttgtagagatgggattttgctatgttgccctgtctggttttggactcctgccctcaagagatcttcctgccttggccttccaaagtagtgagtttacaggcataagccactgtgcccagctggaaacatttatttttgttttatcatttcttctttattggttagaatatttttgtataaagatgcttccagggccaggcacagtggctcatgcctgtaatcccagcactttgggaggccaaggcaggtggatcacctgaggtcaggagtttgagaccatcctggccaacatggtgaaacctcatctctactaaaaatgtaaaaatagccgggcatggtggtgggcacctgtaatcccagctattcaggagactgaggcaggagaatcacttgaactcgggaggtggaggttgcagtgagccaagatcacgccactgcactccagcctgggtgacagagcgagactccatctcaaaaaaaaaaagaaaagaaaaaagaaaagaaaatgaataaagatgctttccccatcaaacatgtggtttccctgaggtataataaacataggaaaggcaggttgcagtttgatttttctaccttttatttactagttttcaaagtagtaaattgattgccttagtgtcctccttttttgaccagttaggattttatttatttttaaatatcattttgaactcatggatttaattatatttgagcctttaagtccactgcagttattattctttttgattctcatcttgtttgttctgtcttcaggttgagtcttgagtccttttgatgtgatccttgacataatttttgttactctttaaaatgattaacttgaagccctattttaattggaatatattacagctggaaagtgattttctttaagcagtactgggttaattattattcagtgttgaaatgtgattggatgtgaatggtgttgagctgttttttcttcataggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctggtatgtgacttgctgaaaccataggctgagtttttactacttgtattttgctgttcattattaaaatattttctcttcacgttctgattatgtttaaatgatattttagtccagaggaaaatatctttatttttttcacttgatttcacattttttccactgtattaaatgggatatgttagtgtggagagagtcaaagagaattatagatttctgggtaccactgtggacaaaggtgagctcagcagtgaaagccacaaatgtaattttctttcaagggctgagaagagcaattgaagttgaactgtagttgaacattttctatttttatgtatcagttactacttttctttagccactatgaattgctaataagcaagccaatcccctaggaatagaactatgttgggggttgtgggaaagaataaaaaagaacagtttatactattttatggtattacatgcctgcttaattgaaggaaaggatttaaaagtttctggtttaattaattccactttgagactttattaagtcttttttcctttagttaaagtataaaactgtagatgtagatagccttggtctaacatcttaatgaattcatatcaatatggaaagtattatttttaaagtactttgactacatctaagtaaattcagtattgacgacatgggttttagcatcatacttgaaacatttctgcgcctttggccccctgaatttgttgtatatttatcaggatatatatttaagttatggccaaataagctaaatgtatctcctttttttagattttttcttgtcacatgtagttcatcttgcatatatgaccatgactgtggacatgatggtagcccagaaagtgtgtgcagttgtttttccaggagcataagcaaatccacacactctgagtcttctattcttttgtgactaatggcacatgttgcaagtcatttgccatcaggcaagagtgagggaatgtggctaagacgcagtgttttttttctgacactcaactaaccaaccccagtgataatcagacacaaaagctgaccttccctagtgtcacatgttatctggccaagactacagtttgtgacttcttggctcttacatctggaactaatacttcagctccttcagtgcagtgaataaaataccattttatatatttaagctgttacctctttaactgttggaataggtcctataaaatgtgatacaaaatgtttaatgaagagtaaaattttatggaaatcagcattactacatagtaaggtgattttcagtagaacaagtaaatctagaaacctttttggcaggaggacagagggtaaggagggaaaagctcttttcagtctaggctggcaagaagggggaattatttctgcctcagatttgttgactgtgcattttaatttttgtaaattggggaaagtttcttatctttgtagaattaaaattattcaacatttatttttacagcagccacattgccaaagagttcttcctttagtagatctggtccagggtcacaactaaacactaaattacaaaaggcacagtcatttgatgtggccaggtaagtttgcttgtttttaaatgggaagtttggttaaggccattacctgattaaatcataaatttgaccatgaatcatctatattctttttgttgttgtcatcttttttgtaggcttttgtagagtgctaataataattttcttaatttctggatagtgtcactagtttttatcattaatttgttgcagagatgagagaaatcaaggacataacatttccttaaaggctttgtgtatttttttttttttaaagaggataacaaatggatagtaataaaatgtttaaaaacagtaagataaaattctgggtataagggaaaaaagcaaatgaactattttatgtgtttatgatttacaagtttatgtataaaatttttgtatgaagattggagttatagttggccttatttttaattctatctcagataatcttgtggagtttatatgggtaattagtaaaatcctattaaagacgatttattatgaaaagaattatccagatagtggacaattcacattaatcaaatgtgtggctcaattttattaaagctgacatgacattattgcttatgttttggccaaccttggtttcaattattacctttcatatttttattttactcctatgttttacccttgcatactgctacattaagaagagaaattaagtctcttttaagccatctcagaacttttgggccgggtgtggtggctcacacctgtaatcccagcactctgagaggctgaggcaggaggatcgcttgagctcatgagtttgagaccagcctgggcaacatagggagaccttgtcgatacaaaaatttaaaaatgagatgggaggatggctggagccagggagatcgaggctgcagtaagctgtgattgtgccactgcactcttgcctgggtgagcctgcctaaaaaaaaaaaaaaagcttttggaatttatcctgtcttatgtcaatcctcactagaaattgttaagtgaatcaagtcattttcccactttcaagagaaaagcatgttgaatataattcagtgatgccttcattaccttttaaaaatgatttaaagaaaatccataaactgaaaagcactgtgccaaaagctttacattaactcattcttccccatgagatgattctgttactctctgttatagatgagggacaagctcagagacattatgttactcgtgcaacagaacgtaactcataagtgacagagctgagtcaaactgagatgtctgattttaaggcgtgtgttcttaactatgcaagttttctctaaaaaacttaattgtaggatacaggtatttatttgtgttccatttaattgcggttttacccttaagatgcctcaatatgtattgggcatctactttgccaggcacatcattaatcctattcaaccccatagctacctatgcagtagatgtctcaagatggtgcatgaggaagcacacccagagaagctctagtcctcacccatagtttacagcttagtgcatggtggagctgagagttaaacctatatcatcttacactaagttcctttttaaaaaaaattctcctgggctgggtgcagtggctcacgcctgtaatcccagcactttggtaggccaaggtgggcagatcacaaggtcaggagttcgagaccagcctggccaacatggtgaaaccccgtctctactaaaaatacaaaaaattagctgggcgtggtggcgggcacctgtaatcccagctactcgggaggctgaggcaagagaattgcttgaatccaggaggtggaggttgcagtgagctgagatcgcggcattgcattccagcctgggtgacacggcaagtctctttcttaaaaaaaaaaaaaaaaaaaaaaaaaaaattctcctataccatgctgaagttttgagtttattatgactttgcagaagcaattttgaaatctgctttattgatttgtgacattagaatgaactatcagtattagtgaacattagtgctattgaaacaactgttttatgttgtcacctttttaataacttaaatttctagccaatttttgcaatgcagtattgaacttttgggtacatcttcatgagtttttagtctatttaaattctcaggaatttggcagaaaactctgatgtgataagtgtaatctgggacaacttgtgtatgtaacacccaacattcctggcgtgtagcaactagatagttagcttcttgacaaataggtgggagttggaatcagcaaaatattagttagttaacatgagagggttggtgcagaagtacccacagcagaatagatcatggtaagtgttttttattaagaaattcataaaaattgaaaaaggtgaattcatataagtacttctcgagtgtttgggaggtatttcctatacttgaactgtatataatagatataagtgcatagataacacatggaaatgatgattaaaaagttcagtatttcagtaagattgtgcttttacatgtttgaatagatatttttgttgaagtgaaattgcagacagagcattagctgtaatctgtcctggaaggggaatgccagttttactgtctgagctcagccattgggtttaattcagatgtcgaagcttaacaagccattggtaccagtgtgatatttgtgtggacagtggcatctgaggaactaatcactaaggaagtgtagacgcagcctaactactggcaagtgtgtccttgggccagctcaggattgtggcacattggcaaggagagatcagtattggattgtagtcgagaaagtgaagctgtctccattcccactctgcttatgtgtgaccatggaaatgttctgttctctctctctctgggaaactgtccaatgggtctgaatttaaacttaccagaatggagtaatttcacttcattaagaaatgggtcctgtatattcacgtatagaaagttaaaacattttggagaattagtacctttaaaggcagttattggtttgcttttagcattgctttttaaccaaaaaagaagtgttttagaaattagaatagcctggacattattgttttacctcagttacaagaggtttttcatacttttatagaacctttaaattattatatatacaacttgaaacagcctctcagtctattgtgtttatccatgattctggaaaaataattatctatttgagggaaatgtttatgatcttaaaaatgggaaatacccatggcaaaaaaaatcagaagtagtgataataaaatgaataaaatatgaaagttagagatgattatctagagaagttcttagtttactgtcattaaggaactttaccaggctgttccttatggataatcctctttctctcctttttcttttccccacagtgtcccaccagtggcagagtgggctgttcctcagtcatcaagactgaaatacaggcaattattcaatagtcatgacaaaactatgagtggacacttaacaggtatttacaaataaaaattagtgaaatatgatctttgttttcaatgtaaactgtttctagatattgggtcatagatattttccatgtctgtgtgcttatttcttggcagtgtttcctttgtctctgttatctcatgttcttatccactgataactctttacatagttatatcattctctcatgccccattgctttgtggtaaaatggaatatagaccagggatactcctgtacgctgaaagccactgatatgcaaatcaaggcactagcaaagaaacacttctttgaacaaaaactagcttcaacttctgaagtccagctttgaacttgatgaacttgaagctgtctgttcactaggttagagttggaggcagcaggcagggtaaaagcagggagttgagaacatggctctgtctcagataactgcctagatagggctcaccactttggatatttctttatctattaatataaaaggccagagttaacttaggtgatctcaatggatttttttaaaagaagaatgattctgttatctacgtcagaaggatagacaggaattttagcatactgttcaaaatttttctcacgaaggtttaaatacttgttagaaagttataaagaaggctgggtgcagtggctcacgcctgtaatcccaatcccagccctttgggaggctgaggcgggtggatcacctgaggtcaggagttcaagaccagcctggccaacatggtctctactaaaaatacaaaaattagccgggtgtggtggtgggcacctgtaatcccagctactgaggcaggagaattgctggaacctgggaggcggttgcagtgagtcaagatcatgccactgcactccatcctgggctgcagagtgagactccgtctcaaaaaaaaaaaaaaaaaaaagaaagttataaagaaaagcataactttaatgaaagaaaatagagacctctgatatgaatattaaatgttaaagggaaaaactaactgccctctaacaaatatgaaaggaagggaaaaaaattaggtttcctgtgtggtggagtggggtaaggggaggattataatccaaaacacttttaagaaatgattcttactattttttccttgctattacttaaaattgcaatttttactcccaaaagaaaaaaggtatcttatgtttaaaaatgtcagagttggacgagattttgaagggttctaatctaatcttgaactctggtccctttaaggatctcagcagtcaccccaaataagcatgtatttatgtttgaatgggtgaatagtaaatacacacagattctcgatgtgtcatactgcctcataaagcagtagctgtcaaaaccagcctaccttatgcaggctctgcttttttttttgagatggagcttcactcttgttgcccaggccggagtgcaatggtgtgatctcagctcactgcaatctccacctcctgggttcaagtgagtctcctgcctcagcctcccaagtagctgggattacaggcatgtaccaccacgcccggctaattttgtatttttagtagaaacagggtttcaccatgttgctcaggctggtctcaaactcctgacctcaggtgatccacccacctcagcctcccaaagtgctgggattacaggcatgagccaccacacccggcccactgaaggtatatttaatagcatatttttaagtactgttttacatggtttgtttgacaccagtgctccatacaaacccagaactacattgccaatgaatccaaaaatatttcttgaaaacgttggtgtttgctgtgagttgattaaaatagtattcaattgagacattgattgagaaattctctctttcttggtgggatgtgtgttttatgaatgaaatgcagtatctacattccaaatataatgacccaggcacttgagcatttagaacttttaaatatctgaggcagaaagtaaaatttgaaatatactggaaagaaagcagattttgatattgtttatctgcatacttattgctactttgatccagcaagaatttaaggtgggaattttacttttgagccagacctttgtatagtcatgtcaagtagaataatttattacagtaaattttaaaatgggaataaacaatagaaatttaattttttttccctttatgtacttaggaatcaatatgaagtatgttttatactaaattagaatgttgatggaaacagctgatttgttgaggtggatggaacataaaggtcattgtcttgatcacaattataaaaataattttatgaagtcagaatccccaaagcagttcactcagctgcaggagaagcaaaatatcaagaaagttgagaaaaggtttcagtatataacatggcccaaaagaaatatataatttatatttgtaatctcttgtttttcatccttcttgcttttgttttttgtgggtttttgttttcaggagctaaaaagcacttcttttctttctttttttgaaacagagacttgctttgttacccaggctggagtgctgtggtgcgatagtagctcactgcagccttgaactcctgggctcaagcaatcctctcaccttagcctcctgagtagcagggactacaggcgtgcatgcaccaccacacctggctaatttttttaaaaaagttttctttagaggtgggatctttgttgtccaggctggttttgaactcctgacctcaagcagtcctaccaccttgtcctcccaaagtactgggattacaggcacccaggctgaagtacagtgacataatcatggttcactgctgcctggatttcccaggctcgggggatcctcccacctcagcccccaagtagctgcgactacaggcatgtgccaccatgcccagctaattttttgtagaaactgggttttgccatgttccccaggctggtctcgaactcctgagcttaagcgatctgcttacctctgcctcccaaagtggtgggattataggcgtgagccaccgcgtctggccttaatagtggcactgtttaccccactgactatctgggttgatttagccgatacatcctgttggacaccctgttcttccttcatggcttgatgtgtaactgttgcatgcccttaaaagagactgccttataaaatagagagggatcattctttaattaaggttatgtaagaagctctagaactctggtattcctgttaataatgctagcccttcttctcaaagaggtattttattgttgcattctgaaacaatgaatatgctatttggtaattcatctattaatcagaaaagctaaagtcttagtcattgttttaaataaagctcatttcatgtagttactctctcctttctagccatacttccctgcccaaacatggatgccagaagtggggtttgtgtgcttgggatttctggttttattcctatgttcccttataagccagtactccaaaaccgatatccctttatgtacctaggtttccacagaagagttctgtgcactcaaagctcaactgtgtgttgtccaaatgtgctaagatgctatcttagctgttgctgatctatttttaatattttgcaacattgatttaggacatatgtagacaaatagtagaattacaagagataattgtgatcttctagtgtggggattggcaaacattttctgtaaagaatagcacaataaatattttaggctcataggtcatatgttctctgctgcaactactcaactttgccatcgtagcatgacaacaaccatatatcatgcttatatcagtggatatggctgttttaataaaactttgcttaccaaaacaggcagtgggccagatctggcctaagggctataatttaccaatccctgttgtagattattttcctcatttcacagatggaagaacttcattttagaaagttaaagtagttttgttaatgtcacatgccattagggagtcaggactagaatccaagtcccctgatatccaggtttagagctagttcttcacatttattgttaggctttttatgtgtaatagataaaatattaacttccttttttatagttctggagtaagggcaattgttacaagtgtaaattaaatcacccactaaagttttgttaattctactttgttaccaacattctagatacaatgttacagactaaagaaagtgatgcctgaactttgctcattccattgtaccacagtcctttagaatcttcacatgaattcagtagattgttttttattcttagatgctcccaaaacacacacgtgctcatgtatgcacacacatccagcaggaatgtgttcatatattcaccaaaagttagaatgctcactattaatagtagccctaattgaagactaactgaatgcctatcaacagtataatggacaggccgggcacagtgactcatacctgtaatcccagcactttgggaggccaaggcgggtggatcacgtgaggtcaggagttcgagaccagcttggccaacatggggaaaccctgtctctactaaaaaaaatagaaaaattagccaggtgtggtggcgcatgcctgtagtcccagctattcaggaggctgaggcagaagaatcattgaacccgggtggaggaggttgcagggagccaagatggcgccactgcactccagcctgggtgacagagcgagaccgagactccatctcaaaaaaaaaaaagaaaagaaaagaaaacagtagaatggacaatgaattaggatgtaatgacacaatgatacactccatagcagtgaggattaatgttctacaactctacacgacaatatattgagcaaaataagccaggtggaacagcggacaggctatttggttagaagttaggctaccttggtggtagctgagtctaaaagagaggcaaataggggcatctggggtgcgattatactctctttcatgacctccatagtgtttgagtattttcactttggaaaattaattcagctgtgtacatgtgcacatgtatatatccacatgtatccgtatgtgtgcttttctgtcaggattttatatgtaaataaaagttgaactattgtcagtaatgttacctgccattagagcacctctcatgtgctaatgtgatgctaagctcattgccccaatggatcatagactggtttatctgaaatgagcaaactaggatccagactacctggcccagtcactcagcaaagtctagactaagccaggactagagcctacagctccttggttccctgacctctactgctggccatgcaaaaacacatccagttttgtggtttttgatgaggtgacgtttgaataaagaaatagcaaaaagcaaaaacatatacaccagaatcttcccaacaaaattgccacagccttccattcctctgtccagcagtcttcctgggaccacatcttgagaggcagtgctggaaaggaagacgtatttatttctccctctctgactgtagtttatttaaactgagtctcctactgtgcgtttgtctgatgtctaaggccactttcataccagaagtgaagatgtttatgattattttaagaaatgagagcttattttgagagaagagtagaaattccaggaattcttcttttttttttttttcttggctaacataggaaatgtgttttgttttgtttttttaattgagacagtgtctcactctgttgcccaggatggagtgcagtggcataatcttggctcactgcagcctccgcctctggggctcaagcgatcctcctacttcagcatcccgagtaactgtgaccacaggctcatgccaccattcccagctaattttttgcacttttggtggagatggggttttgccatctggtcttgaactcctgagctcgagccatctgcctgcctcagcctcccagaatgctgggattacaggcacgagtgaccacaccaggctggaaatgtgttttaatcctggctattagcgcttcctgcaactttttttttttttctttttaagtctgtttagtgaaacagtttcccggagatctctccgaggtcccttcctcctctaagattctccgaatcttccctgaatttgcctgaggttgagcagggtggagacagcaggtggtagcagcggcaaaagatgttaaacttaaagagaataactttcaagtttgtaaataaagcccaatacaaataaagatggtaatgtggacaaaaggtcaggttatattttgaaactctaaatctttcacatggtcattctttatcaaacatccatttaacaaaaatttattatgtgtcagatgctgtgctctgtgtttctcctctttttcattggggcttaatttcctttttacaaagccctgcggtagtagcaaatgttatttaaagcattgtgattgcatgaggtcatggagtagtccacatacgcagaaccctggtcctcctgtacagtgagtatttgctgactcatctgtatgtccttttcctggttcctgtttaggtccccaagcaagaactattcttatgcagtcaagtttaccacaggctcagctggcttcaatatggtaaggaatgaaaagttctttggtttggataaagtggaaacttggttagattggtgtggcctcatgggttttagattaataccgttttttatgggggaatatgtagaatttgcttaatttcagtgagttgtaatgattgcctcttttataatactatttcccctctcaattttgaaaaatacaaaagcagattaatacaataaattctgaaggagtgataatacaacttaacaattctcaactcgtgaccagtcttggctctccctgtctttgatttctttttctttttttttttttgagatggagttttactctagttgcccaggctggagtgcagtggtacgatctcggctcaccgcaacctccacctcccgggttcaagcgattctcctgcctcagcctcctgagtagctgggattataggcatgcaccaccatgcccggctaattttgaatttttagtaggacagggtttctccatgttggtcaggctggtcttgaactcccaacctcagatgatccacccgcctcagcctcccaaagtgctggaattacaggcgtgagccaccatgcccagcctctttgattattttaagccaaatcttagttattatataatttctactgcaaatattttagcttttatcttcaaaagagagggattttcctttttttcattcattattattattattacttttgagatggagtctcactctttcatccagatggcagtggtgccatcttggctcactgcaacctccacttcccaggttcagcctattctcctgcctcagcctccttagtagctgggactgcaggcatgaacccccacgcttggctaatttttgtttttttagtagagacagggtgttgccatgttggccaggctggtctcgagctcctgacctcaggtgacctgcccacctcagcctcccaaaatgctgagattccgggggtgagcactgcgcctgaccgactttcttcttagcacagtcataacagcaatagctcacctaagtttttcagtagtcatccttatcattaaattaatcagggaatgttcacattccttagagtgcctcagaatgtttttatagttcatttgttcagctcaggactgaaataagcctgtattttgcaatacttgagttttccatcttttatgtctcctttaatctataaatttccccttgtcttgttctctgcttcttttcccaagtcccccaggccgccccccaaccaaaaaaaaaaaaaaaaaaaaaaaactccgttaaaaacaaaccagatcatttgtcctgtagtttcttaatggcttaacttttgaagagtgcgtcactgtgggattgtctaatttgtttctgtatttcctgtaaattgataattagatctagagcaaagtttcccaaccccagcactattgacattttgggcccgataaatctttgttgttgggggatgtcctgtatactgtaggatgttcagtagcatctgtggccactactcactggatgctagatgccagtagcatgagctccacacccagcatgacaatcagaaatgtctccagactttgatagatgtgccttggggtacaaaatcttccctggttgagaattgcggatcagatttgatttttttttttgttttgttgttttgtttttgataagactgtgccagagaggtctctgtgtactctcctcaaaaggcacataatgtctctattgtgtaatgattttgaatagctatcgatgagcattgcctgggtcctacaggcttccttaaatttaaatgttaactagaatggtttcttaagaagtgtgcatgttatagctgtatgttggtgattgtccctggaaaataaactttgtctacaagactcactgcaaagttcgtgattttcttgcaggccacattgatagggttgtttcacaaatgatcaagctctaatgcagcttcctttgcccttctcttcccttctgttttgtatgaaagagcttgcctttggcagtagaccagaccagttaataaacatcttatatctttgacacacccagaactctttaaatcagggtattgaacagtatcctagggccccctgaaatataaacttaagatctaacattaatggaggttggttgacaatttattaggttgttctcatgataccagattatattgaaatatttattttaaatttctcatttataacttatcctatttgagaaaaacgcttgaggcttcttctgttagaatgttatattctggtgctacacactaaaaaagatattttaattaaatgcttataatcataatttaggtaagtgtggtgaaaaaacaagaatttcagccaccttctaactggtttacctaggactggctaattgtgagacacaaaaaggaacagaataaggaagagcgggcaggggtttcattttatttcatttgcatttctttttaaaactgggtatcttgcatatgggtatcttgcaaaactagaggaacagaaaaaagatcagcagttgccaggggatgggggcaaaggagggagttgctacaatcagatgtggaattttaggtagagctgacactattctgtatgttgtggttcatgtttgtcaaaactctcagacctatactctagaaggtgtgcattctactttatggaaattataacaaaaaaagtttatagcacctaaggaaatttcagaattaagaaggtttcttaatttttggcattggcaaaaccagtttcccattgcatttgtcctgttgacattctagtgaatggatgtgttgtcatgtatcttcttttgatggtccagaaattgtttagtaaaatcacattcttggacttgccaggagaatgtttgctgtaattagctacttgggcaagttcattatgaagaatgatggagattgaatcctgagattgaggaagaggaaacacttagactctgtggctggagttcataaagatccactgtgtaggcctagattaaggggtggccagctctgcccagtgggccgaatctggcctgcatctgtttttgtgaagaaagtttttatcgtacaaatagccatgcccattcatttatatgttgtctatggctactttctgccaaaatgacagaattcagtatgataaggattgtatgtcttataaactgtaaaatatttactacctgaccctttactgatagtttgtcatttcctggtctagagcagaacatttaacaatatagagctgggtatggtggcttatgcctataatcccagcgatttgataggctcacttgaggccaggacagatcagcctgggcaacacagtgagacccccatctctacaaaatattttaaaaattagctaggcatggtggcgcacaccttgtaatctcacgtttgggaggctgaggcaggaggatcatttaagcccggaaaggctgtggtgaactatgatcttgactgcagtgaggctgcagtgaactgtgatcatgactgcagtgagtctgcagtgagctgtgatcatgactgcagtgaggctgcagtgaactgtgatcatgtcattgcacatcagcctgggtaacagtgagagctcatctgttaaaaaagattcatggaatatgagtgtattatatgttaaatatgcaaaggttggggaagagtatcattataatcatagcatttgttgaatgaggaacactgtcccaactacctgtaattttatctttgcagcagtataaaataggtactattttgacaaaatgagggacaaagagactcagttggcctgtggtcaataagaaaacataacttttaaatcactaatgaatagtaaaaagcatgaattttcatgaaaccggattacagttaactttttgttgaataggaatctttctgacattgatcaagatggaaaacttacagcagaggaatttatcctggcaatgcacctcattgatgtagctatgtctggccaaccactgccacctgtcctgcctccagaatacattccaccttcttttaggtaaggaacatgggctctgatcaggaattgtatgcggagtatatgaattccaaacttggctttattgactatgtgtcttacctgattttcatccctgacaaggaaactaagtatccgtgaattctagagactctcatctaggtctatgttaatcttgggcccattttgttcttcaaagtacttgaagtatattagtgaaacaatgaagtaaaacatcaatagattgttgattttctaccaacctatgtcatcaatgcttaccagaaattttcacaacagatgccagcagcaagagagaaactgcatgagcctatgcatagagaagaaaccaaggagatcacacttgtgaattccacacatttcagtggtaacaaaagctgctagcaatgtagaaattataatcaggaagacaaagaaaattaccctggactgaaagacagtctcagtaaagatgtcaagagagtcacctgaggtccagtattgtgactggcatcctcatttacatccatgcatgcatgcacacgctgtccaggacagctctgtctcctggctttgaacataaaaactgaatatgagatcttacaagtacaaaggagaatgaaagaaagattaagatttctgacctgagtcctcaaactgcaggaaggactggggcaaaatcccctttaaatgaagagaaatagagccattactgtcagcacacacgtggtacaggagcaagctgaggaaactgtgactatgtaggaagcaacagatagctgaggcactttgcctgtgaaatcccacaactgcaacattggaagctgataatgaatgcgtaaaaaggattgggagacggtttaaacacagcaaagttaaaagtgtaaagtggggagggtggtgcggtggctcacgcctgtaatcccagcacgttgggaggccgaggcgggtggatcacttgaggtcaggagtttgagatcagcctggccaacatggtgaaaccccgtctctactaaaaatacaaaaattagccaggcgtggtggcaggtgcctgtaatcccagctactcgggaggctgaggcaggagaatcgcttgagcccaggaggcggaggttgcagtgagccaagattgcaccattgcactccagcctgggggacaagagtgagactttgtctcaaaaaataaaataaaataaaatgacataaataaataaataaataaaagtgtaaagtggaagaaattagtaaacaaagtgatttgttttacgaactatatagacattgcatgtgtttcttagggggtgaaatggagagatgggaaagggaagagagatgctcctagtgagctgagctgctgatcttcccttggaggaatttaaggttacttgagagggcaatggaaatagcagctcccacttagtgctcaccatgtcccaggcattgttcttaccactttttgattattaactactttcatcctttggaattgtttcaattttggtggtgattcttaagcttggcactcagagtctgatgacattccaatattcattaaaaaactctttgtaaatagagaagaccaaatctttatattttccttactgtaaatgaaatttgctccatggcatggtaaaatctttaaaaatccttcttcataacttgtccaactccacccagacagctctgtgtgaatctatttttctttttccccgcaattgcagaagagttcgatctggcagtggtatatctgtcataagctcaacatctgtagatcagaggctaccagaggaaccagttttagaagatgaacaacaacaattagaaaagaaattacctggtaaggcagcctttatgttgagttaaatcatttagattaaacgaaattagagatttcctatctctaagacaaagatagaggtaaacataaatttagtttttgacatttttgccttgtaacttaactgaccttagttggagataattgttaattaagcttgtggatttgggtctggatagagaaataagaacattatgcactctgctaatgcaccgttgttctaacttgtaacttgaaatctgattataaactgctaaacaaaaattatgtaaatgttatccatagaatatacagcactaaaaactgatgagtattaaggtgattgcttaataccaccagtgcagaaatagaaaatcaaatcatctactgttgttttctcatgttgttataagagaattggaaactccttaattgcaggaacctattttaaatttaatgtgaacctattttattttatttattttgttttttgagatggagtctcactctgttacccaggcaggagtggagtggcgcaatctaggctcactgcaacctccgcctcccaggttcaagtgattctcctgcctcagcctctggagtagttgggactacaggcacatgcaccacgcccggctaatttttgtatttttagtagagatggggtttcaccatgttggccaggctgatctcaaactcctgacctcaagtgatccacctacctcagcctcccaaagtgctgggattataggcgtgagtcactgtgcccagctgaacctattttaaataatactcatttacaatgataaatccatcatactattaaaatattctaaggtggctatgaattattaatgatgagatgataatgatactaagaagcaaatgaaattatggagtcttttatgataaatactttgtcagtgtcattttgctgcatttaagatgctcagcagttaattggtctggtcagaacactggctgtcccagtttattgtctaaactaaattaccttttgttcactgatgaaatactattggaaatattttacgtgcaagcctgcatgttgagcaaagaatctaaatgttaatacatggttcatactttctagaacctttaaaatatattagaggatttaagacatccatataagcaatcacttcagcagtatgtgagtgggataaattcctggagagtattatagatgcacaacagacctcacttatggttggttggtgtagactggggaagatatgaggaattaaatgtctgtggaagaggtcacagttgagttgagagttgaagatgaatagggtcaccacaagtggaagtgagaatagttcaggttttgataacaatgagaatgaaatttcaatggcagataaggacaggaatgcttggaatgcagaattttctttttctgtttttagtagacattcatttaaaattttgaacaggaagcaacattatcagagatttcatttgtgcattcattccttcaacagccgtttattatatgcctcctacatactaggaatattgccagatgctggaattaaaaagatgtatagagacttggagagttttttaaattgagatgagattcacataatacaaaatgtacagttcagaggctgtcttagtctgcttggactaccataacaaaatagcatagaccgggcagcttgaacagtgggaattttatctctcaccgttctggaggctggaagtccaagatcacggtgtgcagatttggttcccagtgagggccctcttcgtagcatgcagacagcagccttcagtttttttgctcacatgggatttccttggtttgtgcatgcagagggagacagatctctcctctctctgttttctctatctctgtctctgccttttttttttttgagacggttgtttcgctcttgttgcccaggctggagtgcaatggcgtaatctcggctcactgcagcctccgcctcctgggttctagcgattctcctgcctcaacctcccaagtagctgggactaaaggcatgtgccaccacacccagctaattttgtatttttagtagagacggaggtttcaccatgttggtcaggctggtcttgaacttttgactttaggtgatccacccaccttggcctcccaaaaagtgttgggattacaggtgtgagccactgcgctcggcagtccctgtctttttataaggatattaatttatcataagggccccactctcaacggctaattttttttgttttattttgtttttgagatggagttttgctcttgttgcccaggctggagtgcagtggcgcgatcttggctcaccacaacctccgcctcccgggttcaagcgattcttctgcctcagcctcccgagtagctgggactacaggcatgtgccataatacccaggtaattttttatttttagtagagatagggtttctccatgttggtcaggctggtcttgaactcctgacctctggtgatctgcctgcctcggcctcccaaagtgctgggattacaggcgtgagccaccgtgcctggccagctaatctaatcttaaccttccagaggctccatctccaaatatcacattagggtaattagggcttaaacatatggattttggtgaggcgacacaaacattcagttcctaacaatgacatttagtgcattcacagtgccttgcagccacaacctctcttgtcccaagatactttcctcacctcacaacaaaactccatatccatcactccctccagcccctggcaaccaccaatctgctttctgattcttgggatttacctgttgtggatatttcatataaatggaatcatatatgactgtttatgactgacatctttcacttggcacaatatttttgagattcatccaccttgcagcatgtatcattacatcatccctttctgtgggagggggactttgaatttttttttttttttttttgagacagagtctgctcgtcacccaggctggagtgcagtggcgcaatcttgtctcactgcaacctctgcctctcagctttaagcgattctcctgtctcagcctcccaagtagctggggttaaaggtgcctgccaccacacctggctaatttttttgtatttttagtagagactgggtttcaccatgttggccaggctggtatggaactcctgacctcaagtgatctgcccacctcagcctcccaaagtgctgggattacaggtgtgagccactgcacccagccaggactttgaattttaagatatcagagtagaggataccatctcctctgaaatcaccaaaggtgagcaagaaaaccaaaacatacttgcccgctttcatctctaatcgctgactacagtacgtgaaggaagtctgtctaaagcagtgaagtccaaacaggaatgtgggaagaagccaaagatggatgctcacagctgcagatctcaaggcagagtgagaagcaatggttcttagatgtggaccagggactggcatgctgcacagggtggcaatgagtgctcccctggccggcgttggtaccaaggaggattgcgtgaggccaacacagaaatgaaatagacactgctgaggacagtaagggacaaggatgatgggattgtagaaaatgaagaaataaaatggacataaagtattagaaaaaaaaggatagaactgagtaatcattctaaatttataattgatgtgttaaagaaggaaactgaataatgggttagaaaaaattgttgactgactgtgatctccatagggatcagggcacagcttgttcttcagtgtgaaaagccgaatgctcacctttcactctgctttgagaaatcttgttagaatagaggactcatcagcacggttacaaggcaaagggaaggagggagagagacagagactcatggtccagaagagagggggttaattcctagggcaagctcatgggaagaagggaaaggatggagtaacagggaaggaaaggagtctggatggtgatgtagaactgctagataaggatcttttagaaacagtgtttggcgtggaggagaagatataaacagagaggttaggcaaagggggttttcgttgtgctcattaacaaggacacagaagcttagggagttctgggtttgggtttgtactacaaatttcaaatacattggtgagttttcctttgaaaagagtccgttgaaaatcttgagttttcatagttgctgtgttccttgtctgaagtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggtaagcaggcgagagtggagccacccggagttagtgtgcgatcaccccttttcagaattatccaagtgatctattcacgccatctttgtctttttacaattcagtagttttagtatattcccaaagttgtgcaaccatcgtccctaattccagaacattttcatcactccagctctttacccattaagcagctactccccatttctttctccctccagctcctatcattaattttactttctatctttctagatttacttattcaggacattttttataaatggaatcatcaatatatggacttttgtttctggctttcatttagcataatgttttcaaggttcatccacattgtaaaatgaatcagtcctttattcctgtttatggctgagtaatatttcgttatatgggtataccacattttttaattcattcagcagttgatggtcattgtggctattataaacaatgatgttatgaacattaatgtacaagtttttgatgatacaattttgtaacaaaccactgataccagtaaagtgtttttccagactgttttctctgtatacacctatataaaaatataaaggtttatatggcggagagtgtaagggctgtataattttttaaaaaccactgtaatagtatcataccaattacattgttctgcaatcttcttttttttttttttttttgtttgagacagagtctcgctctgtcacttccaggctggaatgcagtggcatgatctcagctcactgcaacctctgcctcctgggttcaagcgattctcctgcctcagtctcctgagtagctgggattacaggtgcccgccaccacgcccagctaatattttgtatttttagtagagatgaggtttcaccatgttggtcaggctgatctcgagctcctgacctcgggtgatccacccgcctcagcctcccaaagtgctgggattacaggcatgagccaccgcgcctggcccatgcaaccttctttttaaactcttttaaaaatatgtctgggacatcctccctatattctatggaaggcttcgtaaatttagcgccatacctggaaaggggctaagcaaatcttgtctctctttccaattttagtacattactgcagaagcaacacatggttctttcatgtgaatgaaagataaaaatgaggaatttttcgatgtaaaaaaatagcctgagtgctgtgcctcaagcctgtaatcccagcactttgggaggctaaggagggatgatcacttgaggccagtagttggaggccactgcattccagcctaggtgacagagcaagaacctgtctcaaaaaaagaaagaaacaaaacttatagccataactcctttttttttttttgagacagactctcgctctgttgcccaggctggagtgcagtggcacgatctcagttcactgcagccttcacctcctgggttcaagtgattcacctgcctcagcctccggagtagctgggattacaggcgtgagccaccatgcctggctgatttttgtatttttagtagagacagggtttcgccatgttgcccaggctggtctcgaactcctgacctcaggtgatccgcctgcctcggcctaccaaagtgctaggattacaagcgtgagccactgcgcccggccccgtaactcctttttgttcagacagacactaacaaaattttaattttcagaatgaacaaagataggcaaacttttcttcaacgtaccaaaaaaatgatattctagagtatttattcagaattatttaatagacatttaccatgtatcaggtgtagttggatgacccatgagtcagaggcaattcccatagactgtcagatgctctgatatgtactctatctagcagtcgtcagagccagtcgttggagggagcaaaagcttttgtggtaaaaaggaaatgaatgattaggaagtggggagtcgcagacttttaaaacgagttaagtaataatttctcttttggtggagtaaaatcaactcttgtttgtttttgttcaggggtgttttagtttgattttactacataaattttccttcttggcgtgtcagtaaataagaaggagcatttttagttagcacatcaagcattcttgaaggcataaagaatggaattctaatggggaaataatcctgtcatcttacgtaaatatagtattatgtaaatataatacccagttctgtgtattccctttattcccatagaaggaatactgtatttttatgtaattttttgttttctaatgtgatttcttgtaatgtttaatatttcatccctaaaaggaaagacttcctagatgccatttttgtgaaaagacattgtgtagtgtaagaactgaaaaattagtaatttgtctctgtaaatgtcacaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctagtgagtgaagtttggttatactttgaaaatatactaagatggaaccattaaaaacagtaataatttttattatctttcatttgttcaagaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggtgaggaaatatgcctcttaaaagctattatattaaactggcatccttttctctaattcatttcatttacttacttattcagtaaacattaagcaactgtcttgtactaggcactgggaagcaaaaatgaagtagacagggtccttgtgtgaaaagtagcctgtcaaggagacaaactcagcaaatatttactgagcactgcttcgggccaggtgcttttgcagtttctgaggctacagcagggacagacactctgtcttctgggagcttaccctctgtttgcaggaggaacagagactaacaaaataaagtgtgtactgtattagaagatgaaaagtgctatggagagtgagtagggaagggaatagagagtcctagggataggaaatgttgtgattttaactaaggtagccaagacaggtctttctggatggtgacatttgagcagagacttgaaattaatgacaggctaagccatgtgggtatctggcagagcaagatctaggcagggaaatagtgccaaagtcctgaggtcgtagcaggactctgagatgccagttacagcaaggagactactgggtagagcaggtgggagctggatcacacagaacctgtagtccaccaacaggactttggctttactgtggtaattacaataaataagtacacttaagtattttagggggtcatatgagagctatatgtatactaaatagttggagacatacagagcacttttagtagttctgtcttcattttaaagcctatccaaagttgttataatatcacctggtttggtatcaagtgctgaactacaggggcatcaaattcatgtaaatattgcctgtggatgatcatatttgcctgtgattcctttatgttaggctttttctcagcatgatgtttttgagatgtgtccatgttactgagtgaatgactcttttgtttcttttcatcactgagtagtgtttccttatgtgtccattcacctactggttgatattcaggttctttccagtgtggaacttttatgaataaaactgcagtgagcatttatgtacaagtctttatgtggaaatggtttatttctcttgggtaaacttttaggaatggaactactgtgtcatgtaagtgtatatttaaccccataagaaactgtcaggctgggcacagtgggtcacacctgtaaacccaatactttgagagggcaaggtaagaggattgcttgagctcaggagtttgagaccagcctgggaaacatagcaagaccccatctctaaaaaaaaaaaaaaaaaacttaaaaattagctggcatgggggcgttcacctgtagtacctgcctgaggcaggaagaccacttgagcccacgatatcgaggctgcagtgagctatgattgagccactgactgcctgggccacagaatgagaccctgttcaaaaaaaaaaaaaaaaagagagagaaaagagaaaggaaagaaagagaactgacaaactgcaaagagtttgtaccattttacattctgatcatttaatttgtatttccctgaaggctaatgatgttgggaatcatcttacatgtttattggcgagtattttttactgtgcatcttcgttgaagtgtctgaacaaatcttttgcccattttttattgggctgtttgtcttactatttacttgtaaaagttctttttatattcttaacaagtcctttgtcagatacgtgttttgcaaatattttctcccaatctggcttgggtttaatttttgttagtggtattttttaaagggcagaagttttaaattttgatgaagttcagtttaccgttttttttcttttggtgttcatgctttttatgttctatctgagaaatctttgactaccccatgactgcaaatattttattttcttctagaagtttttggggcttaaaaaaataatttttacaagtttttataaattgaaaaaaacttaaaattttaagtttcatagttgtatcttatatgtttaggtctatgagctatttcaagttgatttttgcagatagtataaggtaaaggttgaggtttatatttttacatactgatacacagttgttatagcaccatttattaaaaacactggcttttttcccattgagttaccttggtagcttgttgaaaatcagttgaacatatttgtaatggtctattctggactctattctgttcttttgatctgtctgtcctttaccagtacctcaccctgttgatacctaatttttgaagtcaagtgatacgaattctctgttattgttctttttagaattgtttttggttattccaggtccttaacatttccatgtacattttagaatcagcttatcagtttttacaaaaatgcttggaattttgttggaattccattgaatttataaatcaatttgggaagatttgacatctcagcaatagtaaatctatggcataaatctctattttggtagttataaatttctctcagcaatgttttgtagtttgcagtgtccaagtcttgtagatactttgtaaagtttatccctaagtattttgtggcttttgatgctattgtatattgcatatttttattttagtttccagttgtttggtgccagtatatggaaatagaatttatttttgtatattgaccttatatctgtgattgcttaactaacttcctttgtgtgtcttactttgttgaccagaacctcccatactatattggatagaagtgggaagagccttgttccctctcgatgaaggaaagctctctcaccatagagtatagtgttaaccagggttcttgtaaacaccttttatcaggttgatggacttctccttttgctgagggtttttatgatgaatgggtgttgaaatagatcatatgttttttccccgcatctattgagataagtatgtgttttttctttcttattttgttaatatgatgaagtacatggttgccatttgaatgttaaatcagccttccattcttgggataaaccactcttggtcatggtatattaccctttattaaaatatttcactacattccatttcccattattttattaaggatctttttaaatctgttgaattcaattcaacagagatattggtttttagtgttcttctaatattcttgtctagttttgatatcagggtaatgctggcctcagaaaatgagttggaaaatattccttcctcctctattttctaaaagtgtttgtgttgaaatagcatttcttctttaaattttggtggcattcaccagtgaaggcctctgggcctggagctttcttgaagacttaattataaaattcattatgcagatatagggctattctgattttcttcttctccttgaatctgttttgattatctgtcaatgaacttgtttatattatctaaattattaaatttacttgtataaagttgtttataatattctctttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctataatattctcttattgtatgtaagtctgtagtatctgtagtgatgtctcttctttctttactgatattggtaatttgtgtcctctcactctgtctccgtgcttccttctccttttccttcctaaccccttcttctctcctttctcctactctatctctcctccttcttcttttcttgatcagtctatctggagtttgtttatttttaaaaaataagttcttggctctattgatttttttttttttagtaagcccttggctttattgattttctctgtggtatgtctgttttctgctttatttttgttctttttctcttgtttcttccatttacttatttggggtttaattttcttttctcaagcttcataaggaggaagtttagataattgattttggacctttcatcatttttgatacaaacattttaagctttaaatgtccatctaaacactgacattgccatatcccacaaatttttaatatgttgcattttcatatttattcaattcaaaatcttttttaaattttctttgtaatttcttctaattctttcacctttattgagatttatggctcagcatatgctctgtcttggggaatattctatgggcgcttgaaaagaatgtgcatgctgttgtaattaggtagagtgttccctaaatatcagttagatcaagttgattcatggtggtcttcaagtctcctgtgtcttgactgattttgtgactacttttattagctactgagagtggaacactgaaatcctgatcattgtggatttgtatatcttcctttcatttctgttcaattattgtttcatgtactttgaagtcctaagaaactccttatacatttgaaatttgagatttgtaaaggaaaaagtaccagaagttgattgctggaaattattttaaaatattacaaaatgcatgcacctttttaaagtatatttttcttttcttttttttttgagacaaagtctcactgttgcccaggctagaatgcagtggtgcgatctcggctcactgcaacctctgcttcccgagttcgagtgattctcctgcctcagcctccccggtagcagggattacaggcaagcgccaccacgcctggctaatttttatattttttgcagagatggggtttcaccatgttggccagcctggtctcaaactcctgacctcaggtgatctgcccaccttggcctaagtgtatttttctatgtgttaactctctttatgtgtcttttgttaactcttgaggtaaagtttcataaaatattctcctggaaaatttagggatgaaggccatgtgtttattaaactaagtattatcacctaatactatatgaccaagtacaatttttattaaagattgatgtttagactgttcacttattgataatatgataaaaatcaagattcccaaaaatgtaatgaagtgaaaaataaaacattctttgaagaaagaaaagtatgtagtaggtaatcagatattggttccctttctgtacagggattagcagatacttgctttggagataagtcagatctgatttgtgtattctgttttatcaagatttttttttctggtatggattattcataggagaagatgcttctaaattctagctattgagttaactctttctaccatttagacatgcattacacagagatttattccacataagccagtctgtatctaaaggtggttattccaaaatggactggtttttagcttctgatgaaaaattttaattaaggcatttttagtttttcaaacaaaaagtcaatacatagagctcattttttatcaaggtaaaaataaaagtcaaatattctttattataacctaggaaggctgccattttactgaaacatgcagaaactatacaggatattttcggctaaatttaagcagatactgttcttggcaagttaaccacaaaaattccaaacagcctgtgcagtgtggcttaacttttttcttgtgtcagttaaaaaaatagttgcttcaaaacttttgtgtacctgtttaaaattccatccagtgtggtggaaaaatatatacagcagctaagattctagttgttaaaaatctttgatttctgtttctaacttcaggtatacggtaaacctaagttcagccttagtaagtatcaaagttcaggatagagtaatagggtagctcctatttagaccactgagttagtttacaaacagtaggatcactgcatttgcatttgatcccggtgccattggaagatcattgcttcaatttatctctgtggagtagtacttaatgtacattttttgaagcttataaatatccggtaagtcaacaaaaatataagaaatatcagggaagctataactgtgtagggaaaagcatttggcaaacagagttaatttcttggaaagaaagcaggagccacacctaattaataattaaatgcagcttcaccatgcaggatttgggaagagtctgagaaaactgacttaagctctgcctggatcttaatgtagatgtggtagccttccctgtcattcattactattttcctccttccttcccaggaatctcagcaaatgcttggaagacttattccagaaaaacagatactcaatgaccaattaaaacaagttcagcagaacagtttgcacagtaggtgttttatttttaaagttgaccttttctttattctttctttttttgacatggagtctcactctgtcccccaggctggagtgcagtggcgcaatctcggccaactgtaacctccgcctcccgggttcaagattctcttgcctcagcctcccaagtagctgggactacaggtgcatgccaccacagccagctagtttttgtatttttagtagagatggggtttcactatattggccaggctggtctcgaactcctgaccccaggtgatccatccactttggttccccaaagtgctgggattacaggtgtaggccaccgcacccagccttttcttattttttaaccagcaagaatttccttaagtgaaatgagaacattaaaaaacattttcctcactgcaaattaaagtttttcttatctttgcgacgtttttctaaaataggagattcacttgttacacttaaaagagccttagaagcaaaagaactagctcggcagcacctacgagaccaactggatgaagtggagaaagaaactagatcaaaactacaggagattgatattttcaataatcagctgaaggtaactcttctatgtgtgcctgcatgtgtgtcctacctttaatttttttaactgtccaaatgattagttgctatttaatcacaggcagaaaaatttattatgccattgtgagacaatctaaattgcacttttctccttgaaaatataagaatgaatttggcatctataaattagggctgaatgagtggccccagcatgacatctatttttaacctgaatcatattttgacacatctccattcttttgtctgtttatagtcacatcaagttgattccaaaagctttatctttcttatgttctttgaatactactaaaagggattgttttcttttttaaaactaagaatttttctgccacttcttatcttcattgcgcttaaatgtagatctttattttgttacctcatttttaaatcttactgttttagtggagtaattgcttttgtctcttgtggcagaagtggtgtatggttttgtcacatttgcacagtaaaattgggaaaatgccaaaactctgaggaaatgtaaaatggttagatcacagcctttttcagatttggtgtttctgatttaactttacaactgtatcatcttaagaatgttaattcttggccgggcgtggtggctcatgcctgtaatcccagccctttgggaggccgaggcaggcggatcatgaggtcaggagatcgagaccatcctggctaacacggtgaaaccccgtctctactaaaaatacaaaaaattagccgggcatggtggtgggcgcctgtagtcccagctacttgggaggctgaggcaggagaatgatgtgaacccaggaggcggagcttgcagtaagccaagatcacgccactgcactccagcctgggtgacagagcaagactctgtctcaaaaaaaaaaggaatgttaattcttaaaatcagaacacaaacagtttatttcttataaacaatcatatactactttagatgtatgtagatattagcatttttgttattcttataagaaattggatgttatacttttttcccctccaaatatttgttttccttttctaacataaaattctttttaagccaattcagcttttgacagtgggaagaagtaaaactcctattctataattctaaaaacaaaattaaaaattagcatatttgaaacttttataatagttgacctttggattgagattctaggccaaattgtctagacatctgagtttgaggtatgtgtgctgttctttcagagtattaggtaatgatcttttctcaattgtacgattccaggaaagtgctcttaggggaaatattatttgagccaacttagtgtttttcttcactttgctttcatgcttacatggtgtgtgtttgtgtgtacactatatatgttctatattcatgcatatatgattatgtgtggtatgtcagtattggaagtacagctgtaaattaaccatctctagaataagtgcaattagaaacaaaaaaacaaaaaagaataagttcaattaaagtatgctcacattaactttcattgtcacttgtctcttttataagcaaaaaaaaaaaaaaaatagcactgttgcaaagcctatgttgctttttaatagtctcttgggatataaactgttaaatattaagctctcttctgaacccaggcagtagtccagatttgtgccttcacattgattctttttctagaaatttgactcccctaaaaaaggttcaggtattagaaaatgatactctagtgagaggcttttgataaatgtctagaagattaaataattttggtgattgaatttctgttgccattactaaagagaacacccttaatatgtggcgagtcacccctactttgtttaattgactatggctgctttcagtatcacagagtttcttacataaaggccaattttagcccccttttccactagccctttttccaaatatgcttatttttaaataagagtatttcttcttgttttttaattttaattttggctttctcttattaactttaattaatatgatgagtttaaaaaaaatcacaggtcaggtcgggtgtggtggcatgtgcctgtaatcccagcactttgggaggcaggtggatcacttgagcaagtggatcattcgagactagcctgggcaaaagggtgaagccctgtctctacaaaacacacacacacacacacacacacacacacacacacacacacactagtcaggtatggtggcatgtgcctgtagtcccagctacttgggaagctgaggtcagagaatcacttgagtctgggaggttggggctgcagtgagccatgattgtgtcactgcactcctgcctgggcaacagagtgagaccctgtctcaaaaaacaaacaaacaaaacagtaaacaaatcacaggtcagtataactatattgttttgttatttaacacgcatttggaggacttagtgaatatgttgtgttatggttattatctctagtattcctctcaaacctgataaagccaaaacaaacaattaaattggagaatcaaaagatttatagaatttgattgagacaactcagagatggatttatcatttagtctcttaagtgtcacttgcccacttttctttgttgtagccacactggaaaatgaaatactttttttgtaactttagagcatgtgtccattagcaaccatgttttcttggatgaagagataggccaggaggagccagtctcctgactcttggggtttcttcagtgcccctcttgatcggcagtgcctttagagcatccacgctgttgatgcaaaaattacttctgccttcctgggatgtgtcatttcacacatctaacctgatagtgtgaatttgttgtatcctaaaccttcctttccctaaaggaagccagctggagagtacagaaaagaaattagggcttcctgttcttttgtatttcatgttcacgtagattgttcacctggaagaaggaaatgcagttccctcattataggttagtactgtaacactggaggaataccttacagagtacagaattttaaaattagttgatcaggatactaaatctatattaagtggctggctccacaaatgaggataacatttaacaaaaattgattctcactattttgggtaaattgcaataagtcattcacctactttgatgcatgctcagagttatgtccagtttcttaggtataaaggtaatacagggaataatcgtaccctggttcagcccagattctgagttataagacagtgattaggaagtataggaagcgtatttagtcaaaaaactaaatacacttatactttccttttcttttaacatacaatctgatttagttctttctctagaatgtcttgctcagattaatttgtcttttgtgggtttctcccattttcttcagttcaggaagaattccttccttccctacccaaaatctgataagcaaagatagaaattctcaaagcattaattaaagaggaaaaagttacaggttaacaggtatttgtctcgtataggaagcaacctgttgaaaacataaggcatacttataatcgtgatcttctgttaaatggctccatattcaaagtcgtgggcctttaagtttctacctaatccatggaaattgaaggctcattttttgttttccaaaaaaggctgtttttccatgcgttttaatagatatttaccttttaggtgtcatatttatatattcaaaaaaagatcctaagatgtaaatatctttctatttaccacccaaaccaataattacttgagaaaggaaacaggaatcttactgtagcaaataaactttgcttttgggttttaaataagtctgtaaaaacagggagggtgggagaagaggagaaacgatagcaccctgaaatattgaagctcttatcctacaaattccccaattggcagcctttgtacttatgctgcccttgctatgcatgataaattttaggtttttgattatcaaatgaaatatttgaacagtgaattaaccaggaataattaattttgttgtgattattgctagcatgaattagtacatcttaaaatagttttaattcagtgggtaaaatttatttaccattaatttctgcttttaaaatgtgttctgtatgtaacaaataccttattaagaaatcggtagtcttctcagatccacgttctagaaacaacaatttaaaattattatctatgacttctacttcagtttacatgaaaattaaaactcccaacttttttggagactctgtgtaccaaaagggtagtttttcttacacacagtgcttacctataggcataaaattatgattcaaacaagtgttaaataacattactgctaggactttttggacagtagcacctgactttaccttgaccttggcgatgtcagtagttactgtagcagttttccttggcactgacagcctaatgttccatattttaatgtcttagctctaagatggagcagcagcacaaagtacagcttgtagttttccaggctcctttaagaggtcaaataaggagaatccaacacccaacggagctagattttatgtttcatgttgaaaagttgagtccttgttggttcctgtctagtcagtgtgtactggacaagtcctaatgtgaatggccgtttacatttgagcatttctttcttccagtcagtggcaatggaggaggcagtgttgcagtgcctggcagttctcctgggctgcgtcatccacttagacttctttctaaaggtctccatgccctactcaggcaatgcacatctttctcagactaagaatgatgaaccatctccagctctgtgcttcagtttcccctgcgcagatgagtgctcagtgtctaagatagcatttaccatgaagtactaagccttctttataaaagttaattactagttattattaatcgtggagtatgattgattctttcctattgacgagttgcgtgtgtgtatggtggtgtaaactgaattacaggctggacaaggtactgtatactgtagtcttgtctttttaacaagcattttagatcattgaatttgagcttgtctgcaaaaatgtgaaagcgctcagttgttatttgggtcatgtgcatgtttccatcatgggagacatactgtgatcagtatactattccaaatgtgtatagcattttattttctagcaaagtttgaatatttaagactaattcacaattatgatttaattccttagtatacttgggaaatccaggcttctaaaattagacacaagaggctgttagaaatataaattctccccataatgctacctgttctaaaaattgctcttagaaccgaatcgatgttgaaatgagaaggccagttgtagtaaatgaggttgtttgcttaactaaagcctttatactcttggtttcagacactagctttcatgggaggctcattcattatgaaggcagtgaaaggcaaaatgtttagcaaccagaggaaaaaagaaaagagctggagaaagaactgcagaacagagtaagaagtcagggaaaaaaatgcttgtgaagggaaacaatgaaggaaggagaaagactcagaaagaggaggcacagagacagtgagagaaatcagtatgaattcaaatagccatgttgctttgtcataattagtagaataatgtttggttctttcattctgttcaagctaaaattttatttttacctatatgatcctttggaaaagacctcttatgcacagaagtaataaagtgctctaactctcattctgtcagattctgtgccataccagtaggctgcttggttgagttttttagttacagcatgggttttttttctttttaaggttgtaaaaatttaataaaagataatttgggaaagggttaagaagaactcagtcttttgaaaaaatactttcttctcttaatggaatattgctttgtgactgaagcagacactttgagggaaattcagattttcaggacaaaatggaatcagttttctctttctggtaatgcttcccaagggtacttcccaaagcctcatggcagagggtgtctgattacctattactattgcagagaggacaagagcttctagctcttctgcccacctccttccacacacacaccttgctccaatctcccttagcacttgtgacacattgactaccattttgtgccatgggaaatagtcttattattttgttaaatactgacttcaaatttaaatttttgaacatgttttcaaacagtatatcccatttcagaatttaaataaccagtcaggccaggtgcagtggctcatgcctataatcctaacactttgggagttcgaggcgagtggatcacttgaggtcaggagtttgagaccagcctggccaacatggcaaaatcctgtctctactaaaaatacaaaaattggctgggtgtggtggcatgcacctgtaatcccagctgctcgggaggctgaggcaggagaatcacttgaacttcatcacggcagaggatgcagagagccaagatcatgccactgcatcccagcctgggcaacagagcaagactccatctcaaataaataaataaatgaataaccaatcagtatatatttttctgtatagtcctctcagttttaatgcatcgagaatgaataaatgtagcctggtacagtgacatatatctcaggaggctgaggtgggaggatcacatgaagccagacgttcaaggctatgatcgtgcctgtgagtagccgctgtactccagcctggacaacacatgtctctaaataaataaattttttaaatgaatgaataaatttataattttatgataaatgggctatcagtttaccttgatttgggtatagtttctgtgttctgaaatcgttatttttcaaaattttccatacaggcacaagttctcacctcatggggtttgttaactggccttctttaatagctcttcatttgtttcacaaccacttaatttgaaaaagttaatgtattttaaaactccaaaggccttctataaattttgataccgtatactacatattatccctaggtgagaaataatgtttatttacagaaaagcacttctactttggactttttatggatgtgatattatagataaacacctgaaatttctgatgctggtagctacatcattttttaatgaggtcaatttaatattaacagtatgaagattattataaatgttatatgtgagctaaataattttatcttgatttatggttttgagttcatgaaatttaagtaattaagttatgtttgtttttgtctctcatttccaagagacatcctgaggcgaaccaaaagcaaaatccttcaaaaaagttaaatatctaaatcagtaaatacatttccattaactgctggtctcctttcatagacccctgttgctatttttttctcttcatatacattatgcaaagtaatgtttgtgaaaaggaatcctatatattgttcaggcgcatgctactttatatttcaagtaatattgtttcacataatacatgtatttttgagtgtctctaagaccagatgaaggagaaacagtcacagttattaaatcaagtgattctgtgccttttagcttagcaatagaacaaacttcttcagtaaacctgagccacatttctcaggggaaaaatagttggattttcttgggtattcaatttgtcaaacagattgcttttgaaatactttggctctgtgccataggatgtccaaagatgttttatggttcaaatatcttagttctttaggggaaataagtgacttttccctctttggtctagggaagaaaattaaaagcaagttgattttcgtttatcttaactaatacaaaacagaatcttgatatgccagtaatttgttattgtggttcatgagctgtgcttgatcaaagaccccttgagactaataaaagctgtgagctttctccaccagaaaaatgcccatataccccaagtctgcatgcaacatagtatccacagggctgaagcttattcatggaacctggttaagaaactctgtattttcatgattctgcataaattgtgattttttaaaaaaaacttattttaatatttaatattaatatttaatatatgtgtgtagtatatatactacacattttatagttttattttttctgcataagtatttgttacatgcagctacaatttcttgactacttaataatttcttatttaagaaagtactgtaattatgttttattggaagataatatcaaattattacatactctacctagtgtaaaacatgtcatacacttgaatagaattcataaaagaaaaatcaacaaagttgtacactccgtactatattgctagattaatatccatccaagaaacaagtttttgtagaattactggttttagaaaaaaaaatcacttaactttaggaagaaccgagtgagatactgacttttgattcgtggtaatttgtttgttttctttctgttataatagcaaaataactgtgacaaattccatgtggatttaatagaatttgcagggtcatttaaatcaagttgcctaccaggaaatgttgatactttcagtgtggtgaaattttccttagccatttcccccaataatttgctcatttcctagatatgtaatttaatggcactagatttgtttgtcactttgaatttttttctttctgaaggagttaaaaggatacttcttaataactgtaactgtacttgagtctctttaatagtatggagaagaatgagagaatagtgtagccatctgctcccctatgtgaaaggactgggtattctacaaggactttgttctggcaaaggaaggagagtcattcactcatttttttaagagtatatatttcttcattctatagattgccttctcggaagttcaactttttaaaaagcttatcaacttagaaatcatccatgttctgcttatgttgattcatgccatagtaaactctttaagtccaagaaaagagaagacccagaatgcctgcctctgggcagcatgttgatttccttacaactgtgtatctcagcagtgtttgacttggatgaaggaaatgatagaaaaactttgccatcttgaaatctggatcataaggtgccagagccttctgttagcttatttgtcgtctgttattttatggttcctgcaagctccattccttggaggtgcttgaaactgcaacttacataatcagttcctaagatcggttcaaatactgctatactcaaaaacaagtgtgtttaaaaaatttaagtatcttttttcatgtatttgatacatttaaaaattatttttgaaactgtgtcataggtaggttttttttctgtagattcttcaaaatcactttttcttacaagcttttcaattttatagtctctcctaatgtattactagctttacttaaatccggtaatcaatgatctataaatccatatccagttacaagagcctagtatagaaaggaaatgtgcggtataattcttggggaaaaatgaaaaatcttcatttgtgcctatgggctatctattatagtatgttgatacatcatggccagtgtccattctggttgtgcagtacctgttgttgaatattttgaatatcactcatgaatacattttttcctggatgaaataaggacttttctttatttaatatataatcagattcctgaacatcaagctgaaatgttatttctcttccggcatttcttactcctttgtagggtttaatttcagctcagggttattttgcttatgcttttttcacttattcttgcagttaagaataaaattctaaataaaacagatactgaaataaataaatactttatttgtttgttagacattgtgatgaacaatgtctaagatttatcagatcccaaaactagaagaacacctaaagatcatccattctgattcatctgccagctcatatcagggacctgagattagaatcctggtttcttgattcccagttctgtaccttttttattttttatttttttgagaccgattcttgccttgtcacccaggctagagtgcagtggcgcgatcttggctcactgcaagctccgcctcctgggttctcgccattctcctgcctcagcctcccgagtagctgggactgcaggcgcctgccaccatgcccggctaattttttgtatttttagtagagacggggtttctccgtgttagccatggtggcgtaacttttaagtatagtcttttgctgtaaattattttttctgaacctatttaagaatttgatggtcttgaaaatgaaattttcattcatattattactgattatttattcttgattccaggttactatgaaaaccagtactactgattttttaacacattaaaattaagttttacatcccttggtatggcagtgagaaagatgatgaaaaatggacttctttctccctagggttgattttctgatctcagcactttaaacagtcagtgtgaggctgcatcattgctttccagtcttagccttcttttccccttccctctgttccacatgtcaggtctgctgccatagggaacagtccaatttgtgccttacaaaggtaccttttcctgctgtgtcctgcctggatgttcccagtgtcatctgctaggttccctactgaagccccttcttcctttctttttcctccttcccccttccttcctttccttttttccttcttcccttcttctccattttccccttccccttttcctccagtaccttcctcttcctaagtacctccccccagacccctatctccagttaaactttttcttttatctcattgttcttttaaagcctctcagcgtcacttacagtttataaaacatttgtgtatggattttaactttaaccttagcaaaattagtaggaaaaggttagcctaacccttaggatttttttccaataacaagtgcattttaatactgactttctacagacaaaccgtctacctttgttgttcaatctctgaatgaatctaaaggtaggaattttagggcctggaagaaacctacctgcccatctagtcttgccagtgagaaaggtgatagaagacgacagggcaaatcttagtccttaactctccccatagagatccctgggccatgtactgggaggaccagccctggttagatcaagaaatcagctggaaagataccttggctctactgggcactttgactcatctgatttatcgctggcccacataagacgagtttcagtgactcaatctattggtgaccatttgatttctatggaatcagggagtttcttcctcagcagacgtttccttattcttcctattttcaggtgtctaaacttgtgacttgagtactttaaatatcatagaatgcattttattttcagtagcctgctaaggaaattactgctattcctgcagctagtagtatcaagtgaggaaattggatccaaggtattcatcatcaaattatagctttttacttttaacctgattgctggtttagtttggggcagttagcgacttgaaggatagatttagtaagaaaagatgctctggaagaggagcaacttgaagaaaaatagaccctggggggaagaattgaggtcaaagaattgaggagcaaagagatgtccatttgttctaaggcagcttagtgaaaggtggaggtgaggtttgaatggaggtagtcagtgaagaagaggcatctgtattttcaaagccagtaaaggttggtgttgattgataatcaaaagaagcttaagttttattcatgatcatcgtcatatcttggaactggttacgttccattatgattgctgagcctttagcagcagagctcacctcctgcccttcgctagcaggtttcttctagagcagatcatggaaaatggtataatgtgtatggctcattagaatgtaatcttaagtggcctttggaaatcagtcatgtcaaaatgtggtgtgattctagctttccaagttgactttttccaactctgaaacgttatctcctaagtgtcctaggcttcccactatgaaatgttgcatgctgataaatagttgatgtacctgtcactcatgtcgctacatgaactgtttctcggttaattataggaactaagagaaatacacaataagcaacaactccagaagcaaaagtccatggaggctgaacgactgaaacagaaagaacaagaacgaaagatcatagaattagaaaaacaaaaagaagaagcccaaaggtgagtcttctttggattgtggactcatctggaaggaactttgaggatttactattctttgcttggcttctccaagtagttactgcaccagaaagagccttcagtctttagtgtgcatgtgaagtgtgagtgcaaacacaaacacgtgtatatatgaatctttgcatgtatcagtaccctctgaagtttttggttggttcccagagctctctcaagctactactatgtagataaatggaattatacaaggaaattgggacacttggtgtgctcatttgcatgctaatggccagttcacagccttttactaacagctaacaggggttggagtgcctggtttaaaatccaagccactgagctagtgccccacacagggcttctccagcagggtcagggtgggcctcttctgtttttcaactgcaaattaaactttagtacaaaagggggaaatttgccaccgctgcttagtgtgtaggatacagacatgtttttatctgtttttgtttgaagatttatttgtgatatttttatttttacttgtaacttactgtagtaaattgtagaaatttgtgtctgattttgttactgggtatttgccttttaaatgtcagttaattttagactccacgaaacaaaaatgaccaaatgtcccaatgacagccccgtaaattataaaagttggtaattgaaattagattaaggccaggcatggtggctcacacctgtaatcccagcactttgggaggccgaggtgggcggatcacgaggtcaagatattaggaccatcctggccaacatggtgaaaccctgttctattaaaaatgcaaaaaattagctgggcacggtggcacgcgcctgtagtcccagctacttgggaggctgaggcaggaggatcacttgaacccgggaggcggaggttgcagtgagctgagatcatgccactgcactccagcctggcaacagagcaagactctgtctcaagaaattagattaaaaaggcgaagaaacggatacttgaggcaagtcattgactttagtgggctgagttcagttaacctgccaagagctgtgcatactttcttatgggtatatagagtcttctgtttgtttttcagtgccagtggggaggtatctggggtcccagaccaatttacaggattgttttatggttttcttgggggtcagactaaggatctcctccttggatgttgattaactccatccttttcttacccccagagtttataaaatgcttttattattcacactataccacactgaactgttaaattcctacagtgtagaaataaacataaaatacagaaaaatacataaaatagcataatacagaaaatagcataaaaatataatatggaatatgtattccaattatatagataaaaactgcaaattaacgtcagaaattagatggttatacagtatatatggtgaccttcattggtagaaaatataaagtaattcttttttttttttttttaattttttattttttgagacggagtctcgctctgtcacccaggctggagtgcagtggcacgatctcggctcactgcaacctccgcctcccaggttcaaccgactctcctgcctcagcttcccaagtagctgggactacaggtgtgtgctaccacgcccagctaatttttatattattagtagagatggggtttcaccatgttggtctagaactcctggctggtctagaactcctgacctcgtgatctgccctcctcagcctcccaaagtgctgggattacaggcatgagccaccgcgcctggccactgtttttattatggtttttttgttgtcatgaataaccatatccttacccctccaaaaaatgtttttatactttcttaaaagacattttaaaaattgtaaataaaatgtttaagatttaagtttaaagacttctgcattaaaatatcacattcatacagagtagaaataaatgtaattttttgacaatggagaataaaagtataatttgtttcaattatgttcccgtggcagattcctaattctagccgatgacctgtgtgcgttagccatgtcacaggatggcagttcagggtggagactctgggaccaggctgcctgggattgaagcccatgcatgtatggctgtgtgacgtggacaagtcatttaatatctctgccccagcttcctcatttgtaaaataggagtaatactaggactaccaacctgattcgcagtttaaaggagttaatatatggggagctagttattattatgtcatttgttattacatattagtttcatttaaagtattttctgactttataaagtattatggaatgagaaaaatcattctcagtcttttactgtgggtttcaggttgaggccatcaaaaatttcaaggcctagatttaattacaattatctatttgtggtagctactttgaaaaacaaaatcaaagtagttgaagtcaataaaacaatcccttgctttcaacttcaggtttggggagcaatgtgtgtgcatgtaaatgtgttgttccctttgctggggggaaatttttacagtgttgggtgtattttatttttatagaagttatgttctctgtgttttatggctttgtttgtttgttttgtcagtttaataccagctttattattaagaagtatttttcttattcttgtaaccactttgtaaaatacatcagaaattttctgtgttttcctaaatcatgtgatttcttctcattcagaactggagccctgattcagttgccccatctgaacaacaatgttcccttgatgttcccatcccatttactggatggagctttttttgtgaaaagaggcaacagtagtgttaacttagagttgctttcttgctgtaatcaagcgtgtttgttggcagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcaggtattagaagccaaaaataattatagaaaataagtcatcttctctcccagagcctcctgaaaaatgcccctatctcatcagtacctgtcttggctacattaacagatgagaacgtcagtctcttattttgagcatggccagctcttctttccccagggtcatttgagatctgtgtaattctcccaccaccatgccagcctctggcccacgttacactggcatccacgagtcctctacggagctaacaagtggcgtgaagttccagtggtcttatatgctgcaaaagaacctgctgtttctctggtttgttatttccctccctggaatttctgagctgtttctgcaacagaaagtggcacctttcacccttgcctccactgatggggcattcgctgtcttcggtctgcattgcataaaactgcttttactttttgaaaaatgtaaaagcataatttgccttttctttacttctcttttctttcttctctttccttttcttttttctttgagacagtgtctcactctgtcgcctaggctagagtgcagtggcacactcatagttaaatgcagcttcaaactcttgggttcaagcaatcctcctgtcttagcctctcaaggagctgagactataggcatgcaccaccatgcccagctaattttttttttttttgtagagatggggggtctcactttgttgtccaggttggtcttgaactcctggcctcaggcgatcctcccaccttggcctttcagagtactgaaattacaagcatgagccaccatgcctagcctaatttgccttttttttttaaaaaagggataaatgaaagactgaacaaaaagataaatgaaagaccaatctaatcggaatagctagaaaaagctatcctttataatatctgatgtgagctagaatgtatttaagattcttgtgtggttgtgtgattgtacagttttgcaaataatgttcagtggaagcaagtcattgctttttctttgtgtggtaaattataccagttttgcttggtcatccatgtgcttctttagtgcttcagtatacagaaagaaaagaaagaaaaaacactttcaagctattctgtaaaggtttactggtccccagctacatagtgggcagagatgggcgtgaggtatggagttgcattaggcacctacctgccttcagatgcatgcagtccaggggaaagactggcaggtcatcagacctacagagtagcaaccatgtcataggaggggcaaattaattttttgatagttttttttttaatctgaaaataatttcaccattgatcttaggaagttagtttaagttcttcatgcgtcctcctagtataagatgaggatttatttttccccttcagtcagtaggaaatcttgcatgtcatacagttcaaaatcatgtggagataatacttccccctcgttgcttttcagataagataggtatatgtcaaaatacttgtagctcttgagtaaaaatgcccaaaggtctgttactagtttttgctaaccagaatccaaaatatcctccgctcatgtgcatttttaaacattttatttcatgtaaaatctaaattattttcatctaggtttcatccttaggctaattatttcccaaagaaatgtagaggaagagtgtcttcatcggggattatcagtataaccaaaatcagcacttagtttttatatgaccaggttaaagagcctaaaacatctgcattttcatgtttcagtatggaaactggtgcctctgttccctcccaaacaagttgactccttggctgattcagactttgggtcatatcctaactgctacattgtactcaacacactgggtagggaggagggcgggtattgatgctttacagatctgcactgctggagcccaaggaaagaggcagagacaagggacctttaggcagcctcgccgcacccaggcttggagtgacctttgtttagagagagtcactaatgaactctctcatgggtttttgttgctgacgtcagatttggctgtgctttggcattcagtatgtgtttcagaaattccttgaatggagggaaatagttcagaggttaagataggcaatagaggagaggttagttgtttggcttgttgtcatacatttgtgttctctgtaattatttatttttgtcccccccacctttttttgtaaacagaaaaaggtccacttaccatttctgcacaggaaaatgtaaaagtggtgtattaccgggcactgtacccctttgaatccagaagccatgatgaaatcactatccagccaggagacatagtcatggtaagaaagactccagtgagagggtcatttctgttgaagattagcctctgtcctctttttttcactttattcaacaattgtgagattgtcagtgagtatgaaacccaataatccagcatctagatttttaaagtataagctcaatcttctttcttttctattaaaatgaaagatggcatttaaaaaaatgtatcctaacatcattttaaaattgagttgataaagacagtgtgttcttatttttaaatctataaatgtctgataatttcagagtttagattactacttatatactatgagtatacatatatatgtaatacatatattttatatatgatgtatagacaatatatatactagtgtgcgtgtgtatatatatgtgtatgtataatatatactagtgtgcgtgtgtgtatatatgtacacatatatatacacacacaaaaggatcctccaaggtggaaggaggccaggagtctttaagaaatagttataagtgcaaaacactctatcaaatcattctcataattgcaataacttttgtatctttgcatcaaagcatcttttttccctttaattatgtgaacttttaattatgtaaaaagagtaatgaattatacagttaatctgctttcctactttgtaacagaaaatagtttagaattttgctttgttattgtttctttccttgaactaataatcattttatgatgtgactaaaactataggaaccagtttaagaaagaaaatcagacatggttgatctaaatcattttctaaaagaaaatagtagttccttgttctagttactctctttagagtcttagaagtagtcaactctgcattactcttaacattttttttttttttaaagataatttagattttttttttgttgtggttgacacaagttctcactctgttgcccaggctggagtgcagtggtgtgatattggctcactgcaacctctgcctccctgcaacctctgcctccctgcaacctctgcctccctgcaacctctgcctcccgggctcaagcaaagcgattctcccacctcatcctcccaactagctggaaccacaggcgtgcaccaccatgcccagctaatttttgtaatttttatagagatagggtttctccgtgttgcccaggctggtcttgaattgcctgggctcaaacgatcctcccaggtcagcctcccaaagtgctgaaattacaggcatgagccaccatgcctggcctagaatttgtaaagaactgtgaaagttaacaattgaaacaaacatgtttcttacccaaggactgtatgtctttgaagtataaagggtggtgtacaggtgattttactattactcatgcattcatcttgccatatacacatcatatctgtggatctttaataggctaaaatacctagaaataacaatatgtttggcacttagagaaatgaattcctgtgtccccttttttcctaatagctgctttctctgtaattaccatgggctagaagaagcaaggccaaacatcccaaattattttttcttttttttgagacagggtctcactctgtcacctaggccagagtgcagtggcatgatcttggctcactgcagtttccacctcccaggctcaagtgatcctcctgcctcagcctcctgagtagctcagaggcgtgtgccaccacaccgagctaatttttatttttttacattttgtagagacagagtctccctatgttgcccaggctccagatctttaaaagttaaaatcaccttaacagtagcaaaaacctcttcaagtatactccatggcttcattcagcacacagttattgactgaaacatgctgggtgccagccttactcatcctttacagaaagaactgttggtttgggcatgccactctgtacacacaaatggtaacttgagccagcggggtgtgtttctgtcagctttcctctgacttcaccacctgctgtttcctacaccgtggtttctgatagcctgaagctactttactcatactgcctcatatttgaagtagtgtatcctgtaaagcagattaattgtaaaatatgtaaacaccatataataggaatctaaaatttctgaaaatacaatgtcacatcagtgaggacctcattacaattttttttttaatgttaaacaaaccagcctaatatttttgaaactggattttgttgcaacacaaggtgcagagaagcagctcgctctcatcctaaagtaagggaatgttatgaaatgtgatgatgaggaaatgttgcaggtgatctgtatcttaatgagaaagtgttgctctttttcgggaacatatctgggcttcacttgtaatcctaggcctgttgaaaccttttcctcgaattggctagttaaccaccagcttgatgagatgcgtagagtttagatatgctgtaagaataaagcatgtcattaaacatatattttgccttgctttcaaacctttgctttcctggtggaggttaaaggggaatgggtaagtgttgcctaactgtcaggaagtctgcatcttattcaatgttttgtccttttaagtcacttgaattctgtgtaagtacacgtatctctgggtgttgttgcggcagtaaaaatgtgtttgagtctgtgtagtaggttgtgctttttaaaaaaaaagtaagtcgtaagtcttctcagtttgtgtactgggtttctttttgttagattccttttaaggactaacttgaatgctctgtgtttggcaagggattaggtcaagtctccatctcaggccatagacaaaaaggagttccaagtagattaaacataaaagataaaattctgggaaaaaaatttttttaagcagactattggaataattttctggctaagaaaggccttttgaagctataaaaaccagaagtcgttaagaggcaaaaatggacagtcaacaatatgcaaaaattaaaatgtctatgtttcaaaatatatgagaccaagggttacataaagggttacccctgttacataaagattccgaacagttcactttgaaagacacccacaagccttaaacaattggcagagggtgggaagggacattcacagatgaagtaaaaagtcagttatttaaaaaatacatgaaaagatgcttagcttcttgggtgatcagaaaaatgcaagttataaaacaaaatagcattgttcctctgtcaaatgagcaagtttaaaagtctggtaatatccagctttgtcaagagtataggacagtggatataatatacattgttagcatggttgtataaattggttaagcgatttggaaggcaatttggcagtgcctgtttagatttaaaattctcgttccctctgccccagaaattctatttttctccttcctctcattcttctccttcctcttttgggcacatgcacaaatatgtgtgtacatggatgttcactgcagtggtgttggtaaaagcaaataaacagcccaatgtccatcagtaaagggatggcttaaataaattatgatacagctaaaaaatacaatgaagattaaaacttatgtagatcacatatacacataagatttccatcaaaaaagcagaatatgtgcagcataattgcattttggttcgaaataaaactatatatgtattcatgtgtttatgtatagttaacagttttgaaatatatatatcaaactgttaacaatggttaccactgggcagtaaagaaggggctttcgtgttgaattttatagacttctatgttattttcatttttataaatgtatctaatttgtaatttttaataaaacaaaataaattcaaggacaagtatattagagagtatctactcaggactgtaataatgtttattatatctcagacctcccaaatatgtaatgaaatgtagaatgtactactaggcataattcgttggcttgcagaagggacagcagtgtttcgattttgtactacaaaatgcattgtgatactccaggtgccattcagctgtgttatctttgtgaggataacagtcaatgcaaaaagatagatattgacatctaatagcaacaggtttgtatttttttaatttcatgaattttgcagttaacaaatgatgagcatgagacatgtagtacaacattactgtcagtctccctaggttgaaaaatccggggttcacttatacttttgtgggcacagtcatcagattctcagattcctcaaacgtctttgggacatagcttactataatatgttcgatttttagaagtctaacattgtgacagtgttttttaatgtaggcagtcttagccttaaaaatattttgtttttagaaaaacttagcctggttttatccaaaactataatttttcatgtttaacaaaaatttaatgtggtaccttgtatatagcactattctcagcactgtagataatagaaaattatcaagtctgccattcatatgtttaaaatctttttagaaaaatctagagaaacacatgaaaaggccaacatgtgatgaagttctcaataaacattcactaactctgctaggaatttaaaagaggagaggaatcagtgtaaagtgatgtgctcagggaagaccaaatgctttcaattgagtctgaccttgatggctaaggcttagatgcgtagaaaatacatggcctctcttgatctggaactcccaatacttggagggtgaattaaatcaaatttgacatccgtaacatgttagtagaacataagaaatgagaagacctatgctcactgctgttttgttgaagtttatcttgagaacacaggctgagtgtctaaatcagtacaatcttttggctttcatgggccacattgcaagaattgtcttaggctgcacataaaatacactaacactaataatagctgatgaacttcaaaaaaaagcttgcaaaaaaaactcataatgttttaagaaagcttacgaatttgtgttgggcctcattaaaagctgtcctgggccacatgcagccagtgggttgcgggttggacaagcttggtttaaatgcttatccttggactggtacaggcctgaatgcatccagattgctgagggagcttccaaaaaataaccatgccagggctcatccccagagattctgagaactctactgcatatacagccttcagaagtctgaccaggtggttctgttaggtagtcaatttcaggaaccgctgatctaacctaatctctttttcacgtcaggactaatcctaaatcatttctagaaaatatcctcttaaaaatatccaaagaagaatggacttctttagtagttatcagtcattagccagtcagttcattctggaaattgtttgtcttagtgttactcttataacaatttttaactcattcttttccttttcttctcctgacagacatttttttaaatgtagccaacaatacctttttcctctaccttccatagatttccatagattaaacatcagaaagtatctcatttagtaacaactggccataatatcactgcagttttgagggaccagtatacacgattacagggttggctcaaatctggcccaatcactgcctgttttataataaagttttattggaacacagccaggctccttcattcacatattgtgtgctacagtggcggatttgagtagttgcaacagaggtgaaatttgccagcctccaggttggagctttagaaagagtttttttgtttgtttattttttgtttttgagacggagtctctctctgtcgcccaggctggagtgcagtggcgcgatctcggttccctgcaagctccgcctcccgggttcacgccattctcctgcctcagcctcccgagtagctaggactacaggcacccgccaccacgcccggctaatttttttgtatttttagtagagatggggtttcaccgtgttagccaggatggtctcaatctcctgacctcagaaagagttttaaggccgggcgcggtggctcacgcctgtaatcccagcactttgggaggccgatgtgggcggatcacaaggtcaggagattgagaccatcctggctaacacggtgaaaccccgtctctactaaaaatacaaaaaaaaaaaaaattagccgggcatagtggcgggcgcctgtagtcccagctactcgggaggctgaggcaggagaatggcatgaacccgggaggcggagcttgcagtgagccgagatcgcgccactgcactccagcctgggcaacagagtgagaatccttccaaaaaacaaagacttttaatatcctcatctaggaatttggggagaaaccttatatttcaaaaccggcaaatccatggaaaatgttttactacctgcactcctcaacacatcccatgcagccactgtcagctggtctgaatacacaggctaaacctgtttgctacacttgtttatcatgttctatgaggggaaaaaggaatttctgcttcccccctttgtgacaaggtcagagattttagaaatattaatcttacctaatgaagatggcagccatggagcatataaaaattgagaaaagaggtgtaatatcatcggcctttgccaaacggacttgaagctgaagtggctgctgtgtatatttgactgttgcatcagcgagctacaatatgcagtgtgtaattactaacatttagtagagcagctctgtaacatagtcccagaaatgtgagcaatatctggtgtttgtacttcgcttaaatgatgtttcactagaattacccccaaatacgttggggtgttacagtgtgcctgataaatgaaattgtattgagaccaaaattgttaataataacatctcccttatagcccccagtaggtaaatgtacattgtgtaaaagtccacgttggaaccagtcatattacaaagcagtttgtgttcctatttcttggtctgccataatcttatgttttccaaaattggattggcattttgggtagttttccaaatccaagaagaaatatttttcattttcatatgttgacctttgtgccctttctaagtggttaatttaatttaggtgttaagaatgaaagtctcttacagcccctgaaccttaaaatgtaataatttattaaaattgatgtatacttgtaagagtaaattaagctaattgagactattgtttggggggctgttgagaccaacagatttctttgcttaaaagtgaaatgctgatttcactgttatccttagggatgggagaagctcttgcttaaggggataagaggctgatatggccccctccttcactcctaggtgtacactgcaccagcaggctttctatcacatctgaggacaggctgggtgttatcagtttactggagggggaggacatttccccagggcttcaggtcgcattccagatgtccaccagtgtctcgctctgttactcaggctgagtgcagtggtgtgattttggctcactgcaacctccgcctcccgggttcaagcagttgtcctgcctcagcctcccaagtagctggaattacaggcatgtgccaccacgcccggctaatttttgtattttttgtagagatggggtttcaccagcctgaaactcctgacctcaagtgttccatccaccttggcttccagaagtgctgggattacaggagtgagccactgcacctggcctaaaagtcttattaaccagtcaataccctgtgtttcaagggagtaacaatagatcatgggacataattaagcaaagcagctgacctttgaggaggtccaaaatgagcagacgagtaggagttcccgtcgatcaagggatccacttgagcccctaaaggattgcttatggcaagaaggtaaacctagagggagcagaggaccaggcagttagagcagggaactcctgaacagagaagcagattgttacctagagtgaaggtaaagtcaagaccaggcttttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcatgaacccgggaagcggagcttgcagtgagccgagattgcgccactgcagtccgcagtcccacctgggcgacagagcgagactccgtctcaaaaaaaaaaaaagaccaggcttttagaataggacagaagcccaagtaggagaactacagcgcaacatcagagctggacagcagaagagagaatttaaaaaaaatatctggcctggcacggtggctcacgcctgtaatcccagaactttgggaggcctaggcgggcagatcacctgaggtcaggagttcgagaccagcctggccaatatggtgaaaccccatgtctactaaaaatacagaaattagccaggcgtggtggtgggcacctgtaatcccagctactcaggaggctgaggcaggagaattgcttgaacccaggaggcagaggttgcagtgagctgagattgtgccagtgtactctagcctgggtgacaagagtgagactccatctcaaaaaaaaaaaaaagctaacacttttagtatgccaggcattggtgtaaatatttgtcagtcctcacagtgagcattataataagacaggtatttttattatccccattttacagatgaagaaacaggtgccacgagattaaacttgcccaaagtcaaccagttaatagattgtagaactagctcctaaattgagacggtctaactgcagagccctattcttgatcattacactttgcagtcttgacactaagttattgtgtgtttggctcaagctcctaacccactcctgcctgacatcacctttggtcctagaaccaaggtggctgatcttgactattgaacctactgagaagtctggcaggacctggcttggatagagacagctatgtttccagtgtggagcaaagttataatgtgtcaccatatcaccaaaatgtaaacaaggaaggaaagacatctagccatttgagttcagcataaaagaagatccaaatgggggaaaatttatcttaaatcctcatctagagaaacagttggggctgcccagaaaaagaacagtaagaacaaaacaatgactgcaaagtggctagtgtgttcatgtgggtgtaagtgtgagcagaaatgatagaactgtgaagccaaaaattcaacctttggaagtgttattgcattttatacaagggaactccttttttggttgtttggagaattctcagctttaaaaattgcttttatctgtgacaataaagattccctaaagtggagcagcaagcaggcatcccctacttgctgaatatattgtaaataacaggtagaaatcagaagtaagccttgccttgcattctgttttctccacctctaccccaaacatttgttaattcaaataagctaataagtattgaaccctattactcactgtccactgagtacatacagatagatgtttggtttgtttaatgtaatcattttttgctttatttttaattaatttttactgaatacttgaatggattagataactggtatttttgtcagatttttccaaaatcattgttaagaccctgcctactcatgtctgatttctaagaagcaactttaatttccagtgaagtgtttgatgttttactccttaggcagcataggaaggggtaaaaataagatataaggtttcataagataagacccttataagaattatagtaatgaaaataaaattttttttttgagacggagtttcactcctgttgcccaggctggagtgcaatggcatcatctcagctcactgcaacctccgtctcctgggttcaagcgattcttctgcctcagcctcccgagtagctgggattacaggcatgcgccaccatgcctggctagttttgtatttgtagtagagacgaggtttcactgtgttggtcaggctggtctcaaacttccgacctctggtaatcccccgcctcagcctcccaaagtgctgggattacaggcatgagccaccgtgcccagcccaaaaataaatttcccaatagcaaatgtgattgtcctccaaagtcattctcctgttgctcataaaatagtagggacaactcgtaaagaaaagtagaatcgttttggccattttggatgatccatttgagtcagaattaaaatgcaaaccttaaaagcatttggcgtaataaatggcctctgtgaaatttttaaacagtataatcctggattttcctgtgcactgaatatgcaagttaaatttatacaaaagaaaactacaggaccttaatacaattgattattgctgtaaataatgacttccttaattttctcatcatgtgtctgtggagcttttaaatgcctaaacacagcagcagtcagctttgcttctcgtggaaaccatttaaggccatggtttttttttttaaatcttccttgtccttatactgaataaatactacttagttattggaggttttcagagtactgaatttatattgattgcaccctttgctttcaactttaagtaataaactcaagtcaaattatttttaataatgacatgactttctgatgaagcctgttaagtcacttcccaaatcaaaatatttaaattacatgcctcaggactccaggcactttgtctcaactgccattattaggacagttatggggtaaggcttttttaaaaagtgcagagaataagagcttgaattatagtgcattttttttttcagcattactgcttagactcttttcccagacacttggactaagatgaagagattcctatgccatatgtcaatctaaagagggcagaggcttgggacttcactgtagttgggtgctgggtctattcaggggttaatttagttctacttaaagctgtgactttttccacaggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtacgtgttggtgggctctttctgatgatttttgaaatcccaatttgatcatttcccccccacccccttaagtattttcatagtcttggattgtccttctatgtgagggagctggctcattttcagtactcctttctctagctggcgaattggagattacagtccctgaactggatttaatgatatcattgtctaacagtgacttaccatggtacaaaatgaagcctgttatcttgttttgttcaataatgtatttgtatctatcattcttgtggaagaagtggagaaatacagtttcctaataatctattttgacatccatgtcagtcagcaaattttcagagttatttcctgcatgcaaatagcacttttttttgccaggcagaagcaaaaattgaattcagtcatgtggttctgaataagatagaaagctgtttcctttaaagctttccactttcattaatcttatacaaatgtacagtagaatgaagaggtgtttgcacttggccagttagttctgtgccctggttcatcaggaaatggcattttaaaaactgtgtgtaagcagaggtttgaaatgatagatgaaatggttgttcagacttccagttatagggccatgacctagatgagcaattgtctaaaaatattttatactaggatacaagtatgagtgatttgaataagaagtgtttaaattttttttcaagtctaatcatctttcagaagaaacaaattgaaggcaaggaatccagatgtattgctggagaaggatcagatggaacaaatagagggaagaaagaataattactcagggcgggaggaagtggagggaaggatgtaaggaatagcaagtttttcatactttattttcacataaaaggctgaaggcgctaaagaaggtcccctcatctaatctctgctttaagaaaaaaaagccttccattagcttgacttccaagttgaaacttttccttactcttttggtcttgactgaaaagttctgagtttttaaactaaagcttaggctaaaatagaagactaataccatattttccaggatttgttttgctggggatcaaatcagtatgcctcttcttcaatatatgtatggtgtgcagttctcttgctataattatgggcaccttattttccaaatgaaaaatcaggaattattttgattttcagatttgtttgtatatcttataaggatgtaaaaagtaaattgcctttagatctgcagtcacacagacatgtttatctaaaattattttttattatttattattattttgagacagggtctcacttcatcacccaggctggagtgcagtggcatgaccatggctcacagcacccttgacctcctgggctcaagcaatactcctgcctcagcctcctaagtagctgggcctacaggtgcatgccaccatgcccagctaatttttaagttttttgtagagatgaggtctcactatgttgcccaggctgatcttgaactcccgaactcaagtgatcctcctgccttggcctcccaaagcgctgggattagaggtatcagccaccatgcccagcctgtttatctaaaattattaaaatcacaaaactagaactgtccctgggacccaggacaactggttgctgtcaggatgccacttgtaattgctgtggcatctaggcatactaccaggtacttgctgtagagtgcatgggtctgagaaatggtgttgagaagctccagctccataggtggcatgtagcttttttttttctcatttaactattgttattacaaatgataatgatcatgtgaggatgtttctccggggctttgcagttacagagtatttccctagcctgtatttcatgtaccctcacaactaaccttaagtggcacagtattgttcccattttatcaatgaggaaatcaaatgccttttcctctcctccttgttcttttatttatttttctttttgagacagagtcttgctctgtcacccaggctggagtgcagtggcgtgatctcagcagctcactgcaacttccacctcccaggttcaagcaattcttgtgtctcagcctcccaagtagctgggattacagactcaatgccaccacacccagctaacttttttttttttctttttgagacagagtctcactctgtcatccagtccagagtacagtgatgcgatcctggctcactgcaacctctgcctccgaggttgaagcatttctccttcctcagcctccttagtagcttggattacaggggtgcgccaccacacccagctaatttttgtatttttagtagagatggggtttcaccatgttggtcagactggtctcgaactcttgacctcaggttatccagccacctcggcctcccacagtgctgggattacaggcatgagccactgtgcccagcctcctccttgttctttcactgtagaaagccacattaagtatactaggtttgtgttgcacaggctcattggttgccatctttttcttttttctttttttcctcttttatttatttatttatttttttggtactttactgtgggtaaaaagctggcatattagggagtgcttgcttttttttttttttggtactttactgtgggtaaaaagctggtatattagggagtgcttgttattcatggtgttgtgcttttccctccaggtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccaggtaaaggcagccagtgagagtgtgaagacttagcatgctatctagtgccaaaaacttcagcaaatgctttttggcaatgtcattttgaagcaagccttgttatgtgtgtcttggttggctggcagtatgggaatccagtgcaggagccagaaatctgctgtgaatagttgggagttgggggtgggggtgggacacagtcaacttctcctgcctgggttgatgaaggaagcttcattgcagaagtggcacttgagctgcatcttgaccagtgggtaagatcttactagaaaatggagagagcctgcctgtcagacagaaactgctgggaaggctcgaaggcagacagtcagaatgtatttaaggaaaatcacatacccctccatttgtctagaccattgagttttttttggaaaaggtagaccaattaaaggttaatgggaggctctgaaatgccctgctcggaaagaataatgtctgaaaggataaaggtggttattctgaatagttctcttttgcttaatacaataatgataaaatactcaaatttctatcaataatcatgccaaacagcaagtgcccatctgggaggcactggaggttccagcatcatttctgatctgagaacacccagatggaacacagggtctaggcagatccatctggaggagcggtgtgcaggaagattagagtggagggccggcagggcggtgccaccagtcagggggctgttggtgtcacccagctgagacctagggcaggcctggacccagctgagttcatgttcaccaagtagggaggtgccggtggaagcagaagaggcgagcacgtgggagagactgcagaggagagtgaagaggttggagtcacaatgcctatgggagccgaaggaaaggaaagagggctgggattgagaataagggcccaccttaaagcgggaagggagaaaggcagaaaatgaaatgaatgcgcagttaaagggaagagttgtgttttagttgtgttgagttgaaggtgaacgtgggaccctgtctggcaggctgtcggaatatagatctggaggatggaagagagcacgagactgggattatagattggagccattcccatagagaacattatcggatatcaggaaatgtgtgaggtcatccaaggagagggaatacagggagaaaatagcaaatccacaggcacgtgtgtgttctgtggtctggaagaagaagaggagctactcagcaggaaatggtactttcctttgcatctgtcctagctcagcatttagcacgtgtcacatgctcagttaacagtaactcagtgatggggtgggggtttgttccagagagtggaggtgggggatgggaggttgcttatgttactaagtaccgtggtcagggcaaagaagagaccattcattgtgacaggtagagctttgtaacctgggaaggagaaggatgaaaccacactgcaggggcgtaaaaggaaatgagcagcaagaaagtggaaagatctgcaaaaggaaagagaaggaccagagtgaggggcctcgggaaagcaagaaccagccatgttgccagtggagatgggaatggaaaagtgaagtgtcagaggatatagttggtataaggcagaaaacattaaaagcacagaaaagacaggagtctttttcttctggatgaggaagagtgaagagattggagaagataaagccaagaaaaatgttcaagttgggctgcatgatattgttctcagtgaggagggagcctggaggggctgcggagtgtagaagaggtttgggagcaggcgaatgagggatccgacaaagaagaatgaagaattgggccggcgcggtggctcatgcctgttatcgcagcactttgggaggcaggcaggtcacctgaaatcaggagttcgtgtccagcctggccaacgtggtgaaacctcatctctactaaaaaaaataaataaatacaaaaatcagccaggcatgacggtgggcgcctgtaatcccagctacttgggaggctgaggcaggagtatcacttgaacctgggaagtggaggttgtggtgagctgagatcacaccactgcacttcagcctgggcgacagagcaagactgagttctcaaaaaaaaaaaaagaattgcctggcttaatttaacctgagtccgtaatagatcattgcacattgcctcagctttctctagcaatgcttcacagcttgggactaggaataataatagttatatagctcaccactgttatttctatcatagcaatactgtgcatggatcttactaaacttccttccccctccccacctacacacatcttgcattaccatgggattgctaaactttaatagccttttggagaaagtatcatctctactttacagatgtggaaatcgagattcagagagattaaacagttgccaaagccagaaaattagtaagtgacagacctgggattcaaacccagagtccacatccagcccaggctggggtcattagggcccatcaatgtgaaaaggttgacaaagcagacacggggaagatttctcagggggagagattctgaaataccagtgagggcacagttgaaaggccaaccctggggtccatacgtagagaaatcagtgaagtggcggagaggattagacagtgcagaagggctgtgggatgaggagctacgcgggcagcaggtccactgcaagagggggaaaatggaaggtcgagaatatacaatcttaggggtgttcgaaatccagggaaaccccctcagctctgagggacttgaaggagtgaatgtacagctaagtggaaggaaataggatagggatgttgtgggtttaagaaggcaagaacccatgaagaccaggaattagaggttatcaacatagatgctgaaactatttgacctgttgtaaattctctgctcatcagacataatcataacttaatgtcagtataatataaatgacttctaaaggcatgtacaaattggttctgaagtaactctctctaggcattatcttttgttcttgtccattcatatatatgattgaaagttggtgtttcattttttactaaatgctttaagatactgtaatggtttaatgctatagcttaaaagataataaatgcctcaccctgcctttccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctcagatgctgccccctctgtgaaatttacgctgatgcccccaggcagaattcatccctgttttctctttattcctgcagtgaatagtaggaactcctttttagtatatttcattctgccaggtggtacacttggttgtttttatctctgtcttccccattacttgtgaattacctgctagtaatactgcccatctttatagtgctttgtggttaataaagtgcttttccctaaattatctgggggaggcagagactgtttttttcatctgtaatctcatggggcagtgcatgtagatgtacaataaatggtaattacaatgaatttatgctaaccaaatccctgttttctctgaaaaggaactaaaacaagcataatccagatagggcctatttccctgggtctacctaatctaaaatgccagttaatgatctcatgatagttcataaaatgtctgctccactgttaatcctccactaaaaatgccagtcaaattggaaatggggaggtgtcccgggcaacttgagagtgaaaatagaaccaaaatataaagggcacacagccagatgcaacagaataattgtgacctcctggctttttgaaatagagagttctagatggtcagacaatgactttgtgaagaggctggaaggctttggcctccacttttggaaataaacaattgttgggaaacagtgaagcatccagccctcctgctgtgctgcctcagggccctttgtggctgtgtgtgcttgtctggcctgtgcttgttggagaggtgccatgctcacgtctgccctaattgataacaaagcgcaacataacgagaggtcctttatgttattccacacaagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaaggtatttttgtatttatctgcttgtatttgatgaaaacaatattaggcgttatattactgtttgcactagttaagattcacagacaggagttgcgggattagtttgtcttctagatcttttaactgcaaaagttatagtatatagagtaccaaaagggagcctcttatagataagtgcattctttcttctctcatgaaaacctatgtgccttgtttttcattgccttatgcaagaaggaattcagctctgagacctggaacactcttgtgcattagttggagattatgactctctttatgcttattacccagtgctgtaccagatatatgtgaatacttggaaacccaaaggatctggggaaatgatcagaaggacttaattgtctttttcattagggtcttatagcatggaacctaaggttgttaattcctccaaccatattgatgttcaaaacaaattatgagctttaaaaggatgaaaatagcaaaaatattcaatgagcatctctcagtcagtcatgccttgaaataaactagtacataagccatgtgtccagtatagcaaagtgctgaaaaataagaatgcgagcttagagtcatgcctctgtagtaccttattatgtgtttttaacctagctaagtacaactatttcagctgtgggtcgtttaaagttttaaaagttaagcagttttaacagaaaaatcagtgtcattgtacgattttctttgaagataaaaattaaaatactctcttcttccattattgcagcatggattctggttcttcagagagtcctgctagtctaaagcgagtagcctctccagcagccaagccggtcgtttcgggagaaggtgagggcctgagttgtattatgttcttcagaagggtcaaggacattgtgtaaatgtttgaaatgagattgaatttcatcttaagatagactgcatttatgatcagtatattaaactacagtaaaatgtaagtttagctctttacagaatcggagtacttcatggaaaatactgtcaggtatattaatcatcaaaaactgaattttctaattatattttattataagccctttgacttttaaaagagacccattcagttcactaagaatcgagttttccgagcatctctatagctaaactatggtcattgcttcacctaacatagtctagtctcatctgacttcatagataagtatttcgttttaaaagtaactacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaataaaataaaataaaataaaagtaactacacagaccactagagttctcatagtaacatgaatgccatctgtaccatcccaaatgaaactgaaactcaatttctgtgctccatgaaaacaatcaaaccagacaatttaggactaaaaaaaaaaaaatcattttgagtatttattatgcaaataattgccttctttctcaatctccacttggtgacataatcctaaatattgtatggatgccaactgaataaaacttaggtaattcaggccctcatggtaaaaatctcacatcttttttacattcaatacagccatcatcacatcctaactggagagtgctccctgagttagatgggttttctgtgtagacatctgagcagtgttgtagttaacagatgccataactaaccaattctatagtaattctttatgggttccttgaatacattacaggagaatagaatgttttatttagtttgtctgccataatgagattgttaacattccttagaaaccttgcccagtgaaaaacagaattattaaaacagctgttttaggtggagacagcaaggattaaggtataatggtatttcagactcacagtaacaatgttcttttttcaagaggttttttaaagtaagaattttttttagttcatagtatagctataaaaccttatcactaaacaaatccagcatctaatttttgctattaccatgaaaatgattaacagagttccctttatacattctcattatcttaatgactttttatccactgttagggtaacaaggcaaaaagctcctttaaataccacatgcagtcagtttagtaaaaagcaacttatgcacctcaccaaaagataaagaaaaaaactttggtgtgttacatccaatcaaggctcactggagggctggagtttgtatcttgactcacccatctagtaacagtattattttgtttatgccttagcttctttgtctgtaaattggccgtgataactaccccttgaggtaggaaattattacaaggataatgagataacatgcagaaggcttttagaacaaagctcagtaaatgtctgctacttttatgtcgtttttgcttcattccctggattagtgataaagccacataaagtatgagcatcctcatccaatagcagtatggaggagtgtttgtttgttttgagacatgtactgaggactcaataaataggtcacaagtgaaccatgcatgtacttaaaattgggcaacataatagagttaaattctgatcttagtttgtatttattacagccaattttgaaatgacttagttattagaaatatttggaaaggttgctggctttgtgaaggggtgggaggacattagaaattctgagaaaagctatttacatatattaatgagccttttgtaaataccacattgaacataatcaaatttaaagtaaactgtaaaccagataaaatagatgattggcttgggttgcttttaaaatatttaaaatattggcttggggatggccagtgccctctgtggaatgtttcctgagaaggggtagctaaagaggaacctctgcctatccatcatcatgtctctgggtttcattgtcaccctaaagccactctcagatgtctttgtgcaaggcaggcagggcaaggccagcctcagtcttcccagtctcctttatattttatactgcaataccaagttcagccagagttcatgtttctgaagtttcttaagcatttggaaagttacttcaaaatttggatcaattttaaagaaagtaactttgaagttgaggaatcactggggaaagtattgatggccaaggatcctgtcttaaatggccaaatatgatctaaagaacagtaacagggagcaaaatgaaaagggaagggtgagagtatggagaagtcagaaaaatgagtctgttaatgaagaaagaatgaccctattaaagccaccaaactttgatttccttgtgtgggaaatcatttttccaattttcactgtggaggtatgtgttaccagcgcctcagggctaaagacagagagtcttctgttttccctgggacgtttgaatgacctgtgtctgccatggggcccagtgctctccaccagcaattgctgctggcctcggcgctgacaggtcaacactggcgctgaaggaggcccttgttgctccaggggctgcccacgtgagcacaagagttagaggtttttgtgtttttgtctgtttgttttagttttcattagtacctcctgcagaggctctgataatcaaccgaaggagttctccataaaaaattcctacctcttactcaacacgaggctcgacattaaaggaacatcatctgaggtttagagagaaacatacattgtccatcataaaaatgaactttttgggtaaatggtgatttttctgttgctttaaaaaaatacatacaaaagcctaggataaaatggagaaaaaggggaaataagaaacctgtgcatctttctgtaaatcttttatcctgtacctagaacctccatccaggattttgtgtctggtgatctttctgagagtgtgatttggttctaagccttaataaaatccaccaagagtgatgcaaagttctacatctaattaaaaaggaaagtttcttctgtaatgcacacccttcaaattcaagacacaaaggaacattagttcttatcctttaagactaaattacatgaataataaaatgtgataaactgtgatttgtctttttaacttgttgaaaggctttctgggattgggttagacattccttttatcatcagtcctctctacctgtttgtgctcttgaatgacaactagatgcccatttttaactaaacaatatgtgtaactcattttgtgttctaacagcttcctatcatattgtgtatatggcacaataggacataagttttcaggcacttcaataaggaaaagtatgtcttatttaatttatgcgaaggatatatgctatctaacaattttttaaaaacctgtgacgtagtaccctcaaaactgaaatacacatatttaatatgcttaccaagagcctgcatatgaatgcatctgacccagtgctcagcacagagtaggtattgtgtaactcttagttaaaaataaatgtaaaaaccattttcattcaaaaagaaatcatgatgctaaatggtagatcactcttaaatactcaagtgtcggtaaacatgcagttgggttttttattcctgtgtctgggtcttcccaggaattgtctccctgtctgcagctactgaacttttatgtgcactgggggaatgtggagcccagggcattctgcagctctgtattttatctgtgactagcctttctcttgaatggatcttgtcctaacttccttattcgtaaacttgcttttgcaaagctgtctgggatttctttaaacaatcaagctctctccgtatctcaatatttctccccaccagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagaggtaaacccacattaactgtttcctctccctttctgtgcggtgattctctttgtggggagtcacgatgtttgacagcggaactttgttgggttttgctaagttctggaatgtgacagtaaatccagtgtgacctgtcattgtttgatcttgtcatttggcactgcgcagtaagcactggcttcccccaagcagaatgccatcagggctaagtggaggctgagtgtgatggggctggtccgcatcagctgggaggataatgttcagtattaagctctcttcctgcctgtaactgacttacgctttggagtaaactttcttgattagatcattatggtcattgatttttaaatgcccaagaatggtagcaatattttgcctgtataaacagaagtattctggtgataatcgccccagaatattggatattattagaaagtttttagaatttctggttttgcccacacagtagaaagacacaagatctaagggatgggtacacttttggctaggccttagaatctccgttgatcaggactgaatttaagtgctgttatccgtatgaattggaagtgctctcactgttgttaaatagagccctaaaaatttgatcacataaactgtggtcttaagatagtgcaagttgaatggaatggtggggtggacctaccacagagcatgggagtcagtcttgtaggagccacttgcacgttagtggagagtttcagggtataaatggagtcatttaacagatccaatgcacatttaaaaaaaccaacaagaattaactccttttttttttaagtgttgacagtcaattcacagttattttctttttctcctcatacctcctaggtactgagagagaaaaggctggcagggagcctgtaggggccgctttctcaggagtgagcaagtggacaaagttctctctctctttcaaatgccagtagtagagtgtatactgggctcttacatgtgcggctccgtgtactcggagctgctctgggagcgaggctgggcctggtgccctgctctaggagtcctgcccttggcctgctcacctctcctgcagctcccagaaatgattttatttgcttgggttttgtttttttaaggggtggcattgttttgctttttggtttttcttgctgcggtcttgagagcagctaagtggaattcccatggatggatttacataagtctgcccacccttggagaatctggcagaagcccggaagaaagtaattttgccctgcgagacagctggcatattggacttttcagacctggaaacagagaattcaattcttctccaggccagcaagtcgagtccaatgagagtcatacagatgatatttcaggggaattgggtaaaacactaaaagccaaactcaatttctactaccgtgcatgaaaactcttaaagtgactttaccttttggatcagttaaaatacgaaagccattacttgtaatgtattttaataagttacagttttctactttaataaaaccatccgaaataaattttaggaaaacacacagtgacttttttttttaaggtaagtggagttgtaaggtactttcttaaccacagtcttaaattattagccacagaagaactagcagtactagaaatttttagatatacatctagctatactattcaataataatgaaaaaaaaacctgaaaactcagctctttcgtcctacttgaatacagaattcagtgtaaaagcaaaatatccgacccaacctaacaccagacccagcttcagataccagaactgacgtctgggcatggggagagtcgtcccatcctgcttcccttctctgtatgggcaggtctggggcacagtctgggggactttataggtgcagggaggacagaacatggccttctgaatccatctcagcttatggggctggctgtggtttttcaaagggagcacattgaaactacttgaactctagggtactgccaattgccttgttctttttatggagtatagggagtagattctaagcctgtactaggaaagttaactggtcactggagtcttgtttcattggtattcctttttttgatatgcagcctattgaaaaatagtgagagattgcttttgtataactttgttcgttaataaagcagaatcagagtaaaaatttaacccgaacttttcctggtaaatgtttcttaaatttcaataagcaaaataaagagactgtaagttgtgttcctggtagataaatggcatatttttattctttcagtaactcatgttttgtttattaagccttttgttttgttttaattggaatgcttaatttactgcaagatagactcaagcataaattaatttagaataaagtactttgtaacaacagattccgttctggctcctgtcctgcctctcgtggtctctgttgttggcttacttggctggtttaaaattccatgagtatcccagagaggaattcaaccccagagcactttttaaacacttgatagttgggaagaaatatgctctgcctctatgcattgatagagaaatttcaatgtataaactctgtgaaattgggtggaaaggccacacaggacagccactgcctctttggatagagaggggtgaataggatgggggaagagaggttccagttgtccctgttagttttttaaaaaagaaagctcctgaagcaaatgtgcaaaatattaatattttaatgtgttaaaaccgggtagtaggctcgtgagttatattccctgtactttttatgtgtgaaatatttcataattagccatgtgaaaataagtccgagcttagtgtttaggatgtaaactaacagtcttcctagcctggaacctcctcttagatttgaccaggtccgagaagtgcctgtgcttggagccctctgggctcttacaggcgccatactctgctgtttttttctcttatagaaatgagtaaaagccacatgttttaattatttttttccatgttttcctgatctatatccttgtgtcaggtgatacagtgctatgttttcccagaatgaaaagtggggctttggggctcaagcgggtttgtatcatcattaatcgtttttaaagttgcatgatcaaaacttcagcatgcaaatgagaccttttgctctgttttaagggctctggaactgctgggaaaacagggagtttaggaaaaaaacctggtaagttacaaaccctgatgcttacttttcaatgttttgaatgtaattgatagttgctccccatctttgtgtattagggccagaagcctaaaataaaaagaatctttcctaagagtggtgagagtaagtcctttccttggaatccattaataattttacttggttatgagatttgtctgttgcttcacacatgaagagtggagacgttacctaacagaatgttctcttgggttgtcgagaaataattcaggtgaggccaggcacggtggctcatgcctgtaatcccagcagttttggagaccgaggcaggtggatcatttgaggtcaggagtttaagaccagcctggccaacaggggaatcccggtctgtaccaaaaaatagaaaaattagccaggcatagtggcatacacctgtaatcccagctactcgagaggctgaggcaggggaatcacttgaacccgggaggccaaggtggcagtgagccgaggttgctccacttcactccagcctgggcgatagaacaagactctatctcaaaaaataaaataaaataaaataaaataaatatatagataaataattcaggcaagatgctgggaagttataatacatggagctgtaggattatgggctcagctgcttctccgtcttcctcttaggcttggttagccctttttcatttcataacaatgcattcccaggacacaaacaatggagaagattagagtgtaggtcccattaatgtagaagccataggatggttttcctcggtacacattgaaggtacaaaattgtagtcatgcctctgaatccaaagtgttttagtttatttcagtaaaatcacatgtgctataaatagcacgaaaaagaaaagaaagaagcggatgtgaaataatacggtttctgtggcacgtcttcctggtctaggtcatttgaactttttggctatcatattcttagaaaattataggttgaaacagtcactgaattgccaagagacggatttgcttgtctgtctggtgcccagctccaactgggcttacatggctagggaaaagaagggaaatttcacgtagtctaggattttattttagtcagataaatactggatggagtatttagtcagataaatacagtggatggagatacattggaccaccccaccaaatctccgttttaagtgtaagttttctaagttttgtacacttgtcattccagagggtccagatatttcatagatgaagcccaggtgggctttgctttgcactgaaactagcaagaaaggacacaaaagactgcagagaatgttggggcagattgctggctgcgtatgccaggtcccttgaggagcaagaacatccagtgccaaataggacactagtttggtctttctccaaaccataaactcttggaaccaagagctggtctttggtgtgttgcaggagagtcctcatcccagcgtagacatcccagctggagctcccagtcagagcctaggctgggccagtagaccatgctgtggcctttcttgcttgccccaagctctgcaaagcatcaggcagggccaggcctgcaccatgaccgccaggtgcttctatcctggtggccgacccctgatagcatgcagaacagaatgagagcggcttgcttaagggccagagtcttacttgttccctggagtgagtagaaaagtaggaaatctcgtcagaacatgagacctttttgcgttcttcctttccattcttctttacttcattccctctttcttcttttttttctgtccttctttccttcttttctcctttcgttcacaaaccacacttggagagcaagggtagaggagcagaacagtttgttctctattgcttctagaagttcagaaagcagtagttgcagatgagccagaactcaggcagagaagggttctgtctcttcatactcagtctcctgggcccgtggaaatggtgtgtttcagagcctggtctgtggtaccgctggagtttttcccatgggacttttcacattcaggaaaagtacagaactgttcacatttttttccctgtgctgaattgtttttgcataaagttcccttcttaactccaggtccctcctgtaacgtgaaataaaaagaaagaaatttgccctgccatgatttgcacctgatattcagggatcactctcaaaatgtgagccataaagaagaaggctgtgtcgttgggagtgagaatctgcagcaacaacatagaaataagcccctgccgggctcccagtggtttctgaggaaaatgggcttctctttctactgtacttggcagctagaaaagctattgagtcctttagtcacttcaaagtagcactttagccattgggtgctactgtgctggggtgggtggtgaatgaggccccacccttggcctcagggcattctgggtaattatgggaggggtgtgacagaaggtgccaggagtgggcaaggagcggacttcgtggagggaagttggtaagtaagtttcacgggatgacaagggagtctgcagcccactgagggctcaaggatcagccaggcccttgaatgccgtgtctgcctggtagctctgggaacgggcgattcagggagccttactcgttgggtagaaatccagctcaatacattggttttgatgtgttcatctgtgaacctgggaggcgcctgcatcttcttggccttttctcctgctgactcttaacagtgcactgccgtgtttgatcttgtttttcagaaattgcccaggttattgcctcatacaccgccaccggccccgagcagctcactctcgcccctggtcagctgattttgatccgaaaaaagaacccaggtggatggtgggaaggagagctgcaagtcagtgtcttttttgtttatttacaattctccatccaagtttcaatacacaaaatctcaaagggacgctattttattgtaaagtacaaaccacccctcaccacctaaattctgtatttggatagtgagagatgccaaattttctgtgtttgtttggttcctaagtttcagacagccggtaacagatttctgagagctaggagcgcatacgaaaacatatctttcccattcctgaattcagatagagtcggcatagtgagaactcatatgacgagggatgcctgcatatccttatgtgccttggcattagagagtggagcttttcatcagtggtattagaaggtgtggcacaagagcagatttctttgcattcaaagccacatccatacatcacagtatttttagttcccgtgtgtgtgcgcgcacgtgtgtgtgtgtgtattgttaatcatatcatcttgtttacacattttaccattccagatacttcctataagtctcatttccagagacaaagatgctttaaaaagattactgttacgcagttctcatggtaaaacttcttagaatcattggtggatgcccaatctgcaagaaaattttcagtaggagcagaaaatgtgcatggtcttgaagtgacccccacagatcactcatgatctgcaggggaaaacacaataattatagagtggggaactaggacaagacctgaatgaggtgatcagaatgatgagcagtggggagaccagaggacatggtgtgtgtacagctgtgccgggagggaggagggagggagtgactggtcttcaaaaccgtcaggatcataaaagacaaaacctgtcgaaagggggctaaagaggcgtgaggactggctgcagtatctagactcagtgcagtatctagaccctgtgtgaaagaaaaccacgctgtcaaggacatttttgggataatggacaaaattgggttatggacactacattagacaaaattactgtaccagtgtaaaatttacagaaagcaataactgtactgtggttatataagagaatattcttatttttaggagatacgtgttgaagtatttaggggtagagttaagatgtaagcaacttgcaatcagatgaatcaaaaaaagaacttgcagagaagagggtggggggggagggagggagaacgcgcacaaatgagggagcagctgctgccaagtgttgacagtaggtgaattcgggtaaagggcctatgggtgttctgtgtgcttttcttattcttgccaattttcctgagtttgaaatcatttctaaataaaaagttgcctttaaaaagttactactatagcagttacttgagaggtaagccagctgacttttcatacagaaagtgtgtctccctccccgcatcctcccccatccaaagtgaagatcagcctcagactgccaggcgggcacctggccacctgcttcatagcttagtgaaggacagggcttgctccctggcttgcccacatggggcctatggaaggactgaattttccagcagccgtccgtctctctggcgtttgttgaacgtgggcctctgcgtaacacaggggggcctcagtaaggcttgaacggatataggaaggaatggtttctggaatgctttgtgaggaaggggcccatgggaaccctttggtggctattagtgggcctgtagactgacttacccaatctgctggtatttgtctgcccatgagcaggacggtatggaactacgtaagtttgagggggaagagggaggcaggaaacctttgccatgcagtggactagccacggaagacagaccctcaggtgctcctgaggaatggaggttggaacagcaggagcaggaaggaagaaggccttgctggggaaggcctcgggtctcacacagtcccgtctaccactctgtggaagtgagcctgaggccaggacaggaagagccacactggagagctgaatatataagaaacgcatcttggccagaatagaaggcacaacctggagtgtaactaaagatgaaactttccctggagagtttgctgatggacacccataaatgtccagatactactcactggttaaggaatctgacctctggaggcctggaaatccactcctttttgtcagcatgccttctcctgtgctggggagggagaggcctccttagaccctcgggtcccactccctgcttagagttgtgctgtatcacccattggtccttccagcatcatgcccctgtcctgttctggagacgtgggagactcccatcgcctgtcctccttgcctgccaggggaaggcttcctgcggggcccctctccccggtgcagcctcacgtcttaccgctgagcaatggcgtctccactccagcctctttgaaacaccagcaccccctgctctcctgccttgctgcctttgttcatgacatttctcaccagcggccaaccagctccaacctctccactttcgcaagagctgggagatcccacttctggaagctctctgtgaccatcccaaccagaagcaccgtgtccctcccctgagctccagcactggccccgtgccggcaccactctttagtattttatattactttgctttctgtgcacatttcttacttccacatgtagctgactagcaccttggaggcagcagccgtatttttcagtccccacacctctagcactgtgcttaagtgagtgtttgagtggttcttaggattctcaataaagtggctgagttgccatgacccaggagagctcctggcgctgtcaccagagtgactctcagcgtggatccacaaatgaggaaacaccagtgagttctgtgctgtgctgcagaggtgtgggaaagagtggtgtcattgcgagcagaatggtggtatactcggtagataaacgtggaaatttgtaaccagatggcttcagtcatcggcaggttcactgtaaacataaaagctttagtccttgagccaaggggatggaatctatcagacctcaaggaaagggaaacctgctctgtgttctgaaaatgacctagaggtatccctcttgataaactggcaggtgggagggcagaggtaatgtggtggaagttttcttttcttttagttttatttccttattttgggaataggtaattatagtcacatggtttaaaattcaaaagttacaaggggatataaatgtctccctcccaccttgtccccagaggtggctgtttcgatcagagccttgtttctagacgtgtgtgtgtgtatgtgtacgcatgtgtgtgtatgcacaagtagttttgggttctcttttcttggtggtgtacagaagggtagtcaaagcccgactcatgatccctaactcgagtcttttaatgggattgtgtcctaactgcaaaacccgcctcaccaactttgttataaactccccgggtttatagggacagtcatctactgtcccttcctaacagcatggtgcagaaacactccataaatgagtcttgtgttgaatcagattgaattaagtgagaaaggaatggcggtgaaaaatgtggctttagtcatcacatgggcctacgggtttgtgaaagtaacattgagtctccttgtgttctgtgtgtactgcatgtatgtcatcttgcatctaaggatgtatattacccataaaggagcatgcagacacatgagtgcatcttggcttgccactaactgcctgtggccttggggctgtcactcaacttttcatctggaaattgagaataataatactattatccttctggaattgtgtgcataaatgcacagggcctggctcataaaaagtactcagtgagggccgggcgcggtggcgcacgcctgtaatcccagcactttgggaggccgaggggtgcagattacgaggtcaagagatcgagaccatcctggctaacacggtgaaaccctgtctctactaaaaatacaaaaacaaaattagccgggcatggttgcggtgtgcctgtagtcccagctactcaggaggctgaggcaggagaatggcctgaacctgggaggtggagcttgcagtgagccgagatcgtgccactgcactccagccggggtgacagagcgagactccgtctcaaaaaaaaaaaaaaaaaagaagtactcagtgtgtattggtggccattattattattattattattattcctaaaacccatatacagtgttggcattaaccataatgtctacattacctgaaattaacagctgagtgctagcattacatgagtagaatttcctgtcccaggcaatccatggtatatcttaattttgtgatccacacagtctagccgaagcaaaaacattctgggctttgctgaccagtgattgccacaatttgaatttttagctatggtgttttacttttgtgacatagtaatccatagattttaccgttaatgtcatttgtttttcagttatatgtaagctttacataagtgctctgttataaagtgagctgtattataaaagatgcgcctttaaaaatgtttgatgtaattattttcttactaggcacgtgggaaaaagcgccagataggctggttcccagctaattatgtaaagcttctaagccctgggacgagcaaaatcactccaacagagccacctaagtcaacagcattagcggcaggtaaggagtttcgcatctctaactggaagatggtctgcatgccacttgagtttttccacttgattttctcattaaatatcttaggttgtttttcacatgtgctttaaagcacttcctgtacttgctgggactgacacccaactaatgtgatatggaatatgtctttcaaaaggaccagatatctaagtggcttttctgtgctggatacaacagaacccttgttggaatgctcttcttgcaggagtcatgaatgctgtggcattaaggccacattttcctcttgatttccttccagccatttaaattggggtttaggctagggggtgaggtgacagaaagggacacccaaaaataaacggctggggtctcagtaggtcatgagatggagctgggggccacgggggttggggggctataatgtggtgttcactgaagaccaaaatagctcccctgtgacattcactgtgggcagagggggcttcgctgggcaggcaggatgttgtactcactttcctggaggactggaaaagaacagagcacagcagttggcccagttggctattttctgattgaagggaccaaatgagatgcttcagcaagatctgagagaggtgaggtcagggggagcagatttctgctttaggtctttaagccatcattcttggttggcttttgtggaaagtgtagaatttttgttccaataccttgtggttaaatatctgtgctgtatgtacccagtgagataagattaaaaactggcagccttctcaagaaattaaaggatgggcaaactttgtgatgagccgcagtccccactgggcctctttgcttgagctgtggccttgtgtaggctgaggaatgtggttcccgcagggtttgctgtcccctggagagatgtgtcagtatccctccacttccatgtacagccccttcctcaggcccgctgaaattagttgctgaagtgattgaattagctggagaatttaaaaagcctaaacctatttattaataggttggttaagaaagattcatagggactgtgacctgttggtgcagactcatctgaagtagaagtgccaaagaatgagaacaattttacctcctgtaagcttgagagaaaatgagaaaagaaaaattgttcttgagggtggagatttctttcaggacaacattttgagatgcaaagatacagcagcagaaaaatcttttgaaacactgattttaggcctggcatggtggctcgcgcctgtaatcccagcactttgggaggccgaggcgggcggatctcttgaggccaggagttcgagaccagcctggccaacatggtgaaaccccgtctctactaaaaatagaaaaattagccaggcgtagtggtgcatgcctgtaatcccagctactcaagaggctgaggtaggagaatcggttgaaccctggaggtggaggttgcagtgagctgagatcgtgccactgcactccagcgtgggcaacagagcgaggctctgtctcaaataaataaataataaataaataaatcactggttttagttttccctaagatttggaattcttggaggtcaaatgatgattaccttccactttaaaccaaaaaggaaaaatgatagtaaagtccccatgatacatagctgtcctgtgcagcagaagataggatggggttgggctggtctttccagagtcagcagtaggaaggagttccgctgcactcaaaacgaaagccctcgattagcactgtacattttctgctgacaagtaaacatgaaaaagaggacgatatcataaaaactaaagacttagtgtgaaaattttgttgttgtcttagtttttaattcttcacctttattgcccacactgtaaaaagcccaacagaacagttccacctactgtcaccctcttctgaaaggacagaaatagtagctgggaatgttgaatggctgcgcggtacccgttgtgcattctccggcgggtgtgcagccgctcacccagccctgtctcctgcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgtaagtgccctggtggctctgtcgcctcgcctctctggtatcttcccgtaaaacatgcagcattgctctgattctgctgagctttgtttgcagaacttaaagctagaccattgctgcattcgcagtcgtctctttgaagaccttctgtaatgcaagagtttatctcatggggttttatttctctttaattttcattccttctgtagcatgtcccctccctcccctccctcctttttcctttttttttttaaatcattttggcaccatgctgtttacatgcctgactcattttcctagcttgaattttgctcattgttttgttttgcttatgtgttgttttcctcctttttctaggaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagttagatggaaatgtctctgtgttcttgatgttggaacctggcagtggtggtgaggaaccaagcagactagatgtcagcaatgggcctgctgcccacgtgtcaaccatgacctgtgctctttgaaatacagacattatcagaggctcgccgagtctttgttgaacagccctccctctccccgtgctctccaccttccctgatcaatatgcaaatgatcattccttataataccagtttcgaaacatagaactctaccacccagtttagcagttcagtctcaccgggcttttgatataagttgtcgacacattgagggtgtgtgatttggctcagggtacaaaccatttgtccaaaagatgtatcgtaatgtactggtgaacacccccaaaattatgtgggtaaagacagaaacttgcacatgccccacgttgtctgggatcggcttctgcctggcacactttgcagaaataaaccagcgtccacattgatgccactgtttgctacaatgaccacatgcttgattccatcctcatgagcttcacttattggacctctcctgccattcagtggaaaagtggtttccttcctcaattcagcagatatttggtgggggggatgtctaccatgagttgggtgccccattggcttctgggaggagtgtggtactccgtggaaacagagtccctgtcttcatggagttcatattgtaatggaaggaacaaacagaaaaccaaactcctgcaatccatataaatatgcacggtatgtgtgtgacaaggtgacaagttctgcactagaagtttggatatgaggcaccactgagcagactggcagggccaggggagggtggctgcagggcaaggatcagagaaccttcagggggtggggcggggagtgccatttgagctgagacctgaagagtaaggagggaggagccagatggagtgggggaagaggtgtggctattgtagatggagctgtcaggacaagcaaaggcccaggggtgggcggggagatccttctcactgtcccccaggccacccccgtgtggagcagtggttgagtctgcaagtcccatctcttccccaggatcccttcagctgtgtaagccagtgttgcttctccagtcttgagtttggctggaagggatgcagttgtcaaggtgggtactactccataacactctacctaattcactccagatgccccacgccctcactgtaggccatttccccaggcttgcctccagctttgtgaagttgacatgggttgttccccaggaagctgtgctttcccctacaaatcattgagtttgcatttggttgtatccattggaccccatgattctcagccagtgggagtgctgctggtgtctcatggttagagtcagggatgctgctcctcatcctgcagtgcacaggacagtcccccgcaacaaagaatgatctggccccagatgtcaccagagctgaggttgagaagcgcaggtctcaccccactggccactgtggttaatgttcacctggttattcaccaccagaaaggctgccccggtaactcctgttgaataaatttaatcacctaagctcatgtcgtgtatctgcagcatcaaacgtatctcagaaccttggttttatatttcaaaatcttattcttgtttattatcccccatactctgcactttggtactagattaaactacttcagtcatattcacaagagaatctggttaacagaaaattgagtacaagggaaagaaagcatctttcttctaataaattagtgaagggatactaggtatctcctatggcctcagagtttaaaggtgtcaggttttggtttgtttgttctttagctatttgttttttgttttttaatttttttttttgagacagtcttactctgtcacccaggctggagtgcagtgtcgtgatctcggctcactgcaacctccacctcccggatacaggcgattctcctgcctcagcctcctgagtagctgggattacaggcatgcacgtgggtctggctgcattttgtatttttggtagagacagggtttcaccatgttggccaggctggtctccaactcctgacctcaagtgatccacccgcctcagcctcccaaagcactgggattacaggtgtgagccaccgtgcctggcttactttttgtatttttagtagagatggggtttcaccatgttggccaggctggtcttgaactcctgacttcaggtgatccacccacctcggcctcccaaagtgctgagattacaggcgtgagccactgtgcccagtctgttttgttttgttttttaaactgattattaaatcatttaatttcatattggtctgtgtaaatatatttgcaagtgaactttgggtacagttttgctccagtagcattagacaagatgagtccaaatgagattgtcttcattgtgcacttacgaatcactctcctctggccggctgcctctccacactgcagagcaggcctgcagagttggggagccatggtggttgagttccccaagtggcccaggcctcagactgcctctgcataaaagggtgtctgggagaagccgatctaaagcagtaactcggccctatgttaagtcacaaaatatctaaccattacatgcatggtagaaactggtatcttccctgtttctggaaaggaatctgggcagacccaggccgcaaatagtaacgattgggttatctatgctttcagcgatgccatcagaagaaatagtaacactagcttaggaaaaccctctaaatattaggtttaaccatatgaaattgtcaattcttacctataaaaacagcaatctataattcaacctagtacaatatatcatcacctggcacatggtaggttaggttaaaaaaaaatgcctattgaatgagtgaatgaaatcaaccggtgactatagaaaacaccagtctcagcttttgacacagaccacatcaccctcagagaggagaccatgctgtctctccagtttccttttcctttagatgtgagcttcccaaaaacaacagtggccttggaaggggctgctcctggagtctcttgctcatttggtctaagaaggaggctgaggaccagggaccgttgtctgagccaagtctccactccagcacagggcgggggcaacaccccacccaggtaacagttgggcaacgggcacagcaaatcgcagtcctgcttcattaatcctattcattctctttagttccaaaaatacccaagagaatttttatggaaatgacattggatgccaatggtcccaaaaatgcaaggaaaaatagctccttctttgaaatgtctggtattcggggtctggtaggatagggagacgtagtgaagtccaagatcacagtagccttaatgtgaatgttccgcttcagccagagttctcttgggcacttttttttttttttttttgagacggttcacccaggttggagtacagtggtgcaatctcggctcactgcaagctctgcctcagcctccccagtagctgggactacaggtgcccgccaccatgcctcgctaatttttttgtactagagatggggtttcactgtgttagccaggatggtctcgatctcctgaccttgtgatccgcctgcctcggcctcccaaagtgctgggattacaggcgtgagccaccgcgcccggccactcttgggcacttctttacgaaaaccccacataggaaaaaccaggcttccagagtgtctcctgacgtctagttagctattccatttcagagggctccatagcctctcaggaagaatctattctttaaattaaaagctccccaggcatttttaagttgtatgacctgattctcaaaaatgtttcatttataaaaaatgagcatcagctataagatatatatagtgtccgtgcaacttaatgttgggcataccacctcttagaagctaccagctaccatgctgttgttttatgatgtcaacggtgtgtgtgtgtgtgtgtgtgtgtgtgtgtgtgtgacaggcagtgagcagcaactttcaggtgacttaactgcctacatctgtagcttggtgacagtaggtcaaacggtgagttcagggtacagccagaaggcagataaataccgctgtatagaagattctggcagaggctgacagctgctatttccacatctgcttggcacgtcgcttctgagtgatgttgcaagcctcaaaagagatgttccttattttgactcagactatcatgtctttaaaagctgaacagttccttctcttgatgccgtttctctgaactctgacccaggagaggggagaacacttttgatctgccagttttcatcaaggacgctgtttccctcagtgagaggatgaaacccctgacgcccctgctttcccctcccatttcctatgctgtcctgtccccttctgatacctgtccccacacactcatgcacgctgatccactgcgttgcttcccaggccccacccagaaagtgaggaaaggcctgggctgcggtggagcgcaggatgttctctgcggattattcagtgaagtcgagatcttagagaacattgagcataaggcctgcacctatacagctgagggcactgagggtctcgggaaacacagtgatgttctcaagtcagcttttcaaattccgacaagtcctcgttctaggcgtaccatttgatgcacagatctatggacatgtgtgtccataatagccccagagctcctgcctccacagaactggtggctgcatctttggaaagatcgggaaggggcccctcttgcctcatgtgatttcctcactggtggggttaccatgggagtttggagccattggtaaggattccaacacattttcaacgcacaagcttcatgctgacccgccccagccctttgtccttctctcctccactgggcgagtttgccaggcgctcaggcttacttaagacaccctcagtctgagccaaatgtaagaacatgtgctgctgtagcttcccaattttcattcctggcctccagaaaaacatggtgctgtatataacaacacggcttctctgcaagttcagcctaatattttactccatttctctcatcattttggaacattctatttccctgtagaccacctgcctataggaagatagtgattcagacggagcatccacataactgcatctggggaccttatagaggctaaggagcaatccaggatggtggctcagagcacgggttcaaatcccagctctgctacttactagtggtgtgatcttgggcaagttatgtaacctctttgtgcttcagtttcctcatttacatatggagagataatgatgacatctagcagaaaataagcagagaataatagctttgttgctgttgtttttattggagagaaaaggcatttgtgcctggtcagtgagcatcatggaatccaatcaagtgccttctttcattaaaccaaaacagcaggtaggttgtgtgcatttttaagaccttttagaaagtatgcttttatagattaggaatttcagagagaaaagattggacagcttccctaaaaactttgagctatctcattgcaagatttgccctaccaatccgtgcacgaaccctggcccccttcctgatagcaggaggcccaccggtggaagcaagcagctttttaaacgccttcgctgcactcctgcaatgtgcagagacctctggaccaaagaccagagcctactcagcagactcttggttgatgtggacaagctgcctgtgtttcacacggtcgacggtggggaggccaccagggaaaatggaatgtgcagggcttttaaatgtcacgtctggactgtgttggcaggcccatgcagcgctccacaataaacctgtcacaaatgcattgagtcactgggtcctttatttctcatcacggcattctgtggccttgtgttctcttgccagcaaagaatggaacgttcagccccctagacatgccggctgctggattttttaagcaatcatccagcttagataaggggcgtgggctgctggggaatgctgccccaaagcgctgtctccagagcagctgccccaggcatgcttaattccctccctgcccactgtgtgcacccccaagatgcctctcaatatccagacctgcagttccactctgtttgttaggccccccaggagagcgagcctgcagtccgccccagcagaggggaccaggccagggatgcctctttcctctctggagtgttaccttggagtcctgaggccccgtgacaagaccccacacggccgaatcctcagtaacagccctccactgacttggtatccagtgggattcctccctccatcccattctctagggggcagaagcacatctgcccgtcctgtccgcctccccttccatcctgcatcctgtcttctcctctccccgcctcctgctgtgtggcccatgagcccaggagggacccagtctactctgtttacctctcccgctgcccactgagagtcatggctgaggtacatggaaccggcctggtcatagggccgtgctcagcagaacacaagcagaggagatgcctagaactttcaggagcaggtgacaagcagcagagaaatgagtgggggttccagctagtgaaggatggggtggcacagagcatgactgggggccagggatccagccgagaggatggcccgagaaagctctctgaagaggggggatggagacctggctgcgggggaggcacgtccaaagatcaagggggaggagctttctcggcccaagggacagcaagtgcaaaggccagggctgaaggagctgctcctgcccctcacagaaggatgactgagtcttcgacctggtctctctgcacccactctctccttccagcttcccccacgctgcaggcagagagctattctaaaaacatcacttcttatgcttaaaatcatccaggggattcccggtcctccgagataaaagacccgaatctacttggtctgcaaaccctgcctgatctgcccccttctccagccctctaaccttccctctcctcatttattcctatttgtgctgaattttagcacggctcagtcgtcacctcctcgaggaagccttccctaacccatgcattcttctgtgcttgcagaggggaaactgggctgactggttacggagctgctctacaggagcctgctcagtgttctttcttctgccacctttgagtccccgtcatgacccgtcacgaaagtccaggcttttgttgcccccatggctttccaaatggccctgttgaaaacatcccctttgaccctccaaaccactttatggaaaggtccattttcatcatgggagtccctcctcagagagagtcagaacccacatctggtgcccactgtggcatcgtgggcccacgtcagcaggaagggatgggggtgcaggcaggcagtgtgggcaaggagcctcccccagccttagagactgaatgactcaaccccccttgtctacctcccagggatcttgtgtgcccacatgtccaatagggaggtggtgcttgggtccagggacttccttcatcatctagcctcactctgctgtccagtctcacccaacccagaaccttccctccatcatgtcagcctccaccaccaccccagaattcttgagtctcatttaagccactggtaggccccagctgcaaatgcctttgccccacctcccctgcctttcctgcccacctgccttcacctctcccgatttcgctgccacctctcctgctccattaacttgtaacaactcagctcttttctgaattccttatcacacagaaagatgactagatagaaaggctgatacagaaatacatagatactcttacctccccagttagactgtgagctccttggaggcagggcccaaatcttgtggtttgttacatccccattaagacctccatggtaacaacactaatgaacagcgatggtaccttgccttgtgtagttgtcttattgcagggcaccctgcctccctgctgattacaaaccagagggcagggcctacctcccacacgtgcatatccccatggcgcctcactcttgccagttgctcaggaagtgctgtggcagacagtcctgggctgcccttctacctgcctgttgttccacaggcttggtccttcctccccagctaggctgtgaggggcaggacacgtcacagtgttcattctccctgctgcgtgtagcctggaacccagcacaaaacctgtgcttgagtttccctccccaggaggaaaggaaattgtaaacgaggcaccatcgtttacaaaataagttctcatgaaaagaccccaaaacaggaagtgagcttatgaagcataaggattgttcttcatcgttcttataaccaccttcagtactgtctatttatgtatgtatttggttttctgtctcccctaccaaaatggaagccccacaaaagtaggggcccctgcggatctatgcagccgctgtgaatgagcaggaaatgtcatggctcaggttgcctcttgggttcctatgggatcagtttgttaagttaggagagaccgaccccagggagcaggctatgggtgcttagacccttctgaagaaagttccattgagatgagaagtccacctgcccctctggacagctcagagctggtctggcctccagagcttcctgtgggctggggctgtccaggaaccggtcagccaagggtcattttcagagaaggcctggctgccttggcctagactggccactgccatcccccaccagtccccaccagccctgcgctccaaggacaagcacaacctctcagcctgatcttgcaggcatctgctgagagagaaaagcttaaggaccaccctcaggcctgccctttgaaaagccggtggtttcctcctgattccatttcctgacatatcaccagcataggttttattcttgatagggaaggtcaccgtacatcgctgggatctgctgttccattcataagatgagggcgttgagcagagagagtagcctttgaagccatagcccatggctgggggtcagtggtggcagcgtggcctgaggtgcagcttcagagggcccgaagagtggagtgtcagatggtctctgggctcagagagatggcgttctgtggttacagccattgagcctcttggacaatggcttgagtgacctgccatgggctggattcagctcagcagttgtggcagctctcatgatccctgggcctggacggatcagtttccaaatcccacccgcttttcgcgccaggtgtcttgatttccaggccatctttcctctgatctcctggctgtacatgggaaccacacgggagctttgccgataacagatgcctggaccccactccagccagtccggtttagttggtctggggtacagcaggggcactgggatttttaaaaactccttgcgtgaccccagtgtgtggccaaactccagggccacagccccgtccatgccacacacagctgccgcactgatcccctgaaacacagccaagaccttcccagctccgcagccagcgcctcctcgactggacttccccacctgttagggctgaactgtgtccctcagattcacacgttgaagcccaggacatcagaatatgacttcgtttggagataaattctttaaagaggtgatgaagtgaacacgaggctgttagggtgagccctaattccatctgatgggtgctcttaataagagggggaaatgtggacacacagacgctggagatgtgcatgcacagaggaaagaccctgccgaggagagaggcctcaggaggaaccagccctgttgtcaccttgatcttggactttgtatctttagaaccatgaggaagtatatgttgtttaagcggctgggtctgtggcctttgttatggtcgcctgagcagattagcgcaccagcgaggaggaagaggcctccggggaagagcatgagctctagggtcagactccctctgccatttatcaactgacttacccgccctgtgcctcagtttccctgtctgttcagtgggggataacaacagtatagctaccgcataggattcctggtgaggattcaatgagtttgcacatgtgcagcacccggcattgtgagctctgagtggcgttccacctgaacgcccatgactcaccatcacgcagagactgcttccctcctctgcacctgcccccagggctccacgcccccgactccaatttctatttactcccattcttcctccctccatttgaatccctcaccgctgcctgccccctcaccaccgatattagcctgctgaagtccaactcaaattcctcctcccctgctaaatattttcaaatccttctcatcaaaacaacaggcccccttgaattagacctagtatttggccgagtgtggtggctcacgcctgtaatcccagcactttgggaggccgaggcgggcggatcacctgaagtcaggagtttgagaccagcccggccaacatggtgaaaccccgtctctactaaaaatacaaaaattagctgggcgtggtggcatgtgcttgtcccagctacttgggaggctgaggcaggagaatcacttgaactcaggaggcggaggttgcagtgagctgagattgcgccactgcactccagcctgggtaacagagcaagactctgtctaaataacaaaaacaagaacaacaacaacaagaaaaaccctagtatttggctgggcacagtggctcatgcctgtaatcccaacactttgggaggccaaggcagacggatcacttgaggccaggagttgaagaccagcctggccaacatggtgaaaccctgtctctattaaaaatagaaatattagctgggcgtggtggcgcatgcctgtaatcccagctactcgggaggctgaggcacgagaattgcttgatcctgggaggtggaaactgcagtgagccaagattgcaccattgcactctagcctgggcaacagagcaagactctgtctcaaaaaaaaaaaaaaaaaaagacctagtatttgataccacaacagagcaactacaatagtaatttaattgtacatttaaaaataactaaaacagtgtaattggattgtttgtaacacaaaggataaatgcttgaggggacggataccccattcttatgatgtgattattacacattgcatccctgtaccaaaatagctcaggtgcgccataaatatatacacctacaatgtacccacaaaacttaaaaataaaacaaaaaccaacaggctcctccttcatattccaataaaaatgcatttgtactttcattataacatgccagtctgcctttgtacccaaaaaacttattaacaggagctactcatactacaggagagggcacagtgagagcaggaagtcaggggtgggacatagaaggggcctggaatgagctgaagcatacctaccacagaggatgtaaagctgtgccaggaattccagtgcccattatgaagctatgaatgatacaccctttcactctctgaaatgtgcatatttatggaaaattaagagatgatttatccctgagaagaatttgatcttcaccacttctcagcagtaattaaactgcctggcaacccctgtggactggattcccctccttgggagaaaacaaagcttatttggagttacattggcacttttaagcatctgggttacatctgaatggaagcctcccgaggacccagctacatggggcaagatgtgtcaccaggacaggctgggtgggatacctgagctctgctggacccacgagggtctctggtgcctttgggggcattccttcccctctcacctctgtgcccaccggcttctccagaccccattaaaaatcgcatcttgaggatttgcaactccgaggtctcaaggactgataaccgcttggagtgatgccctgtgcaaagtgcctgcaactcagcaaggatccaagttggcctgggactcccaggtctagcaaccagcaggctcccaaaggacaaggacccggactgcctccttctcactgaaccccggggccgagcgtggatgctgcttcacagcaggagtacacaacttcatggcttggagaacgctggggtttcagacatcagctgcagggtaaagggacatagtgtttggccagagaactttcttcacgtcatatccatgtggcttcatctgcttttcctacacgacaggccaccccacacctaccaggagaggcccagggtgttgaagggagtgcagttagattaatttgcccaggagaagccagtgcagctctggggtgcatgggctcacctggcaggagagacttggtccatggggagaagcctgcagtatagatgggacctccaggagcccaagtagcatagaccctgctgatccggggccattgagccagaggatttgggctgaatgtccccagagacaaaagggaaaggtagatcctttcccttaaagatgaaagccatcgcccgggcttgcttattgctctctctcctggtccttccacatgttgtttctgaacatttgttctggcatcacaatccccgtcaccctgtcatctggcccttcccacctttccaccttatctcttgcagtgtctccgcgtcgacctggcacctgggtgaaggcttgctcttgctggtgcccatagcccccagtgtatggtcttgacctccccagccatatggagacccagcctcaggagggcccctcgaggaagcctccccttagcacgaggagttgctcccttctgaggtcctactgtctccaccatcagcacagcacacgggctcttttttcttttcttttttttcttttttttttgagacagagtctcgctctgtcacccaggctggagtgcagtggtgcgacctcagctcactgcaacctccacctcctgggttcaagcgattctcctgcctcagcctcccgagtagctgggattacaggtgcctgtcaccatgcccagctaatttttgtatttttagtagagatgaggtttcaccatgttggccaggctggtcttgaactcctgacctcaagtgatccacctgcctcagcctcccaaagtgctgggattacaggtgtgagccactgcacccggcctgggctctttttttaatgcttgctattttaatttcttttttttttttctcgttttttttcttttcttttcttttctttccttttttttttttttttttttcctgagacaggtgctcgctctgttgcccaggctggagtgcagtggtgcgatcatagctcactgcagcctctatttcctgggctcaggtaatcctcctgcctcagcctcccaagtagctgggattacaggcatgtaccaccatgcatggataattttttaaattttttgtagatatgggtgtctctcactatgttgcccaggctggtcatgaactcctgggctcaggcaatccacccacctctgccttccaaagtactgggattacagacataagccaccaagcccagctgcttgctattaatatttttaatttaattttcctgttgtgtctctcccaagattgtgagtttccctgaggacaaggacagtatcttgcttatttctgcgtctcttggacttcagaggaacttaataaatatttatggaccaccttattgcatattttggcccctttcatacaggaacaaggtctgtttatttgctttgctcaatgggcaacttgctgtgggggctggcttcgttttcaaaattctgcttctcattgggaaaggtagaataattggaggtgtggagatgggtgaggtgcactttttaccctgaatgctctgtagcccttgaaattttaataatcagcatgtgtttatgtattacttttgtaataaaacaagttcttgaaatgatgctgttcatacaaatatcagttgagggaagcaagatgaccttttattggtaaggtttttttttccccgtgattttctccagggcctagactcaaaaaatccttccagaaggccatcacatctctctccatttcgtaaatgtgtctaactaggcaacatctaagggacggcacacagattaggaattttatgtgggctataataggggatcatttgtaaccgcctggagtcatttgcaatattatttcagctgtgtgtggatttcagttagttttgagaatccttctgtcacaccaagatgttcatggaaaaccatttgatgtgttttctcctctcgtttttccctgggaaagggggccagaaaccatgtttatcctaggacccaaaagaggaaaaggccacgtccctccacccctaaagaaaacgcttttatttgaaatgtcttttccatttaccctactttgaataatggagtttttaaactcacttgtttttctaaatattaaattttcaaaggaagaatatttttgagttcaaaatgcctatttcaaatctttaatggttctcttggtctggcattcaccagcaagttttaaagcagcctcccatgggtcaatttgatggctaaaaagatgattccaagccaacatcattggcacataatgtaaagaagactctccccacaaaacttttgcttttcattgtgttctgcagtggccatcagggccatccccctgtctccaggcagggtggtaggtggacctgcgagaggtggaatttggtgggggcaagcagcccagacttgcccagcgcttcccctgacctccaagctccatcagctctgacttgggccttgcaaagtgtttggaccagaggccaacgctacctggagcaggaggccacgcagcagccctccagcttgtccccaactggccccaggctcctgggattcttggacaaatggcccaaatttaccctgaaccttctgctgttgctctggctctgagcttcttcacaacctgcaccgtgtaaaacttgaagactcagaagagcttctgaaatccaaagcaagccaggacttttccccataggtccttctttccgattcctcatcattctacgcgtgtctgctggtccctcgcacctccatgctgcagactggaactctggtcgggttgtcagtttcaagtaacactagtgtttctcaacagggtgctcgtctattggcatttggggtgggcagttctgtgtcctgcatgttgtgggtcatttagcagccctggccagcctgccagattccactatgacaaccaagaacacactctcagccctgggactggagtgggatgcagggcaaacctcagcctttggggagtggggacagtactgacctcaacatggtggggaagagcaccaccttcagcggagggtggggcagtagcaccgcctgctgaggaccaccagtcccccaggttcttagctatgccctggagggcaggagtctctcctcttctgtcctgaatccccagcacccagagtggttagtcctagcctcatagtaggacatcagtaaatatttgcccagtgaatgaataagatctatgaacagtcttcaaaagggcctgtgaacccaatgaaagtgtgccctaaaggtgtgcattgtacacatgtattcgctgcagcaagaacccataacttccctcagattcttcaaggcaactgtggggcatccttaaagggacattcagaaaactggtccagccagtggccactacgggcctgatgtttctgtagctgcaaacatcaccgcaccgtgtttgtgcagtgacttttagagctaccactctgtgtcaatattctaatctccctgcagaagggaccatcctgaacgctccagggactctgcttccgtgagagggcatccaagttgcctaatgcaggggctgcattcagcccttcaacaagaaatggcctgaggcccgggccctttcactcactcacaggagagtggggtaaaaagagggcaggaacaagatatgtttccccccaaactcgagtgtttcttgggtgaccttcccaataaaagtcaaagaactcggagacatcactcagcttgccacaaacccaagctcacacagcagcttggctgaactgaatgagtgagccccgtggcctgcctccttcctgagagttcattgttggtgcagctgttttaataaaagacaatctatgccctgaggcaggaagaacagttgggccaaacccgtggctgagcagagggctcaagctcagacacatctgcagacctgtgcaaaagtgcgagctcaccttgcagccctggagaattctgcttgacctcagggcaggggactctgagtgaggtcgagggtgttgatataatgatgactcatttctgctgctttcccagcattctcctgctggtcttgggttgttcctgtcccagcaagagaagctacagcatccagaaaggacaattggcccagagaacggacaaaaccaagggctggaagcaccacaacccgagagttaacctctaaagcagcaaagcatttgccaagaaatctctgatatcatttggcccagagggatcatacaatttgcagaagctttcagcatataggctagatcagtcatgaccccagataactcccttgagagaagatggaaactcgaggaacccctgctaggccagagcaggcttcttgaacattagtgcgccaaaaaacaatcctctggagagcttgttacatcacagatacccagcccccaactccagagtcacttcagccggggcatctctagcaagctcctaggtgacgctgatgctgccagcctggggaccacgctttgacaaccactggtccccagcagggggttttgcactgtgctccattgtgcccccttgaggggaacagaagggatgggaagaacaagtaaaggggattcagcccggactctcccacctacattcgggacacctctgggtctgtcttccaagtctggcttctgtgattaaataaagaacctctgataaaaaagagaggtgggtccaggcctgcacatgggatgctcccaagaaccaagcctccctcctgctcattccagtgtgtctggggcaggaggctcaaatgttcaaacaaaaccccaaataacaagctaagtgggcagagtcatgagtgagccccacttccagtgcaggcaccatctcagggcagtggagtggcccttcccgtcgggcagccttggcctccatgatggtcttgtgccaggctctctgcagtgggaaggactaccctctctgtggcaagcatgctgctcagctgccccaggggccaggcagcagctttgtccaggagagtgtgcccagtgctgtctggaggcaccctgcatctgcctggtccccaggaccatcagagcctcagcacagccacctcatcctccacaaaccaacctcgacatggataacccatggcctcctggagctcggggatagagcacagcctctgcagcccaagtctcagggtttggctcttgccttcaccacttccaagctgagagacctggggccagtcaacctgtgtaaacctcggtgtcctcgtctgtgaaatggggataattctagtataatacttgagcattaaatgcagttcaccacctgacatggtgtgagccctccagagttttggccaatcgtcattgagtgttttgttttcacattattttcgtgtttctgatgaagcaggagtgtgccgcctgtatcagtttctagggtgccctaacaaacgaccacaaacggggggacttaaaacaataagaatttattgccatacattcctggaggccggaagtctaaaatggaagatgctggcaggtgccagcctcactctgagggctcggggtgtgtcttggtttggaaacacatcactccaggttctgcctgtctgtctctgtcttcttctcataaggacactgatcatatagggtcaggacccaaccctgagtatgactttatcttaatttgattatatatgaaaagactatttccaaataaggtaacgttcacaggtaccagggggtagggcttccacatattactggggaggacacatttcagcccatgaccccactggactggagcaagccctcaggacccagcagccacgaggatcttccgtgtgaagttgtgtgggcttccccagactgtgctaagttctcccaaatggttgtgttttccagggtgttcagacttacatctcttggatatgttgaccccaactgaaagaaagcgacaaggatacatccacgagctcattgtcaccgaggagaactatgtgaatgacctgcagctggtcacagaggtaagggagctggtggggcagggggcacggcagggggcgatgacggagggagaggggagggttccgtcaaggaggtctatgtcctgattctgagcccaagaaactttctgatgtttgaggagcatctggatggcaaatgctataggagattgcgaccgcagagacggttcgttgcttatccatggccaacattgagtcattcccacagagggacagagatcacttagccaagggcaagtgagtccctgagcagttgatggatggagtcatgtgaactgagagtctggagtccacgctctactcagagcagctgcagctcagccaccaaccaggaggtgccatggagccagccacgccgccctcctggcccgcagtgttggcatctggaaatggggggccatctggctgctgtctcgagtcattcctgccatatgttaccctgagacaaacctgtcactgagaatggcaacgtttcctcccaggcccccacaaaagcccctgacctgagtgatgcctcctcatcttgtcagtcctcccagaagggccctggccacctcatccagaactatggggagatgcggagcccggcgctcctgctgctcagcaggccttttgtccacgtccatgggaagatgccatattgggagacagggatttgcagagatggacctgcagtttggagagtgctgtggtagtctggcaaccaccacaccaaacgggtgtgaaaccatcttgtctgatagtcttaacatccaggaaagacgcagcagggctcgccgctgttggaggagtacagggtgggttgttagctgcaggaccaccattaatacttaggaagcattgatgcaaactcaaaaaggtgcccctttctcaaggtgtttgactgttattaaatatgcagttcaggatgtccagggtgcaagtgtcactccttagatatggctcctttttgcactctgcaaaacgcaccaccatatgtggttgccctggtacatgccgggttcaacgtcggcttaaggactcctgtggaataggactcccagggagcagccgcagcccagccaagtttatgtcgaagatgggctgtccccttccctaaagagccttcagaagcgcctcctgtgggagaaaatgacctccttgcaggcgggggcttgcaagtggaacacggggttccactgagatctgtgatttactgagagttgctcaaccacacagagcttggaggggctcattcattttccagagcccaggaggagggcagcactcacccccttgtagcgggcctgcaagtgctgggtctgtccagggtcagcccaggaggctgaggacacagcgatggagtcagtcaccgaggtggccactggcttattagaggagctgccgcctgggctgctcctctcagaaggccctcggtttacctatgcagatgaagggactgtccacagccaccggcacctttaagccccgcttttcacaccggtccagcccctcccagtgcgcaggtgagaccgcttagcctgcgtgcatgacttggtaccggcctccctgcttgtctggtggagttaagacctgtctcctggagacttcagctgccctccttcccctgtaaaacaatgcaggccctgctggggacccccctccggtttccagggcagaggaggggctctctgcttcagaaactgcaggaaagcaggcgttcacctctgggcctctcagccaaggtacagacacctgagccctttccctgctctcagcggatcggcgtgtgagtgtgtgagttttaagctaactgctttctgaactgcttcgttttctgcatctgtagatttttcaaaaacccctgatggagtctgagctgctgacagaaaaagaggttgctatgatttttgtgaactggaaggagctgattatgtgtaatatcaaactactaaagtaagcctctcctctaatccccagcctggcttggcctcctcggctctcatgcactcgcacctctgtgggtctgtgtgtccttcttgcatgctgccctgtgcttctttctggctttttttttttcttctcattgccactcacaaacaccatcacccttttgtgccttcgtgctttctggaaacgcactccgaatctctcattgcaagagtaggtttcctgggcaccccagagcctgctgttgggtgaattactgtggttgtgaatttccagggctagggcgacgctggctcctgatggtgctggctccatgctggggcgtggggctgccccctctacgctttccctcggacgcgggatcccatgggggattattggtcttttgaggcattcttggccctgcagatggaaaaatgtggaactgttcactgcctaacatcagcagttcctcaggatcactccgggaagctggccctaggctggtcgtattttcttccaactttagtttgcagaggcagctccagggccaggagtcaagagacctgggtttggattctgacttactcactgcctttcctttttgagccttagtttccccatctgtaaaatgaaagggttggattcgatcatcacaaagtctcttccaattcttagaaaaaaaaaaaagtcaaaaaccaaaatctgtatccaccacgctctcattgtaacatcacttgctagaacacagattaagtcacagcctgcagggcgcgtgatattccctgctgggaggaagggccacccacttcctgggcccgaggatggagggcaggctccagagccttgcgtccattcctgatcttcatccgtgtcattgggaagtccccatttcctaaatgtggtctctgcattgttcttataaggtaatttcaggtccccactttcctgagcgtgtgtttgggagtggatggagggatggagaggaggtgtggagaggtggacatgaagaaagatacataatgtctgctggcttggtgctctagaagacgaatgatccaaggtgacatcaggcaggcttttagagaaggtctggactccgttgcccgcgccccctgccacccgatgccgtggaagcctttcgaacttaggtctggtgtcacacccttgggctcacatccgctattgcctctggctgtgtgtcttctggcaggtcactttggtccctgggcctcagtgttctcgtctacatagacgatagctgggcacagtggctcatgcctgtaatcccagtgctttgggaggccaaggtgggtggatcacttgaggtcaggagtttgagaccagcctgggcaacatggtgaaaccccatctgtaccaaaaatacaaaaagtagccgggtgtggttgtgggtgcctgtaatcccagctactagggaggctgaggcagaagaatcgcttgaacccgggaggcagaggttgtagtaagccaagatcgcaccactgcactccagcctgggccacgggagtgaaaccctgtctcaaaaaaagaaaaaaaaaaaaaaaaagaaaagaaaatatacctgtaagttaaaacctttttccttgggcagctatcagtgggggctgggggaggcgggagatgtttctgagcttcccaagtagcccttagagagggcttcccccacttcagggttggcctgagggaaactggtgctggcctcagctccccatacctctctgttgtcttttaacccccatctgggaagaagcagcctctttcttgagctgtgtggggggccaggcctgcgtgcttcttcctcctgtcggctctgacttgctccacagttgtggaggtgggaactgacagccctgttacggctgaagcagcaaagctcagagaggctgagtgacttccctaaagtcacacagtagggtggctgctctgtggatgatgcctaggtcccggaatagagactccgcccagtcctgcccccgtggaaaaaaacatgggcccagaagtcagacatcccaagtttttgtctgggctccggccccttctaactagttttgggcattaaggtggcagtcatggtgcttgtcctgcctaccatgcacggtcattctgagagcaagggaatcaggtgtcccaggggcacgccgtccatcagggggctgatgtgtacaggggctgctggcttccctccatcccaaggttctctatccccgttcctctgattcccggattagcttgtttggactaactggctcatgtcttcatcctccagataaaatcttatgttgaaccgtagccttctggggacctgatttctttttcttcttttctgcattttactagaaaaaatctcaaacatacagaaaatttgaaagaattgtagagtgaacacccacatcataaactggacaaaaaacattgtgctgtatttgggtggctgcatagacataatttcttcatgccaaggaataactgtgatgaggggagatcgagggctcctagcagccgagagagggaggcatttgaggataagaagttaaggcagcaatccctggagtgccaccagtgagcggccatatgtctgctactcctgatcctacagtccttgtatttggggggtggggcagggggtagggcagttatcaaacaagtcaacaataaataaataacatgaaaataaaaagggctaactggaacacatggacttcctactaatgatgcctcattgagggttagagcaaatggctggctctcttgcgaggaagctgagacctgagaaatgtgcctttcatagacaaggtagggccagacaggtctagaacctttttatatccagagcctggagcaggaccctcaggacagctgtcagaaatgatggcagaagggccgggtgcggtggctcatgcctgttatcccagcactttgggaggccgaggcgggtggatcatgaggtcaggagattgagaccatcctggataacacggtgaaaccccacatctactaaaaatacaaaaaaatagccaggcgtggtggcgggcgcctgtagtcccagctactcgggaggctgaggcaggagaatggtgtgaacctgggaggtggagtttgcagtgagctgagatcgcaccactgcactccagcctgggcgacagagtgagactccgtctcaaaaaataaataaataaataaataaaaaagaaacgtcatctctactaaaaaaaaaaaaaaaaaaaaaaagagctgtgcgtggtggcgcatgcctgtaatacaaactactcaggagtctgaggcagaagaattgcttgaacccggtgggggcagaggctgcagtaaaccaagatcgtgccactgcacttcagcctgggcaacagagtgagactgtgtcacaaaaaaaaaaaaaaaaaaaaaaaatgatagcagaagggaagcagaagtgaggtggggtgaccaacccaggtttggggaactgttttttatcaagaggctttcctgtcccctcgatggaaaaagaaaagaaaaaaaaaataagagcttgtcccaaaacagtgtttttcttaaatatctgactcatcttctttttaacttaagaagaatggattccattttatcttgtttaagcagaaaatgaaggaaaaataaaaaataaaaatcagtttggggtaatgacagatggtgagaaagaagaagaaaaggatgtggggttgggagaaggagaagagggaaggagagagggcatggagcagatggtgggaagtccagcagggcgggaagtgcagaggctgaggctgggaccagcagggaaaggcttgagggcgagatggcgggagcagggcagccgcgtctgggaagatgggcaggtgcccagagcagcttggaggcagtcgtggcgggaggtgggttggggcctctgaggctgtggtcccaaccatgggctctggagtcagacctgggttccagggttacctctgtcacctattagctctgagacttgggtcaagtcactgaatttctgcatgcctgagtttccccaataggaaatggggataataatatatgtaaaactctgtttgacacataggaagcattaataaatgctagttccatgactgtccacttggtctgcagacttcagagggttacagacactcatgtgttcagcaatcattgagcgctctttgaaacatttgttagccagttaattgccttttgcagttcaagtcctctcatctgtaaacctttctaggagactgccgatcagctcaccgcaagcagagtactcttagggctgtggctgcagcagccgagtcacatgatccctgggcctggtaacaccttgcggtcttcataagtctttgcctatacagtagaccatcctggacgaagacccatgactgaatctaataggtgcctagtccatagtaaatcaggctttaattttaggcctgtctgctggttgggtaactctgttctacaagtgtgggtctgcagaacccaggaactaattcctcaagacaatcactgtctgcagatgctctttcttcttttcttttcttcttgtctccttcatcctttaataaaaaacaggccagcggccggggccgggcacggtggctcatgcctataatcccagcactttgggaggccaaggtgggtggatcacttgaggtcagcagttcgagaccagcctggccaacatggcgaaaccccatctctactaaaaaaataaaaattagctgggcatggtggcgggtgcctgtagtcccagccactcgggagactgaggtggaggttgtagagctgggattgcaccactgcactccagcctgggctacagagtgagactctgtctcaaacaaaacaaaacaaaataggagaaggaaagggtgaaagtactttttattcacttgttaaaaaaactactcctcataggaaaatgatggaatgatggaatttcttcctgtttccattcattgcaagtttataacgtggctatccagggctctcatccccccaaattattggtgtcatcacccttgagcacatttttgctcgttgtggtatttcacaccaacccctcaatggggcagtggcctttgggccatcctgaggacaccaagctgccactgctccccacaccccagaggcagccagtgctgatctccccatgagggcatccacttcaggtggaatcgctgactgctcacaccacatcatttatggtccctaagtttttctccttggcttgcccggtccaagggactttattttagccaaaaatgtgggagaaagaaaagaaagtgatctgaagtttttaaagcctaatataaatattgcagagcttccttggaattcaatagcccgccccgtacctcaaaggcttctccaacatgaccatgaaagcagccaaaggcattcaatagggacatcctcccagccttgtgttaaagtcataggttataccattttgttccatctacccatccatccacccatgatcactaactaggatagctgaacacacccatggcttcatgttgtggtcctgccatgtagtaccttgctgtccttaccgtgtataagctcagtgccatgcccttcttccagatgctggtgttaagggttcacatgttgaagttgggagaggggaagcacagtcctagttaccatagctctgagcactcacactgcaggcagaccccagaacacacacttcccagtcccatcaacacctctcctgaattccaggatatacattttttgggttcattggcccattatcatagtaatagacctcttttccgaactcctcttaatttagttaactcagctctagcaatgaagcagcgaatcacagagatacttcaaacagtcatttatacctggcttttgctgaatctcatgggattattttgccaaggcatttgttttgccatcttaattatgttctttttagccaaaaatcatccttccccatcctctggcaatagcaacttcccttgggcagaagtgtctcctggaaataggatcagtgctcaggccacatcaacctggggctttcaccaccgataatctgtgtagtgaggcatcgacacaggggacccatttgagttgttcaagaaaaaaactccatatttctgcacaagaaaaacaaattgtaacaaacagccactctgccaaagaaaaatgctctggtgctacctctctgtagccctagactcatttctttctccattccttgtctcccaaatagatcctttagtggcccttaaggctgtgcccctcacacacattctgtttctgtgcaacctaagtgtgctgtggtgctgtcagatagcgtgaaagcagggggctcacctcccgtgtttccgtgcagagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaagtaaggagccaggctgtgcagagactgggccccagagtggcgatctttgggcagctggatgtgtgaggggctaattcaaaagtctgcaagagtgttcccactagaggccaacagggcctagggtcttggctaagccttaggggactggcactcactggcaagtgtggctgtcaccaaaggggtgggcttggagaggaggggtgaaccctgggcttggaagctttgaaagtgtctttagggatctgttttccagatgctattggtgttatttggatgcatgtttaaatctttcatttcatttgcaaggcccaggcaggtcttagatttcctcttgtgtttaatcgccacatcctcagttctttgctggtctctgcccttcacttgcagagggaatggccaggactcccagtggccccttcattcctttcgcagttggttctgcttgatgtgctcccgccttagacagcctgtgggagtcagtgtgggatgccaggacctcttccttggaggtagcagggatctggagagttgggagtccaccaggggatgtttggggaggtaatgcggatactgctggaagacctgcagctctgggacttggccttggccagtgtgggtctctgctggccgtgctgggccattcaaacagcccccacatctcctggagaaaaaaaggaggaagagaataaaatagcttctgtgaaacaggtatcttttgatgaataaacaacaaaataataataacaggcatatctttggatctcatgcattttggagacaggccatcctcacctgtcctagagtggtgcttgtggaatcactgtggtgaggcacaagcgcagcctcttcttggtcagagcctcatgtgagcttgttgtttctgcctctcatggtgtttctcagcctagacttgccagccaaggcatggggcactctgaggtcattccaaggggagaaagattgctaagaaggaggccttgggtggatggagacgagagagcagatgctgagctgctgggcgccatggaccacctagggtttcagccaagggctgggctcttcctaggcccgagcaagatgagttcattgttggatgcacttgaacttcaggaaagtgctgacaccagcccagagcaggggcctcattgtccctccccgcccctctcctcttcacctctccccacctcctctcagtgggaatgtggcacgtcgttgccagctgcgaggtgttcctggaatgatggtgtccacagctggagcaggtcccggtccctggagacagttatcaggtctcagggctccagtcaatgcagctgcccgtttctaaggcattaaaccagaccacagcctttgacagctaagtggccagaccctgaaactggagtcttgacccccgttgtctgagctcctctttctcagccctgcctggagttcccagaggcacgtgcaggctccactcaaaactagacaatgagatttagcccttccagcagttctggggtgtaaggggaatttttcctctaaccgtatagtcttgtgactcttgttcctgggaatgttataaagtttctgcagacatccagacgaaatattctgtgtaaagccagaatctcatctctgtgcataaggaaccatgcatgccatggagggtatgctgaatccagagtgcagggcttaaccctgctggctgagtcacatctgtgggtctccattctccatctggaaagtgtgtcatcctggacagggtaactagtcaggcccttccaaccccaggtctctcagttgtcatccagataaatgagataatgggtggagagtcctcactgacattagtattgatgtcactaactttggattttgcaagtttcttaagtacatttaaaaacatctcatttcagagattggcaatggatcctcggtgtaaagggatgccactctctagttttatactgaagcctatgcaacgggtaacaagatacccactgatcattaaaaatgtaagtacctgtcttgccttttcaagcaggggacggctttctctgcattggagagggctggggtcatggacaagattcccagtgaacatatctggtaactgttgtgtagaaagcacgagacaacaaggtgtcacagaggtctgcttggtaactcagaaagaaaagctggtttatcacgcaaagagctggctgggcacggtggcccgcgcctgtaatcccagcactttgggaggccgaggtgggcagatcgcttgagcccagaagttcaagcccagcctgggcagcataatgagaccctatctctattaaaaaaaaaaaaaaaaaagagagctaatactgtgtccggaattggtgggttcttggtctcactgacttcaagaatgaagccgcagaccctcgcggtgagtgttacagctcttaaggtggcgcgtctggagtttgttccttctgatgttcagatgtgttcggagtttcttccttctggtgggttcgtggtctcgctggctcaagagtgaagctgcagaccttcgcggtgagtgttacagctcttaaggcagcgcgtctggagttgttcgttcctcccggtgggctcgtggtctcgctagctcaggagtgaagctgcagactttcgcggtgttacagctcataaaagcagtgtggacccaaagagtgagcagcagcaagatttattgcaaagagtgaaagaacaaagcttccacggtgtggaaagggaccgagccggttgccactgctggctcgggcagcctgcttttattctcttatctggccccacccacatcctgctgattggtagagcccagtggcctgttttgacagggggctgattggtgcctttacaatccctgagctagacataaagattctccacgtccccaccagactcaggagcctagctggcttcacccagtggatcccacaccggggctgcagctggagctgcctgccagtctcgcgccatgcactcgcactcctcaggccttgggtggtcgatgggactgggcgccgtggagcagggggcggcgctcgtcggggaggctcgggctgcacaggaacccacggaggcaggggaaggctcaggcatggcgggctgcagtcccgagccctgccccgcgggaaggcagctaaggcccgctgagaaatcgagcgcagcgccggtgggctggcactgctgggggacccagtacaccctccgcagccgctggcccgggtgctaagtccctcattgcccggagccagcagggccggccggctgctccgagtgcggggcacgccaagcccacgcccacccggaactccagctggcccgcaagcgccgcacgcagccccggttcctgctcgcgcctctccctccacacctccctgcaagctgagggagggggcttcggccttggccagcccagaagggggctcccagagtgcagtggtgggctgaagggctcctcaagtgctgccaaagtgggagcccaggcagaggaggcaccgagagcgagcgagggctgtgaggactgccagcacgctgtcacctctcaatactgcacagccttcagatgtgtgaccaagtggcttctaccttgtaagtcagaaaatgagagcttagtcgttgattctttttttaatttttttttttctagaagaaaataacatggaatcacagaaacagtctgtggtctgtgcctttctcccttgactctttcttaaagacaggcccagtgcctctaggccttgattttcttagcagaaaagagaaagaaacgtaatgctacgacctgtcttcagaaggccattgtgaaacactgtattagtccattctcacactgttgtaaaggactgcccaagactgggtaattaataaggaaagaggtttaattgactcagttccacatggctggggaggactcaggaaacttacaatcatggtggaaggggaagcaaacacatccttcttcacataatggcaagaaggagaagaatgggagcccagcgaagggggaaaccccttacaaaaccatcagatattgtgagaactcactcactctcactagaacaggatgggggaagccaccccaacgattcaattatctccacctggtctctcccacaacatgtgggaattatgggaactacaattcaagatgagatttgggtggaggcgcagccaaaccatgtcagacactgtgtgttgatattagatgattgttcttctcctgtcactttgagaaagccgataccaaaagaaaaaagaaagaacaaaattagggtttcagtgtccccacctgtaaaatgagtgaacagatttagatgtcctctgagcctatgtttgtaaaaccacagggagtatagctcctggaaagaggttttagatctggttccttttaatggaaaatggtgtttagaaactcagatgtgggcactggcgtgctcattgctactggggtgattttgttttgtgttcctctcggtggcagagctgggaaatatatgaatgtcttttcatgcacacatatttacatatgccaatgtatatacacatatatttatatttatttctagatccatctatccatgtatattagaactcatgaattcacaccagtacctcctattctaatccaatactgcagaattttttccagcctttccccttctgcctttgtaactccctactctgtgaagagcctggctctcattatcctcaatgtgtttccttatttgctcagtcttcttacatgtgacaaaactccctcccacataagccatctcctcagtccagccccagctcaactccacaaaatacactgtggatctttggctgagttaaatacttagttttgaagtaagttttcaacttactgttttctctcttccaacaccacagttactatttaattagctcagtacttctcttttttctcccaatgtttaattgcaaattgaagttgaaaacaagcttttaaaataggtgttctatatctagccaatgggagaaaaactaaaacaagaaaaggactgcatggcccaaatatttaaaagggggaaaaaaactcattatttgcagaaacacgattgatttcttccagagcacccacaaaaatgaactgaaaaccagctgaactaagaagagaattgaaaacagtggtcagctatgagatacatatgaaatctgctaaagtactaatactaaatatttttatgatactgatgtggagaaattcttagcatggtctcaaagacatgctaatcctaaacttaaaggatttagatcatagcaacctaaaaaatacccaaactttcatctgggcatagtggctcacacccataataccagcactttggaagaccaagacgggtagatcacttgaggtcaggagttcaagactagcctggccaacagggtgagaccctgtctctactaaaaacacagaaaaaattagccgggagtgatggtgtgtcaggtttgaggcccagctgaggtctgaggggagtgggtgaacgtggggcagggagctggaagaacacttgagagacagcaggtagatgggacatggcacagaattgtgcacctgcactctaatccccctgagtcatgcaggctgtttacatctgcgtatgcctgcctggttgcagcacagccatgttccctacatgatgtgtatctgtaatcccagctgctcgagaggctgaggcaggagaatatcttgaacctggcaggcagaggttgcagtgagccaagatcacaccacagcactccagcctgggtgacagagtgggactctgtctcaaaaaaaaaacaaaaaacaaaaacccaaattttattctggggaacaacgtatatgttcattaatgggaatggttaaataattatggtagatctgtactatgaaaatatttaaaaagatacagagcaacttctactcatgtattagtgtggaaagacactgagaaaatgctgttatgtgaaaaagcaacactaaactcactgagcaatcctatggtatgatgcattttgcaagaagaggggaaagagctatgattgagtcactgcactccagcctgggtgacagagtgaaactctgtctcaaaaaaacaaaaaaaaaaacaaaaaacaaaaaggccggatgtggtggctcacacttgtaatcccagcactttgggaggccgaggcaggcagatcccgaggtcaagagatcaagatcatcctggccaacatggtgaagcccgtctctactaaaaatacaaaaattagctgggcatggtggtgcatgcctgtagtcccagctactcaggaggctgaggcaggagaattgcttaaacccacgaggtgaaagttgcagtgagccgagatcgcgccactgcactccagcctggcgacagagcgagactcagtctcaaaaaaaaaaaaagaaaagatagaatatagaacttgaagttgctgagaggcagtaggcagtatggaatagcagtgaagagcacatagcctggagccaggctggctggggtttgaatcttgctacttaaccactgtgtgctcttgggcaagttgggcctcagtttcttgtctgtaaaatagggacactgatagtacctactgcatagtgatgtgggaattaactgagttaatgtatgcaaagtggctcatactaggcagtatataaatgttagttttatcattgagaacacttatgcgctaaatgtacaaaaagttcacactcacaggtaataaaagaaaatacataacaaaacaagaaaatactttgattttggcttgccagatgagcgtatattgaaaagattataggtcccagtgttggcaaagatctgggtggaagttaaattgatacagccttttttggaaggcgattatagatcaaactataattcctctttggctcagcaattccacctctaggaatttattctaaggaaataatttaagaaatattgaaaagttggaagcaacataaagttttatgggaaggtaactatttagacgcattgtgctcaataacgtgctcaatgaatattggggtctaccccaataatgatatattataaaaccctcaaaatgataatatgtatgaaatggacatggaacattgtactataaagcaatgtatgaaatagtacagtataaaatggtagtttttgtaaaatggtagtatgatccaatttttatttttatttttatttacttttttttgagacagagtctcgctctgtcacccagtctggagtgcagtggcacgatctcagctcactgcaatgtccgcctcctgggttcaagtgattctcctgcctcacccttctgagtagctgaaaccacaggcaggtacaatcacgcccggctaatttttgtgtttttagtggagacggggtttgaccatgttggccaggcttgtctcaaactcctgacttcaagtgatcatcctgcttcggcctcccaaagcaatttttattcttgaaataatggggagattattagtgatttttaggttctttataactttttgaattttctaaattttgtacattgtacaatattacttttgtcattagaaaaattgataaacctgtttgaattttgaaactaaacaaaacaaatgaatttactcaagccagctgggtgggttcctagcctgtagtagtggttctcagatttgactgcatgttagaacatctggaaacctctagaaaacccctaagcctgagtttcaccctccagggattttgatttagtcatggatgaggcctcagattttccaaaaggattctaacgtacagtcaggattggcccagaggttggggttgttgcttggaattgatttgtggactcacaagacatagaaaacagtgtgtgtttttctccatttgagcatctacttaggactttaaaccacggtatgcctttgggataagatattcagagtcagggccatttacattgtttgtatgtggacaaggcctgggcaaatatgccctcggcattctcctggtacacttcaaaggtggcttagggtctttcttcattctccagcacagggtgataattgtttttaggggcctggaagtcctttgaggatctgatggtaatcactgttgcttattgagcactttctaagggccaggtgctttgccaagaggtccacgtgtctcatttagttctccacacaccatataaaggaggctattaacctctccatttctcatgcgaggaacctgagactcagaacatttatgtgggccaggcgtggtggctcacgcctgtaatccccgcactttgggaggctgaggcaggcagatcacttgaggccaggagtttgagatcagtctggccaacatggcgagacccccgtctccactaaaaatacaaaaattagctgggcatggtggcgcacacctgttgtcccagctactcaggaagctgtggcaggaggattgcttcaacctgggaggcagaggttgcagtgagatgagatcgtgccactgttctccagcctgggtgacagaacgagacaaaaagaacatttatggctgggtgcggtggctcgcgcctgtaatcccagcactttgggaggccgaggcaggcagaacatctgaggtcaggagttcaagaccagcctggccagcatggtgaaacccccatctctactaaaaatacaaaaattagccaggcgtggtggctgtagtcccagctactcgggaggctgaggcagaagaattgcttgaaacccgggaggcagaggttgcagtgagccgagatagcgccactgcattccagcctgggcaacaagagcaaaactccgtctcaaaaaaaaaaaaaaaaaaaaaagaacatttatataaccaacccaaatcatgggtggtctgtggtggggcagggatttaaattcaggaggtccagctccggagctggcattcttagccaccaccccaaatggtctgcttagaaaagcgcacacttgctctgatgcacccgtctgcatgtggttccagaggcgcgtggacccaggaaggagccacccttgctgcagccaccgctcctcttatgccccaggctgcatgctaagcatagactgcgctgtccctgccctgccctccaagggcacctgttggctcttagaccctcatcagtgggttgatggaacactgcacatcaaatgccagaattgcattgtatgttccccaagtgagtgaacaggtgggaaaatagcacggaactgggcctgggatgcctgggctctgctcctggtctcagggactagtttattcctctgtgaaacagggtgaatattttctttttctttctttttttttttttgagacggagcctctctccgttgctgggctggagtgcagtggcgcaatcttggctcactacaacctctgcctcctgggttcaagcgattcttctgcctcagccccccgagtagctgggacgacaggcatgcgccaccacgcccagctaatttttgtatttttaatagagatggggtttcaccatgttggccaggatggtctcgatctcttgaccttgtgatctgcccaccttggcctcccgaagtgctgggattacaggcgtgagccactgtgcccggccaagggtaaatattttcaaagagaaactctaagggccccatggttatatgtacacactgtgatcctgtgagtctgcatgtgtggcttggggtccaccctgcgatgttaacattttgccggacagatcacatagcttgccctggacattcagggtgtggggctggactgagacctcaaggatgggaccattcactgcttcccgcaatgccacccactggagccatcaaggagtggccgtcatctgctacgtgattgccatgtgggtgctcagagctgcgattgctcaagtgggcgccgtccatgaaaggatggtgccctgccccgctgggcctggtcctgcaggaccctggatcacaggcccgcccacattgcctaaaaggaggtggttgtttttattctcctgtgtagatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgaggtagccaaccttggggctgggccctggtctcccccggcagagcctcgcctgccagcctggaggaggacaaagaaaagcatgaaccattctcctccccagccgatagcatcctcatttccatccagctgcttctcatctgctgtttcatccacccactgagtatttatttatttatttgagatagagtctcactctgttgcccaggttggagtgcagtggcaccatctcagctcactgcaacctccgcctccccggttccagtgattctcctgcctcagcctcctgaatagctgggactacaggcacacgccactacacccggctaatttttgtatttttagtagagatggggtttcccgtgttggccaggctggtcttgaactcctggcctcaggtgatctgcccacctcggcctcccaaagtgctgggattacaggcatgagccaccgcgcctggccatccactgagtttctaatttaaattatatcatttcccattgccagaagttctatttattttctcctgtctgctgatttctttctttctctttctccctttttctttcctctttctttctttccttctttctttctttctttctttctttctttctttctttctttctttctttctctctctccctctttctttctttccttccttccttctctctttctccttccttcctctcttctttttctctttctttccttctctctctctttcttctccttccttcctctcttctttttctctctttctttccttctctctctctttctttctccttccttccttccttccttctttccttccttcctttctccttctcttctcttcttttttcttttctttctttcaacaggatcttgctctgtcacccaggctgctggaatgcagtggcacaatcccagttcaatgcagcctggaccacctgagctcaagtgatcttcccacttcagcatcccaagtagctgggaccacaggtgcatgccaccatgcccagctatgctggtttctttcttgtatcttgttttttgctcaaatgttaatccttcttatttatttcttaacacattttaaacatagatattcctggccaggtgccgtgactcacgcctgtaatcccagtgctttgggaagtggaggcaggaggctagtttgtgttcaagatcagcctggaaacagagtgagaccctgtctatacaaaaaaataaaaagtaaattagctgggtgcagtggttcacacttgaggtgggaggattgcttgagcccaggagttcaagggtaaggtgagctatgatcacgctactatactccagcctgggcaacagagcagaatgtgtctcaaaacaacaaacagatatagatatagatgtagatatagatatagatatagaacccataacctgaagttatgggtgttattgttttgtctgttgtttctgccagctcttgctaaacttactaccttgtttcttgtattacgatttttgactgtgaactaaatgttccttagaactttacctgtgggcaccttttttttttttgaaatggagtctcgctctgtcacccagggtggagtgcagtggtgtgatctcggctccccgcaacctctgcctcccaggttcaagcagttctcctgcctcagcctcaaaagtagctgggattacaggtgcgcaccaccatgcctggctaatttttatatttttaggagagacagggtttcaccatgttgaccagtctggtctcgaactcctggcctcagaagatccacctgcctcagcctcccaaagtgctgggattacaggcgtgattaccgcacctggcccacctgcaggcatctttattgtctgaagttgtattccttctggaaggactgttattgtgattatccaaaactatgtttagaggggtttgggcatcacagcccttgtgtgaatcgtggttgtaaacttgcgtgagagctacctgataaagcacacattctcagggcacgttttccttcactacaccaaggtcaaaaacagaaatgttttattgctcatcccctctgagcttgagtttacctgtcactcctcctctgggttcatctttttgtgaagatctcctagtagacccctcacgttggctctggatgcacctgtttctgcaccctatgtagtgagtaaaatgcaaggtcagcgtcagcagattcaagagagaccctcaaagctatagtggcactggctttcggtgatcttccaaggttcctattttcattctgttttcagcctctgcaaatttcttactttgtttctattttgtgtgtgtgtgtgtgtgtgtgtgtgtgtgtgtgtgccagttttcttggagttaaaaagtggatttttgcatttttctgtttttttaaagtttttgttgggtgagtcattctgagtatctagtccactctacttccagcaacagaagtctctctctgtctctctttctctttctctctctctttgtgtgtgtgtgtgtgtgtgtgtgtgtgtgtgtgtgtgtttgttttagtcagggtctcactctgttgcccaggctggagtgcagtggcacaaactcagctcactgcagcctcaacctcctcgagtgattctcccatctcagctttccaagtagctgggactacaggcattggccaccatgcccagctaatgattctattttttttgtagagacaaggactcaccatgttgcccaggctggtctcaaactcctgagctcaagcgatctgcccgccttaacctcccaaagtgctgggattacaggtgtgagccaccacgcctggccagaagcctctcatttggtttctaattttcttcttttcacttaacctttcctttggtctcattcattctttttgcccattttttctctctgtttctgtatacacatgtgcttgtgcctgtacacacatacatacatgcatgtatgcacacacatacaccattcactagggtttcccaaaatgaccagcgagaatgtgtctccctcatccactcctcctgtggtttcttccctctcataagctgcaaaggccatcaccacctgagggagtcaccatgactggttcctccacggccccatctcctgtccaccttcagtgttggtgtgggatgagcaaaggtgtggaagcagccccgtggaagccgagaggacagctgtgggctcccattttgggattttgtgttgctctgctgtcagtgggtggctcatttattcgctcatcatcattcattcaataagcacttagtgagtaaccacccatgtgccacggctcagtactaaaccctgggacataaaaacaaataagatgtgactcccactctcgaggagcttatggtccaggaggaagctgggggttaaaccaacatttacaacaagatgtgaggggtaaggaggcagagctaggtgccaagtgctgtggcgacatgtgacaggagcaagggacagttgtacgggggactctcgggccctggaggtgatgcttgactgcgtgttgcaggatgaagcattggaggcaggccaagcaccgtgtctcaggcctgtaatcccagcactttgagaggccaaggcaggaggatcccttgaggccagaagttcaagaccagcctgggcaacatagtgagaccctgtctctacaaaaaatgtttagaaaactaaccaggtgtggtggcatgcacctgtagtctcagctacttgggaggctgaggcaggaggatcgcttgagcccaggagtttgaggctgcagtgagccatgatcgcaccactatactccaacgtgggcaacagagcaagaccctgtctcagaaaaaaaagaaagattgaggcagggcattaggagtggaggaccattctgagattctgagcagggcattggtgaggattgcagaggaatgatgggccacagggctgcagggcaggctgaggcccagccgaggaaggcctgtgtataatgcaaaggaacattaacttgatcctgaagacaagggactcaagcagcccctgcactgccacgcagaaatgccgacacacagtcatgtgcactttagaaagggcccttccccgactctgacagctgccatcagagggacacagtgaggccgggatctgaagatgttaaagtaaaatcagttgtcatccttctttttttttgagacagagtctcactctcttacccaagctggagtgcagaggtgcgatctcggctcactgcaacctccacctcatgggttcaagagattctcctgcctcagcttcccgagtagctggaactataggggcccagaaccacacccagctaatttttgtatttttagtagagacggggtttcgccatgttggccaggctggtctccaactcctgaactcaggtgatctgcccacctcggcctcccaaagtgttgggattacaggtgtgatccactgcatccagcctagttcttgtgctttgattttttcagcttacatcccccctttgccatcagatggctgtccttcttggtcagtcttcctggctatcatgcacagcgtcgttgttgtcttgatgatgttcatggtgatgggaaggggatgtgttgacttctgtctcctgacctaggatcacggtgtggaccatgcgtggcccaggtctggacacacaccagtgattaagtttcaaacagatgctgtttttggcattcctgtctgaagatagagaagtttaaatactgttcccagttcatgcatattcagtgttatcttggccaattagaggctttgagtatgaatgaacgagagcacctttatgtcattggatccaatgacacttgccttctctggattatttgcgcccacgtggcttgaaccctgtcttggcaagcaggaagggctggttggtctccaggctcctgcctggagtgcagaggtgaagaatgttctttgaaggttcctgttgtggcaccaccttcggtctttcttgggctctcagaccctccacaggaggtcagaggtcatctttcctcctcgtggctgacagcagagtgcagtggcccctttccagctgcctttagctctccactcacagaagtgccactgtttctcctgtattggagatggacaggtggccatcagcttcttttgggggacacatgttacgaacctatcactccttcacaaatactctcttcagagaggggtccatagggctcgtagctcaggacagagctccggagcgccccccaggccaattgtgtgggcagatggggagcgtgaggggctggcctcggactgggtcatcttactcctggcgcgcagccatggccttgctatccttggcctctccccttgctgtcaaaaagggggcctctgtgggatcatctccacctcagtgccctctgccccttcagaacctagtggaggtgatggacccccgagaggtgttagagccgcgtttcagcgcccaccgtgtctctaagggtcagtggagggagggagctgttcccttcctgtttgctgagcgggtgagtcgggtgaggtttcatgtgcgcagtacagtgtctgttctgtttggcactggagggtcgctcaacaccactgatttacagctgggtatggtggctcacgccggtaatcccagcactttgggaggccaaggcaggtggatcacgaggtcaggagattgagaccatcctggctaacatggtgaaaccccgtctctactaaaaatacaaaaaattagccgggcgtggtcgcgagcacctgtagtcccagctacccgggaggctgaggcaggagaatggcgtcaacccgggaggcggagcttgcagtgagcagagattgtgccactgcactccagcctgggcgacagagtgagactctgtctcaaaaaaaaaaaaaaaaaaaaaattaacaccactgatttgtgcagtcacacacatgccaggggcccggactgcagttgtgccttggaaggcagcatttgtccatggaattggagagagacgggggctgctgctttccagaagctcaaaggactgtctgaatctgtgtggggttttctccctggagctgtttcatgcacagaccctgcatagagcagggagtccccaaggtgggagccaggtgggcacttttctttctgctgccccatttccccagtaaataaaaaagagaaatggccaagcccagtggctcacacctgtaatcccagtattttgggagcttgaggtggaacgatcgcttgaagtcagaagttcaagaccagcctgggcaaagtagggagaccccatctctacaaaagtttttttcacatgtgttggggggctgagatgggagaattgcttgaacctgggaggtcaaggctacctgaactatgatcacaccactgcactccagcctgggcaacatagtgagaccctgtctcaaaaaaaaaaaaaaaaaagaaaagaaaaaacacaccagttgcaccataagacactggcatgctcctagaggaaaagccttagaaattaccattgagactcttcttgatacttggaatcccctgaactgtgcctttgtctgactttgatctcttggctccaaagtcttcaaagctatccttgacttttgcctgagatccgagtctgctggggcctggcctctgattctgatggagcccatgctttcagatgcggagaaacaaaaatgctacactttgggttttgttttcctttctcagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacagtaagttggattctagattttgcattatcagggttgacgtgtttggggaggaagaagtttccaaaaaggaggtagagttttagcagggtcaggggctgtggcatgcaggagaaggccaggagttgaaatgcgatttagggtgtccggagtggaggacgatccatatcccgccgcagtgtcagtgacactcagtgctatcggtggaacatattggctgccaaatggctgctgtggtcccctgggatgtgacagaggcatgctttagcctgtaggagcgaagtctagggtacagatgaggcaggtgtgaaaaagctcgggagaagaggtgcaaaacagcacccagggcccaccgtcgcctccaaacagtcctaagtcccctgccagacttctccaggtagcttgaaacatccgagccccctcctttctagcaaagtctctctaaacagttgatacgtggagaatttccctcagctgtttatatggtctgctcatacgtgcatggctgtgtttgtgtgtctttgtgtcacgggacgttgtttttctaaatttgtctgcatgggggtgtttttacagaagaattttctctgaggcagcagttagctttattatgggaaaaaaaagagctatgtagttatatagttactagaaacttcatgtgaaaatctttggagggaattgcttgatgtaaagtggatgaaaactgctgtttagaatacaccaggaaaagcgacaccagccagatcttattctgaaagacttaaaacatacccgcaaaatcgtgggcgggggaacccatatttatcatatttataatttgtaatatgtaaaagttgatgctaacccaaaattattattctgggattctttactggaaaacacacacgcccttagtctggtttactggaacacacccagaaacacacacacatgctcagtctaggttactgaaacacacgcacgagtgtgcacacacgcgctgacttgcagtctcgtttactagaacacattggcataagtgtgctcacacactcacggtttaccggagcacacagacccccagcctcgctttgtaatgcctgtgtgttactttccagcctattttcctaaatgaggttctagtaaaattacccaccgacccttctggagacgagcccatcttccacatctcccacattgaccgcgtctatactctccgagcagaaagcataaatgaaaggtgagacctgccgcctccccagcatgggccccagggctccacggctctaggacacacaaggggcgggtgattaatcaggtgccaatgtttcccaagtggcaatgccatcacccctagctgggagtggggatggggctattacttttttctacagcctctcaaaaatctgtcacatggcatgccctttccaaaataacatggattcaaactaattttgcttgagtttttttttttttttttttttttaaggcagagtctcactctgtcacccaggctggagtgcagtagtgcagtcacagctcactgcagccttaacctcctgggctcaggtaatcctcccaccctagcctcccaggtatgtgggactacaggcatgtgctaccaagcctggctaattctttatatttttttgtagagatgggttcttgccatgttgcccaggctggtcttaaactcctgggctcaagggatccacccgccttggcctcccagaatgccagaattctgggattacaggggtgagccactgcacctggcattgttgttgttgttgttgttgttttattaagaaatgtttcgcattctttgaggtaaacagagcatctcaggtttcccctggcttcccaggtggcagaaaccaataggaaagtaatttcggggttaataggaccacgcaaacccaaacctctcctcaccttggctgacttaaatgggcattctggaacctagggctgtgggtattttgcttcaatctgtcttcaagacactgccctggagccaaatgaaatagatcattttctgaagggtgaacttgacacaaggccagcatcattccaaagagcatttgcaccaagcaagaaaattggctaaagcttttgtgcatatggttctcagaaaaaatgaaggagaaaaccgcggccacaaatgccttcccccaaggcgttttggtctttcgtgtgaagtggttcccaatctgggaagtggtttttgttctttctttgcgtgatttcataagcgagatccttctggctttgttggattaggcaaatatgtgctgctcttcggtaaggaaggaagaggagtcgtgtcccgatgttgcctccaagacagcatctatcacagattttcttccccggggacatcatcgcaggtcttgaggacatccatggaaatggccctcatgcctttcttatcgatggcaggaataagtattagcgtcacgtgacataaaatcagattttctttcccgagcctttgttgttaaaatcaaatgaacaaagaaacagagtcctggcaacagtgtttgaacagacctgaagcctttttcctgagtttctgtttggcaactttctgtctttttctgtccaaggactgcctgggtgcagaaaatcaaagctgcttctgaactctacatagagactgagaaaaagaagcgcgagaaagcgtacctgggtaatgcatggccccgcggggtgtcctgcacagctgggcaggagggagggccatttggctgggctgaaaatcctcagaatagaagaatcccctggacctagaggaggggcatggaatgagatggaagtgagcttggggtgggatgcagatggggatggagggcaaattccaggagcaaggaagcaagtgtttaaggagagggaagaattacttttgagtcgggagaggtacatgaaatgcattgtgaggctcacagagatgggaaaggtgtggcacgttcaaatgaagcattttgtgtttttcctgccgtcatagtccgttcccaaagggcaacaggcattggaaggttgatggtgaacgtggttgaaggcatcgagttgaaaccctgtcggtcacatggtaaggctgtgaggcgcccccggctcctgctttggggttgggagtagggtccgggttccccacacccccacctggctctagatcaaatgtgctatttccatactccctgatctccttccagaattggtttaactagcacttgttaaaaacctggaggttttgtgtttttttttccatcctttctaccattctgcttctccgagggatctgagtggctgcattcacagtggatgtgacacaagatcaggccaaagtaacgagacaggaagggcctagtttcaaagcccactcaattaagtatttgtttttagtttaaggatgaagctgacttctgggagtttccacccggattctccaccgaatgacacttattaagcatagcagttattaagagtggggagcggccgggcatggtggctcacacctgtaatcccagtgctttgggaggccaaagcaggtggatcacctgaggtcaggagtttgagaccagcctggccaacatggtgaaagcccgtctttactaaaaatataaaaaattagccaggcatgggggcagccacctgtaataccagctattcattcaggagactgaggcaggagaatcacttgagctcaggaggtggaggttgcaatgagctgagatcataccactgcactgcagcctgggcgacagagcaagaatccatctaaaaaaaaaaaaaaaaaagagtggagatcaaaatgaggtgtgagttccacctggcgaaggcttttgttccctccaggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatggtgagtggaacgcggccctgtggttattcctccttccctggcactcgtttgcgtgggttaatgttttcttacctggggacttggtgccaggattccttcggtttccctcctgagagatgaggctggctggcacaagacgaggctctgtctcccctggaggagtcttctggaggcgtctcattgcatgtggacagagcatgcttggtctagaattgtgccagctgccctgggcaaacacgtccatcttctgctttccaaagcaggtgactgtggagaggggtgtgtttaagagcctcagcatagttcttcagtccttggcaaaaagctgtgctggcaatggatgaaactggccaatggaacaaggatgttagcccacaacaggagccgcagaatgggccaggtccctttgggtggcatttttgtaccacttattaagtaggcaaagggatgcagtcatgttgaatgaatcatttcttcagccagccttctgtttctgcttgggcctggaaaagaatagtctcagcccaatgattccaagaaactacctgtctctccctcaacccaataaaaatcaccggtgggcatggtgctgcaggcctggaatcccaacactttgggaggctgaggcaggaggatcgcttaagcccaggagtctaagaccagcctgggcaacatagtgggaccttgtctctacaaaaaaatacaaaacttagccaggcatggtggcatgcacctgtagttccagctactcgggaggctgaggcaggaggattgcttgagcctgggaggtcgaggctgcagtgagccatgatggtaccactatattccagcctgggcaacagagcaagatcctgtctccaaaaaaaaaaaaatcacagagtaagttaaaagattatggtctcaacttaattataaccgaagaagtgagggtcaaatgctagcattatctgtacaaggtttaaatggctccatatggccttcatcttttagtactttttatatgaattatctcattgtgagttaggtactcgttgtggtagctggttaaatgtttgagtgtgactggaacagtttggctcccaagtctgggctcttaactactatgtgtactgtcaacttctaattcttttttctttttattttttttatttatttatcttttttcttgttgttctcgctctgtcactcaggctggagcacagtggtgcaatcacagctcactgcagcctccacctcccaggctcaagcaatcctcctgcctcagcctcctaagtagcagggatgacaggcatgaaccaccatgctaggctaatttttaaaaattttttgtagagacagggtctcactctattgcccaggctggtgtcaaactcctggactcaagtgatcctcctgcctcggcctcccaaagtgctgggattacagacgcgagccactgtgcccggccaccttctaattctgagagataaaggttggggttgggtttttttttttatttaagtaatgaaataccatgacacattggcaactccgctggggagcgagttggaaatcctagtgttggtttacatcagagcccagagaagaagggagagcataacagttcatcagggggtccccaatatgccagacatgtgcctcgaagagagggaatggtccctcttaggagggtctgtttgttctcttttcagattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgtgaaaaggaaaaatatcaagctggaggttgggaaagaaaatgaaggcagtccattatgtggtgggtgaaagaccctaggaggatgcaagccccgcacatcccggggcaaagacctaagacacttttccaccctccaccaccccaacctcacataatatgcttgttgcaagagtcaggactttatgactatgtgccaagctgtttggtttgagttctttaatttttttttcccttaaatgccaggagatcatctggttagttagatagtaacttgatttgctaatgaaaagtgggggccgtgttttgtttgcatgttaatattctcataatcctagtttgttgtggtcatgaaatgtcctttgcatgttctgttggtactggagtctagctttcctgtactagatggtgttctctttgattgtaggtccttagactttaattagggttatcaaagtgctttctaaatgatagcatcagcgttgtggcagagtacctcctttgctgggaactgaatgtgtagtgttatcatttcccatgagagcccggtcatacttcaagcaatttttttaaaagtgtgtgttggaaaggacaacaaagtttacatttcatacttttaagaaatactttattatttatttattgaagatagtgtagaattttgtatcaagaacaacagacataagtattttttgaaacaagcaaatataccctgtagttagaaactttcaactgaacatgttagagaccaagtttaacttcaggcatgcatttgtttaccatttcccagcagaaaacatggttaaaatactttaagtttatattttttgatgttgttaagaaacttttaaattaaatctataaatagacatgcaactcatgctttcctatttctataaccaacaccgtttgtttagtgtatttatgaaagatatgctaccatggtagaaagaaaagtattcaatgtgtaaatggggtagtgtgggtcaccattccgatctctttttgttttctgtcctgtcttttcttcattgactttatttgcgtgttaatgttggacatcattgttcatgtaggtagcgtatggtatgcacaatgacaaacaatcgttttaggtcccaggtcacccactcatagtgtcctattattggaattaatgtagcatgagaaagcaatatgtgactctttttcctcaagtgactctgttgagcatccttgagatgctcctgccatgtagcaagttctggattagtgtccttgtatttactggtgtaatttgtaatgtaaccaattgtccgtatggaggagtcgggctggccctcggacccagctgtgattcatgagttgtgtcacagggattgagaaacatgggtgatgcatggagtctcaaaccattgggcctctctgttccttcacctctaccttcttgaccacctgggctatatttcatagaaattaaatgctccttgccaacaaggagtctgtctcctagctctttgttttctaaatataggagttctctaggccactgcatcccggcatcctgatcccagccttttagacacccctgcaagcgttcctctgctctgagccacactgctagcttctcctgcacactctgatctcctttagcccaagaaggggctgtgctggtcatagggttatgctgtaaccctcagtcttccctgagaactgaactatcctgggacctcttgggctgagccttcttcacagagcagttctctagaaggcagagtccacatcctggtccctctggggcagggcctgtctggctgctggcatcaccctggcaggtggatggacagcatcatctcctggaaccaggtttgctgtgaccatgagagcctgaagatgtggctcattcggatccaggcctggactaatctggaaagagggactttctaggtgcaggtcaccagggatgcttgagaaactagagccagacttccttgtttgtttggataatatgtccctgtcctctgatagcagaggaaagagctctgctcccaaagaacattcatgtaagaggaggcatttttttcttctttgctttttttaaacaacctaaagtatgacctaagtgtatgaaactaactgatttctttgggtagagtagccctgaatttaactggggaaaaaatcccatcagactatgagtaaattgaccacccacattaagtcttatctcggtgacctggtaccaaagcccaggtgtcctccaggggagtattctggggtggcagggggattaggtgctagcgccagcagggaaggacacttgcaggtctgccttccaaggctaagcaggccggctgtctctccaggaactggctaggacaagtgtaaagccactgaccacacagaaccaggatgttctagaatctgatggggctgaagatgaagggagaaatggacaaggcacttctggctttattgaaaaggtgaagctcttggagtatattttagagtaggccagtaccttgtataagcagaaaaagacttctctatctccactccaagtcgtttttttctagttgattgggcctttttgattgataagaagaaaatgtgttttgtacgtgtaacaactttaagaatttccattggaaacaaagtatgatttgatttgatttgatttctaagttctcccttccttttcaaggttagcgatgtgctttatagcagacactagcacttttacatgaatacctggtgtgctttggatgtaacagggtcattttgggctcgaggtgagtgtgcaattagcagcaggtctgcttggtccagatatgcttgtttacaagtttagagcatcctatgccagaaagtgagatgaaaacaaaggcacctggattgctttgttttgcttttagataaaagagctttagctcacaccaggcagaagcataaccagtagccccagaaaccggtagcatgatgaagccctcagacagtatagtctgagccaccataagaggcattagggaaaactaacacctccttctttttgcaccgtggggtgctgaaattcctgctagagacttccccttacttccatgaatggcccaggggctgcttagtatatcattagaatgttcattctcctccttttccctggagtggaccagtgagaccaaatgcttgtgtttctctatgttttcagttcatttgttcaaatgacccagaagatgaatccatttctgggaaggctgagctcagatgaggattgctaggccagcctaggttctggggcggatctcagggacagaaacaggcttgtattaagtatgagtggcaggtacttctctagaacagccctaacctgcactagtgaggggggctcaggaattcccatgacattgatctagcagcctcctgcacgtagacactcagttcattttagggacgttcaatgcttgatcaaatggggggcattttctttctttctttttttccccagctacagtgtaattgcctacctgcctgggccccttctagaggaaggtgggctttccttgtccgtcaggctgcactcatgaggtgatatcgtaaagcagcagaaagactgagggtgcaaagaaaccacagctgccattcacggggcagctccctctagctcttctgcccagtgaccttacaggctttagaggagcctgatgagagctatcctgggggccaagggatgcattccctgcagcttcctcctgggggacccacaggtcagcccattccaggagaagcagtcttaggcccgtttgcatcccctgccactgccatgtgcctgccagcccggtttctgatgaagacgtggctcagtccctgctctccttgtcgcagtggcttgtacttcatgtgcagtagcccagggcccgccttctagagtgaatgtttccctcgagcccttggatatttttattctattttgaatggttccgatcaattaatgttgctttgtgtggggttcttcagagaaataatgcaaaccggccaggtgcggtggctcacacctgtaatcccaacactttgaggggctgaggcaggtggatcacctgaggtcaggagttcgagaacagcctggccaacgtggcgaaaccttgtctctactaaaaatacaaaaattagccaggggtggtggcaggcacctgtaatcccagctactcaggaggctgaggcaggagaatcactcgaacctgggaggcggaggttgcagtgagccgagatcacgccactgcactccagcctgggtaacagagcgagagtccttctcaaaacaaacaaaaaaagagctaatgcagacctcttctggttagacctgacacggaggaagtaattggctggtcaacttaatggcgccccacagcttcctctggatcctgcttctttgtacttggaacacagtttatttgagctagaggaaaggaaagttctagaattcctgtttcctcagcctgcactgtatcagatccaggatatgtctgcatttcatcaggatcaagtaagatacataaccttatatctgtaggagccagaaaaaaaaaaatctattcctgataggcatggaaacttagtccacatgaaagacagaagacatctaacagctgtctgtcttgggagcattaaaacccagacaccaagacacactagacagtccatctctgggttgtgatctctcagaaacatcttagtagttaatgcactgttcatttagggagtccccatcctggtccaggccaccctcctagaagctgggcggcagctggacgggcctgccttggtggcattcaagcaagcctaattggattaggttggtgcaaaagtgattgcggtttttgccattgcttttgatggcaaactaactttaagtcattaaaataagacccaacgcttataaaagagttcatatccacctcccaataacttctttagttccatgcagcctcaatcagttcctccattcaaaggaaccctctttaccctggccctgggggagccatattacacccacatcataatttttctgacactatgtgtgcttgtcaaatttcagggtcagtttccccttattggatgtcaggggtgttttgtgagttgtgttttaataggattctgttcgattttctataccagcctatattgttactatcatctgcctagtatgaatattttagtattcaaagcccaccagataaagctgtgttcagaagtggactttttggtcagccttgaaaaaaaaaaaatcagcatttctctgatatttcctgaggattaaccagaaactaaggtttctttttaggcagtggtaagaatgcgtattttcttcttccagaagttctggttttatacttttatcttttgaaagaataacattcctgtgcgactctgcttctcttcgcttttgcatttctcttttttaactcaaatctcttatttcctgccgttcctgtatctaaacagaatgggggcctcaggcagacaggaaccaaagaaagggtgtagtggctttgcagcgttgggtgagcagcagccgctgccattctgtgcactgtcaccggcgggggtggagggtctccctgtaggaggaggaaactcgctgttttcactggcagatttcaaggtgccggctccacctaccgcagctgctaggcattgctcttgtgtagatcgcagaaggagttattggtgatgtggggtgtaggggaagacaggaaaacggactcagagctaggaatgtgggcctggcagagaccgaaggctgggtgggaaggaagctcgcggcgagcctagggttcaagcctagcgcgccaggggtctccagtgagaccttgctcttccctgccgctgaggctggggctgcacggaggtcctcaggcttcccaccctttctgcatcagctttagtgtctgtcggctgggtggactgcagggcaggtgacctggaggaggccctgctccccagcaagcgttctaggagttacggtgtgctctattgggattggattacagtctctacttgtagactttgacttctggaattttaggtggaagggaatttttgttggtgggacgcagcagctcagtgcgtggtgtgtgcatgcgtgtttgtgcgtgcgtgtgcatgtatgtgtttgtgcgtgcacgtgtgcgtgtgtgtgcatgggtttgcgtgcatgcatgtgtgtgcgtgcgcgtgtttgtgtgtgcatgtgtgtgtgtctacgtgtgtgtgcacgcatgtgtgtgcgtgtatgtgtgcgtgtgtgcatgtttgtgagtgcatgtgtttgtgcgtgtgtgcgtatttgtgtgtgtgcgtgtgtgtgcgtgtgtatgtgcgtgtatgcatgtgcatgtttgtgtgtgcgtgcatatgtgtatgtgtgtgcgcgtgcgtgtgcgtgcatgtgtgcgcatgcgtgtgtacctacccacacctagggggatgcatggctctgtgccttggagagggaaacaggaaatacgttgctccacagtcctgtcatcctggtcaggactagtcgcgtggtttgcggacagagtgcaaaatgaaaatgcgaggccccttgttcaggtgatgaagcatttctagacagtgagaggagagcattaagccaagctcaggtcccttctgagtgcatagccccttgtggctgccaggcagcacacccaggaggccggccctgaccacactgttctctgctggttcccgaagctgatgggctctgtcttaggtcttcttactttgaaaggtctcccggcaggctgtggcaagctgcgcggatacacttttctaaacgtctgcatttatttcctaaaagcacaaatggcctggactagctagtgggtgtggaaccgagcccctagttcacagctgtaccccaaggctggagagggggttgccggtggtggcaggagctctgggctcccagttcaggatgggccacagggcgtcaagcagctgtgagcctttaccattgagctcactgcttggaaataaaacccttcctctgggccttgggcatccactgggagcttttctcccctttcctgggaggacagcaagccttttccaaccttctgccttcaaagagaagcagggtcatagaagtgctcagtgtcccttccccagtggctggacacttgctcctccagccttcaccccctggagagaaggggagtctgcggagccagtgcctccctgcccagctgggccacacgatctggtctgcgggtgtctgggaggaacctgcttcggagaggctgcgacctcccagctagactctccccttaggatcccatgtatggggatggtaggagagaaaagatccctctgtgtaagtagcctcaagttctagaagaccatggccccgggaggcagctgaccatgaagctgggcttcctgttgttgctttctttcacgagcttttacttttcctgggctggacgctccaaaatgtttgcagttccatttgctttttgcaagtaggtccccatctccatatacattgagcaataatcctcactatgtttcctgattctgtctgggattatatttgctaagtaaaaatgttgacagaaattgcaaactcatctcacctggatttgattgagtcaccttgaatgacataacaaattatggctttgttttcatgcgtcatgcaatcttccggactacgggaagttctgcaagtgttctccaggggcatttcattaatagcgtgtcagcattagttttaatgaatgaacatttgaggtacattctataaatcaatatccttaaaatgtcatctgctaaacattcactgtgacagaaagtagatattttagcaagatctatgttaatgctacttaattttagacatgcatttaaagcctacatggccaatagcccaagtatctttgaactgtgaaatcaacctcagatctcatctgctgtagccccgcaagccggagtctgtgccctccatgacccttcttatcccttggtggccctgcatagataggggagttggcccctgcccaccccgtgttgtattgccttagctccatcagctttgtaccctcacacgtataggtggtgaacttatgtgtaaatacatgtgtacagatgagaaactgcaacaaaaatgtcctgtggatgataatcagctcagtttccggttttctacattctgtgctgtttccagctaagaaaaaggcgaactcccactatataaagggaaaaggttgtattcatttcatgttcctcatgaaatctctgctgtatgtttatggaatggccatgactaaatgtatatatggtatgtaagaggccatgctgttaaatgttgcataaactaacacagattctgtagtcaaaaatatttaacttgttattgtaaaatgtgatttgtcattgagagattatttttctgtatgtatatgagagtattttaggaatctaatttaagtgcataaaactatagaaaaaaatttaaaacctattccaagagtagaaaatgcttaatgagattacttgggttcaactcaactaaatttcttatattaaaaaaaaattccaagttgtatatgttagaaatcaaatgagtcattttttttcctgcaggaaatatgataaatttcagtgtaatggatggtggcgtgatcaaatgaaaagtatcctgtagctatgacctcgcatgggaccttggtgttgcattaaaaatggatttttgcagatcacatatctgagagggtacttgtgtcaggaaggatgagaggatagggagcctgtttttcatcagatccatgtgccacgcaggcttccttgggttctagtggatttgttagggatctggggctgacgcagctatcccactagagaggccactctctgacttccaggtcgccctttctacttctgtatctggattgattcagtttatccctaattagcgtttgcgttttccatgaaatttcctgatgcatcctcactgtcttcaactgttgcatagccaggtgggtggatggatggtttagggtttctgagttaagccgttttggggcaggcttctggatgcccatgtttccatggagaccccagggggaagatgccttcctcccgtctgcattcccagaaaaggatcagaagtccaggctgcttctggggcacagactttctgtacttggccaccagaagtgccccttaggccacctaaggaggattctgtgaaactcaatgtctaaacccctgagaaaggcattcagaaatgatttcaggagggggcaaccccaggagtccagcctcccctggcagcctggaaatactgcagtaacaaaaagagctggtttctggtgatctgaatgcattgtgtttgggggtgacaccgctggtggaaggttgagggcctgtggtctgaaaagacatctgaagaatgtgttaggttttcaacatttctttgaacaggctgcgtgcatcttaatgctgtcaaccagcaactggagccccttttttgagaggcccgaaccagtaaagctgctgacttcaggagtatgggaagctgtgatttctggaagcttcctggaatctatttaggtgcatgaataatctgcaaatcacttagaggcactgtccatgtggtccataactggctttattcccaaagatggagctgttcagagatttctttgttcaggcgcagccttggaaggccacctaaggcctgccagcagaggagatgagctctggtctaccaaccccaaacaggccctgactctccttccttagaacgatgccctctggctggggtggcaagagggctgtgagtggaaacaagtcagccagtcaactgtcccttgggccttggttgtttcaaaaaagtctggggacaagaaaagctagaacatggggccctcccttcccaggagtgctagcgaaccctcccagatagcctttgcctgtttggaaaagaatgtaatccatcagaacgtgagctccttgtgcttccagtgacaagcgggccacagtgctggtggcatgttgcttccctcacagccctgcccaggggtaggaccaggcccgccccttgatggatgtgctgttgattgtaatatacttctgttgccaaataatggtactgtttaattttccataaaagagagactatattgtctgatatgtaatgttaatggaattctaagaattactagacactattataaattgtagacttacgtatttgtctaaaggtttgatgaagcagggccaaaacattgtttcttcttttttgtttgaaagaagctgaggtttgtttttgctgtttgagtgttcctttggcaacttattatgtgtgaaatgttaaattttaccgattaagatgatggtaactgagacctttctttaaaccagtagcaacatcagtacaaattgctcttcctgtgtatcttgaacctaaaaagaacaatctcttcaaaaacaaaaacaaaaacaaaaaacaactctttggtcattttgacctgtgtggtttaaattcaaatagttcatgaataaaaggagaaaagccaa

SEQ ID NO: 789 - DNA, 668 bp, Homo sapiens
ttctgggaggaaggcttgggagtcccctaagacacatcttcagtcacttctctctgcctgtgactcaggaagaccagctcctcctactgtcttctgtgctagggatcacttccttgttgagtggggccggagttttaagaggatcttctgctcctcctcatctggtccctttccttccaaggcccccgagaggaaggcatgcggtgggccctactggtgcttctagctttcctgtctcctggtgagtacgctgcctacagagaggctcacaggttgggttttgttttgtttacttcttttgaaaggggtgccatacaaaggaatacctcattaaattttgtgttgttcccattgcagccagtcagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctgggacagg

SEQ ID NO: 790 - DNA, 53532 bp, Homo sapiens
cgccgaccctaagtttcggcgctcagtggtccggcgctccccaaggctcggtgtccagcgtcaaccccgaggtctctatgccccgcctcccgacgccagggggcagggccagcgcgctgcgcgtcggggcggggctttggctgcgtcggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggtgaggccggaggctggggccgggcctggcggatccgcagggcttgcgtggacagcgggcgtcacaacggtcgcggcgaggaggccgcctccctggcgagggaccggggccggcgggcactgggggcgcgccccggcatggcctccgtcctgcccgccccacagagggggtcggctcgttcgttcgtgtggtcccggagggcaccgcggactgggggtgcctggcccatcccctgcctcattccgtgggggcgggaccgcggggcttgggggccacacgggcggcccgcagctgggccctggagtgcggccccagcgtctcttcctcaggctcgggcatgatccgcggcgggaaagcagcgcgtccagccgaagcctgggggtcggagagcttgtgtgactgagaacgtttcggaaggcgtttctgacctttgcacctgccctcccagctcgttggcttgctcgtgtttgttgctggataaatgtgagcttgttgtgaaaattgtcttgaaattataatttcctgtttcttaacttttttttaaggctgaactccgagcagctgtgtttttagcactagaggagcaagaaaaagtagaggtatgaagtttccagattttaacatggctgtattcgttaatacttaatttcttattcattaaaaaccgtcttaaaaatagtttatagtaacatatagctagggataattttgaactgttaaggattacattactattgagagagagccaaaattattcttttttcgtgtagcttttgaatttgggggtaatcttaaggtaccacagtaactctgatactaatgcttaatctgaaacaaatggtcataggagtttcttgaagaaatggtgccattgtcaatgtgttaagtgcaggttcactcagatcctttagtaagctaatatgttattaatccctatgaaacggggtatatagtatgcaacttttcccaaaattatctgaccactcaattattttgacaatgaaaaagacagcgattattttaaaagtgcagccactactctatatttaagtgggtaatttaactttttcggagtcccaccaaccatcctgagtaaatattctggaatttgtcaacaagaatagaaccatcatcaaagccttaaactcttgctgtatgacaaatcagtctactgtcctctcacttctttagacctgtatacctaatctctaatttcatcaaaatcttcagttctttgccctttccatgtctgtgcaggcatcagtcttctcttggcagcattttgctctggaccctatgggtctggacccctaattaccttgccttaacggtcatacgtggtctggaagaaatctcagtggtcatttaacccagcaaactaactcttcccactttgcacatatgtgctcttggagaagagtcagtcaatcctgtggattgctgatgttgcaaattggcaggtaccaacctggttaggtcctgagcaggcccagcagctctcttcttcaccctagctgtgcagtagccttctatgtcacccctgcttccttctctctgaacacatggtcttgttgcttcctccacagggaaggtagaagccattagatcctaactttatgtcctcctctcctgtccctcaatctattgctcacctgtgaaaatgcttacctgtgtctatgtttatctgtacctctttccttactgctttagaagaagaggctctgtcctgtccaagaataatcactctgtcttgtgtatactttcaagtctttaattatttactgtatctttgaccccttccttttctgatggcttttcttttgagcttgaaaacatgtttaaataactattaggagtaaactgttttcctttactcacattctgcttttaataccgctgtggtttttttccttcacaacctggttttgaccactccttggtttctttagcatgatctttttcctgtacacctgactgagacttatccacagttgtcattctgtactgtctcacagactgaccttattcatccagtaactccagccctgtaactttcatgcatgtttctttcccgagcttcagacctgtatgttaaactgcccactgtattatgcccttaatgggaccatcatttatctggcaagaaatctaagcgtttcttaggccttgctcttctttccacctgctcagccatcacctggctctgtgtctgtcaggtgtgtatctgaagtgtccccaagggagtgctctgctgcctcctttgtgcttgtttcttcttttccagattgccttatccccttcctacttgccagtctccgtttccgtggtgtccctcaccatctccctgaagtcctttttccacattgctcctagattggctgtttatagtacacatctgatctgtccctccattctcttaaaatatttcagttgactccctatcttagaattccctgaaccagcctaccaactaccttgaggatctctcctctccttgtcttttattttaacaactttattgaggtaaaattgacctatagtaaagctaaagtatttaatatgtacaatttgatttttaatagttaatttatgcagctgtgaaatgatcatcacaatcaaggtactgcgcatatccttcaaacttttgaccttcaaaagttttccttgtgccccttatgtaaccctctcccccaccccaaacctttttaagaattatataaatggaatcgtatagtaggtactctttttttttggtctgtttcttcaacataatgcatttgaaattcattcatgttgtggtatgtattaataaatcatttcattaatacattgtacagatatgacagtttagccattacctgctgacagacatttaggctgtttccagtttttgagtattacaaataaggtttctgtgaacagtcacatacaagtctttgcttggatctgtgatttctcttgagaaaatatgtagaggtgaagtgactaggtcacatgctaggaatatttgtgacttttaagaaacactaccaaattgctgtccaaactcgttatgccattttgcattcccatcagcagtgtatgaggctgccactgtagcagcaattaatgtggtcttaaggaagcttaccatgtgctacctactgtagcctcttctcagcaacaatcacaggcttgatggtctagaagtattttttccatacttattcaaataaatgtataattacaaaaataagttggcctatgggccgcataagatcatctcacatttcatggataaactgggaattacaagtgtataattaaattcctgttcatagtaagtatgctataaatggtagatacctgagatgacaaaacttttatcaaacttcatgtatttgaaataataaacagttgttgacatttaattgtatttcacacaggtatttgaaaatatctagcttcaaaagcagtttataaaacatttaaaaattaaaaatacaaatcttcatatatggttttgttatattaactttgagaaattactaaatagcacaaagtaagtcctgtagtaattaacagttgtagaatggattttgtaaaaccataattttatcaatgaaaacgttaaactttatattttgtagttgtttttagggtaaacacatgacacttaaatttttttttttttaacagaacaaaactcctttagttaatgagagcctgaaaaagtttttaaataccaaagacggtaagatgttcagtttgttcttgtttatctatctctgaatttttgaatcttgataccatttgggagaaatcaggaatttcagggctttttttttgtcttcaattgttataggtcctcattttaaaataatattttattgtacaacaatcgtgttgctattacatatttttggatttgggatgttgttgcttaaagccagttttactacaaaaagccaatattaaccattaaaaagcgaaacactgaaatctatgagatgattgtcttacagttagttacagactgatgatcccagtgaaaaaatcaggagattgagattttcattacttaatcatattattcaaagaggaaatttgtaacttaaaaaatttagaaacctttcttccattaatttagtgtatctatttcataatgttaatttaaaaaattcagtttttgaagatttgcttacttacctttttcttgatctttataggtcgtttagtggctagtcttgttgcagaatttcttcagttttttaaccttgactttactttggctgtttttcaacctgaaactagcacagtaagaataatgatttttacatctatcttttgaaacctttgatacaaatgagttaatattaagctgaaagttaatagaatttgacaactgatagttttttacatttagattatttttggtagttgattatctgtttttcttaaaagccatatgagctttcagatagctggcaccagtgttgctgctttgtgttacttgaaagcttgctaataaaagtgttactatagagttaattttgatacgatgttagagtgcacctgttaatggaaacgttgaaggtagaggctctgtaaaagaaataggcataattttttaaaatagacatttcattcattagtaagacagtctctttgagtttaaagatgtctttaaactctgaaaatatcttctttactccttgagaataacttctgctatttttttgtgcacttgtattttaacttcttttctagctgcaaggtctcgaaggtcgagagaatttagcccgagatttaggtataattgaagcagaaggtactgtgggtggacccttattattagaagtgatcaggcgctgtcaacagaaagaaaaagggccaaccactggggaagtaagtagaattctgtgttatctttttctattttaattattggctgcttagtttagccatgcagattagtgcatatatagtaaattaaggttttcatactagaagatattccttaaaaacaaaatgagatgcattcagattgtatcaatgcaaattttaatgaaaattaggaatgtgctgactgtgattctgtggcatatctgttctggtttttgatcctcaagagtgttgggtcatgagctaaactgtctggaacaaatcccaactcctcgttgcctcacttgatcctccattcattccatactgtgtatgaagtgggctctaccaggccctaccttggtgttctgaggcttctctgcataagccaacagaagcactcaacttgctattatttttattaaaacatcttatttaaatataaaagggctgatttataggatagttaataaatttttggacttaaaggcctctttaggcttaaaactaagctgttgattttgctttacgctgtttagaaacagttcaaacttacacttttttgatcagtagtacttttcatactcttaacctttttttagaaattgtgctaatgagattaatgatataattttattttcatacattaattttacatgaagatactctgttttatagatacaggtaacatctgtaactgttccagatatttgattaaatgtgagcttttagtcagaaatttataggtaagaatgtggagggctgtataggtttccagttattttctttggtgagtctcagaggatgttttctattagaatttttgaaaattgataaagcttgcctgagtactaattatgtgtaaggcatggtaaatagactttgtgggtactataagataaaatataagaaacttctgtgtctctgaatagcgcagagctatttaagataaaatgtgctcaaataaggaaattaacatttaaataacagtttaagattatggaggaattgtcatttaacacattatttccaaccatattatgaatagtttagaggaggaagcgattgtcacatgccaaaattttattgaagtcaattttaaagtgagagtaggatgtcagttgtggggcgaggattgggaagggctttccgagaagttggaacggtgccagccaagcgtgggagcaggagagcatagccagatcccaggctggctgggagtgaggcggctcacccagagcgcaggttgtcacttcagcttgtgcatataatttcattccttcatttatcaatatccagcaagcttttattgtgcgcttatttgatagatactgtgctgggtactgggcaatcaaaaacaaactaaagaacccagtctcctggggccagcagtctgtaggtcatgatgacctctctttattggctttcccctctcggcttctgtggccctgaagaactctcttctctttctaactgccctttcattttcttttctgtttagtagttgtgctttggctcacctcattgcagtggtgtttatgcatatttttctgtctagattgatctttcttccttaacataccactagcatggactctggaaccaggttacttgggtgaaaccccagctctgctacattctagctctgtgagcctgcagtcactcagcctccgtgtgcccaggttccttatctgcaacatggagatcacagaagtatcgcgcctacaggtctggagggggtctgaggaagcaagatgtgtgaagctttgagcacagtgcttggcacggaggactctgtgtgttactgtagtaggcatcagtggattcaattaactgcgaattgaaaatattcggataggctgagcgcggtagctcatgcctgtaatcccagcactttgggaggccgaggtgggcgaatcatgaagtcaagagatggagaccatcctggccaacatggtgaaaccccatctctactaaaaatagaaaaattagctgggcgcggtggtgtgtgcctgtagtcccagctacttgggaggctgaggcagaatcacttgaacccagtaggtggcggtggcagtgaggcgaggtcgtgccaccgcactccagcctggcgacagagcgagactccatctcaaaaaaaagaaaaaaagaaaatatttggataaaatacaacaaaagaatgcaaatatagtagaaaactatttatatagcatttacattgtattagatataagttagacacgatttgaagtacataagttatatgcaaatatgtcatttcacataagagacttgagcatccttggattttggtgtccacaggagagtcctacaaccagtcccctgtggatactgagggacgactgtgttagtattactgtttcttgttattgtatggatgactctttaagttcagtgtagtctgcctaagctcagctcagtcctttatcctagctccagactagaatttccagctcttcacaaaacatacctccctggataacccaatagtatattcgaatcctgtgtggaaaaacttactttcttctctttacctctaaaaagtaaaaacataaagacaaaagcaaatcccaccttactccccgcaaataaccctcttcaagttcttcttgctcacttctgtgttttgattgattctattcctgtgactccttggtttcatcccaaggagccacctcttcacatgtgctctggattcagttcttctgtcaggaaggattcactctccaccttgcaccccgtagctttggtaacaggctgtggaagaaagaataattgctggagggctttctgttctctgctagataggagtgtacctcaaaatgagacccagtagcatgcctgtgtagtgggtgtgatgtgaaaatggacacagaatcactgttcttcagtacttcattctgactcgtggatttgaggcctcccctgaagtttgccctgactttttcatagctgtgattctgtcaaatagagccaggataggaattctgtatcctcaaaaggtagttgttttactcccccaagttgctgaaccagtaagttgggcatctcatctccattttttgctagttttcccttcctaatatctggatatttaattttaatagtttgtgcatatgtatataaacaaatagataaaatatttaaaatagagacctcaaagatgtatgttttggcccttcattatttattagtgttttctattactttggaagaaaacctgttgtttataatgaaataaaaaattagagcttttattagcttttgactttgactgtagaaaactagctataggttaagctcactgaactaaattactgatgctttttaccaaaactgcattttaaccacctcaagaatcaggttgctgtgccccacccgctttaacctgacttttgtttggttttattggatgctcccaagccgtagataattaaagccctttcttgttttctgagcccctcaatggatcattttcatctccttcagcacctctaccatgtaggtccttatatctgtccaggatcatttcttcctaaaggttctcatgctttcagtctgtcattcactgttgcagaattatttttaaacttcagcccttcctctgttcctttcttctgtacgattgtagtgactgcactgccgactcaggagtcccagattcttcagcccttatgaaatgttctgtgtgatgtggccttaacctgtctttctagccttatgtgttttttttttttttaatgtggaaccttgtacttaagtcagattgaactttggacttactacttgaaagtggcttgtgttttttcgccttctcttatttcgttattctatcctccacttggaattatactctttccccttccccagctgtggaattttgtcagtcaggttttctcctcagctgcaactcttgttcttcctctctccttactggaaactgcatgtaacttagtgcctccttctgtcaaagttgtagtagtgatctgcactggttacacatggaaatttactgaggacaagggctttatcttcatatctcttacacagtctaaggcattgtgatttttttttgtttttttttgagacggagtcttgctctgttgcccaggctggagtgcagcggcaagatctcaactcactgctgcaagctccacctcccaggttcacgacattcttctgcctcagcctcccgagtagctgggactacaggcagccaccaccacacccggctaattttttttatttttttatttttagtagagacggggtttcaccgtgttagccaggatggtctcaatctctgacctcgtgatccacccgccttggcctcccaaattgctgggattacaggtgtgaaccaccgtgcccagctggcatagtgatttttaacatactgttcacagtcagtggaagcctttgaaaatttgaagaggaatacccatttagaagatttgtggaggttagattggtaaaatatggagaagttagcagactagaaagaagtgaaacacataagaaggcaaatctagacaagaatggtagcagtaagaatagaaataagtggacatacaggctagacatggtggctcacacctgtaattccagcactttgggaggccgaggcaggcggatcacttgaggccaggagtttgagaccagcctggccaacctagtgaaaccccgtctctattaaaaatataaaaattaatgttgggcgcggtggctcatgcctgtaatcccagcgctttgggaggccaaggcgggtggatcacctgaggtcaggagtacgagaccagcctggccaacatggtggaactccatctctaccaaaatacaaaaaattggccaggtgcggtggctcaaacctgtaatcccacattgggaggctgaggcgggcggatcatttgagaccagcctggccaacatagtgaaaccctctgtctactaaaaccacaaaaattagctgggcatggtggtgtgcacctgtagtcccagctactcgggagggcgaggcaggagaattgcttgaacccgggaggtggaggttgtggtgagccaagattgcgcctctgcactccacagagcgagactctgtctcaaaaaaaaaaaaaaaaaaaaaaaaaaaaaatacaaggaattagctgggcgtggtactcgggaggttgaggcaagagaatcgcttgaacccggcagtcggaggttgcagtaagccaagatctcgccattgcactctaacctggacaacaagaatgaaactccgtctcaaaaaaaaaaaaaaaaaaaagttagttgggtgcggtggtgcattcctataatcccagctacttgagaggctgaggtgggaggatcacttgaatctgggaggcggagattgcagtgagccgagatcgcaccactgcactccagcctgggtaacagagtgagaccctgtttcaaaaaaaagaaaaataaaagaaagaaagaaatgaatagataaagatgaccttttgagaatcaacaagacttggtaaactaatattttggcatggggcaaggtcacagaaggcaataagagaaaagaaaagctctcaaaggccagtttaaggattttagcctagaagataatatcaccaacagaaatagtgggactgaagagggagaactgaagttatgaagaacagcacattttcgtatttaaaaagttacagtcagtcataaagggatttttgtaacaaacagccagtatttactatgtacagtgtcctagagcttgtgctggtagtggatgaattgtaggaagtgattttcatttaagaaacattttaaaaacctcctccttggcattaaccacagtgctcagaaccctgtggtgacagggcactgggcagcagacacagatgactcctgtggaagttgggctagaacaggtacttaccattttggaaaaaaaatgtgtgaaagtagaaaactgggagagtgaactactatttgaaggggtaaagtatttttaatgaaagttgttatttggtattttttcttgagataaaatgaagtagggaaacaaattcaaggagggcaaaaagtagatcttagagaattacaggatattatttgtctggagagtagggagaagggaagtgaggaagtaaatcctggaatggtagacctgggacagatttcagtggagaaagacagtatcctgttcaaagtgaataaatgaaatattttgcaggtaattagaatctagggatgtgtagaaggtttttgagggggtaaaattagaggaaaatctaaaaaggatggttactttaataagaaataaaataccaacattgtatagtgtttttaaatgctaaaattctattggagtgtaattggtatatttgtgttttatttttaaatgtattttaattttaaactaaaatattttagggtgcacttgatctatctgatgtacattctccaccaaagtcaccagagggaaaaacaagtgcacagacaacaccaagtaaggtgagttagctgtggaacacggaagtcatgtctggacttaactccagagtgctctgcttttctctctctagtctttcttgttacaagttgtattgttttatataaacacatgggctctttagtttcttgaaggtgctttttttccattaagtatacattaaaaaaaaagttttgctttgttggtagttgtttgacatttgtattgtagaaaggaatgtgctggtaagtaacagaatcatagaatatttggatttatttggtacttcggacattttctcctattaacaaggagatttacttacttttcatttataaattcctagcttgagaatattaagctagaaatatgtattataggatataatattgaatgaatattttagacttctagatgggtgatgagattcagaattgtaaatcatgatggtttttaatatacctgggctgttttgatacaatttctaagaaaatgtatgtactttggttacatttgtgtgtgtatgcatgtgtgcgtctgtttgtgtgtttatgagttgttaaaggtaagacttgatttcagagattaagcataatgggaaaaaaaatgagctctacactttgaatttaagatccaggatatgtaggaatggatagaaagatgattgtcaggaaatttgttttctcaagagcacagcatgaattggtagtcccaggcggtcttaccaaaggataggttggggtctgtcttagtctgttcaggctgccaagtaccatagattgggcagcttacaaacaacacatttttcctcacagttctggaggctggaagtccaagatcacggcatcactgtggttaggtctggtgaggtccctcttctaggttgcagagagctgccttctcattgtgtcctcacgtggtggaaagagggtgagagagctctctggggtcagggccctaatcccattcacaaagccttcacccgcatgatctgctcaccccgcaaaggctccaccttctgataccatcacattgagggttaggatttcaacataggagctgggggtttgtggactacacaaacctgcagtccatgacaggtcgggtttgtattctttgactgtccctttgattttcatcccataggaatagagtgatgctgtggagtccattccaaaagatgaggtcccatgtgggtttatggtggtggatcgactctcagatacagttgcatctttttaaatagatgaacttccaggacgtagtgattatactacacgatacctttcttttttaaatgtctaggcacagaacattgctgaacgattgctgttattttttgcttgttctttgatgttgttgctcctttttattgtttaagtttggaaaactaaggaattttatacttcatttctaaccaaagaaacaactattgtattgtttatagttgctccttctgagatttctagttggtgtagggaaggcctttttttaaaattttttttttcctaaatactcataggaggctataaccccagtgatagagtaaggtcatgagtaaatttttaaaatttctttaaattaattgcaaataaaacagcctatgtaagtaagctttacttttcatgaaaatacctggctttagaaaaattaaaattaatgaatattccaaaatacttatcagtacctatagcatttgactatttggaagctctttttagcaaattattactgtttttaaagcaaattagcaatcctaacctatatataatgtatgtcttcagggtaaaatattaaagtctattttacgtactcttattctccctacatacattttaagatctaagaattataatgagaatctcaatgttttaagtcagtcaggaaatgatgctgtgagtttttccagagaaggggggactgtcctgaggctgctttagagaatagcgtttgtcctaacagctgtctctgccgtcatcccgttattctagtttagtctccgtttctcagttggcctcataaacccacttcagaaataccctagatagtccttgtgtagggttgcatctgttctaaaataaacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacccaacctttaggaaccagctttgtgtgctcctgagaaaggtcagatgaggtcaggacaagtcttcaaggaagttgcctaggaactcaagtgaggcttatttagaatgctgctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgagacatttttcagtaggtatctttgtttggtaatgagttagtttattttttaaagatttctattttgtggtaaaatctcattttattctcatgctcagataccaaggtataaaggacaaggtaagaagaagacaagcgggcagaaggctggtgacaaggtaacatgcatgagggcagaggagaaaagcagcctgtgggcatcaggtctcgactctggggcctcctggagcgctgggctcctgtcagattgggttctcagttttcttatgaaatgtcacttgaggctgggctaggtggctcacgcctgtaatcccagcactttgggagtccaaggcgggcggatcacttgaggtcaggagttcgagaccatcctggccaacatggtgaaaccccgcctctactaaaatacaaaaattagccggccgtggtggtgtgcgcctgtaatcccagctacttgggaggctgaggcaggagaatcgctttaacccgggaagcggaggttgcagtgagctgaaatcgtgccattgcactccagcatgggtgacagagtgagactctgtctaaaaaaacaaaaaagtaacgatggcatgaaataaaaagtaaatttcactgtcagtttttatccaggtgaaaatcatactgttgaatcttaaaaccatgctctcagttttactttgaaaattcctgttgtgttggcaattagagttgaaaatacgtatttttcttttgaatggatgattatatacatattagtaacattgtgatttttatttgaggaaaatagaacatcaaactatttttttgaatacgtacctattgataaattaaaaattaaacgtatttcctccaagatgtttttgtgttctgtcatttttcagacaattgcacatttgtgatcctttattcagtgcccctgctcacagtagactgctgggggccagtgctgcatactaccaaggccttggctgctttttcatcctctcctaaagatcacaaaaattgactaatccagtagattagctgcttatgaaatttaaatattagaagttttagaaacattatcagtacagtttttacatgtacttaggataagacaaaatatttaattttcagttctgtgagattcattagtcctatgctgaactttggttatgtatagattttttcactaggttgaaaatcttcaaacttaaagctttttaaaaattccacctgttgtgttagatggctttagttctaggagtttcaaaggtaaattcctattactgtattctctttctgttcacactgttctttatgcgttattaaacaagaagttgctttaaaataatgatttagtaagttttttttaacatttacatagtgaaagttattgtgtgttaatgctttgggcaacacatttaacacagttctcacttaaggagtttatagtttaattggagagatgagacataccttaagtaagatataaaacttcttaatagattttaaaaatcagtttcttgggcttttctaaaatttaaaagcatattttatagtattaagcttttataatcttactgctattgtgggtttcaaacaacttaaacattttcaagaagtttatacatagagccaaggcatcctaagagatgtggttttcactttgtgtgatgtgaaataactgtgatgggcccagactttagctttcgcggtactttgggcagagtgtagtgtgtgccctgacttgagaggggattgaagaatctaggtgggcccatatcccaggatttagtccataatttgggtctcttctatttcattgttgtgttcctgaggccaggatgcttcctcaattacttggaaacctttttccctgtacatttctgatcttgtttctgaactgccttgtgagaagtctgtattgtaccccatgtggcctattgccagccttacttatatgggtaagcccttagctctttgttcccctgcctttctgctttgccttgtgcatgcagtgagttcccaacagccttaacattctcaacatcttcatcatccagatgctatgttgcatgtggtggttgaggttgtacacagcaagactccagatggagccatccgcatggtaggtgagtggcatctcccaaggtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatacaaggagtataaatatgaaatgagagggcattttaaaaatgaattaataattttgaaatatatattaatacttgctgacttccaaagtatcatctgtgataatttatctcattgtattccatttcgttgtaccaaacatcctaattgtttggaaaaaaaaaaaagtatcagaaaattataacagacttttgataggccctactagcttaggtttttaccatttagttggaaatgttgagtaagatctatatttttttgtttttaatatttagaattagttgctctttatcattatattaaatgtaatatgaaagatcatcctttcttcttacaaatagttttcaggtgtctgtttctttttagagacaaggtctcactctgtcacctaggctggagtgcagtggtgtgatcatggctcacaccacttgtcctcctggggtcaagtgcccacttcagcctcttgggtagctaggacaacaggtgcatgccagcacagctggctaattttttaaaaaatgttttcatgtagaggcaggggtctcactatggttgtccattctgatcctcaactgtggggctcaagtgatcctcctgcctcggcctcccaaagtgctgggattacaggcatgagccaccgtgcctggcccagttttcaggtattttaaaactaacatgtattgagatgctttttcacattacgtgtaggttttggggcatatgtttttgtatctttggcagtcacctgaggattttccaaaccaggcgttaccattccctgtcacactctcacaccatcctgaatgaatggatacatggatgcatgaatgttcccacacttagccctgtagtaaaattacttctctaaataattcattagtaagtcatggatcagaaactgtcgttggcagggagagaggtggggggcagaggcatgggtgaagagaattttaaatacagtcagcctcatatctggaggtttcatatgcattgctttcacacctgcagattcagtcgtatgtaaatggaaaaatggttataaaaaataataatacaaattttatttattatttatttatttttttttttttttatttttttgagatggagtctctctctgtcgcccaggctggagtgcagtggcacgatctcggctcactgcaagctccgcctcccgggttcacgggaggctcctgcctcagcctcctgagtagctgggattacaggcgcccaccaccaagcccggctaattttttgtatttttagtagagacggggtttcactgtgttagctaggatggtcttgatctcctgacctcgtgatccacctgccttgggctcccaaagtgctgggattacaggtgtgagccaccgcgcctggccaataatgatacaaattttaaaataatggtatacaactgtctacatagcattacatttattaggtattacaagtaatctagagatgattcaaagcatatgggaggatgtgtgtaggctatgtgcaaatactacagcattttatacgagggacttgagcatcctcggactttggtgtctgcaggtgtcctgggtactgagggacaactgtattgcatgaattttttgaatacttttgcaaaacaatagtatttctttgatatttttcctacatgaacagtttggaaaaaaattcttttttttttttttcaggttcttaagtcagtctgatacaattcagtttttgactactgaaaaattaaggtttctcattgtgaaacttctctagtgctgactttttgttaatctagaaatgattggcttctttattatatgagtgtactattggataatttaaatatatactaaagctttcttatggctgcactataatttcccatagagcttattattagtcttgagctccagccaagagaacttaatgaccgttgtagtgctgtgcaataggtccctcacttttatgaaaagacaaaacttgttttagttttttgttataaatgacttgatttgtttcctagggctaatgtaatataagtaccaatattgggtggcttaaaacaacacatgtgttgtgtcacagttctagaggcttaaaaatgtgaaatcaaggttcgcggagggctgtggctcctgttctagcttctggtggctgctagacccagatgctgtttggcttgtagatggattactccagtctttgcctccatcttcacatggacttctccctgtgtttctctgtgtctcttccccccagcaaggataccactcattaggttaggacccaggcccaccctactctttgaatggactcatcttaactaaatacatctgcagtggacactgtttccaaataaggtcacactctgaagtactgggagttaggggtttcaacatatttcatttgtgggatacagtttgacccataacttttgtgcttgtccagagaatgaattctaaggcattgccatggtatgtgtgtgtgtgtgtatttttttttgagacggattctcgctctgtcaccaggctggagtgcagtggcggcgattacagctcactgcaacctccaacttcctggttcaagcgattctcctgccccagcctcctgagtagctgggattacaggcacgtgccaccacacccagctaatttttgtatttttagtagagacggggttccactatgttggccaggatggtttcggatctcctgacctcatgatccgcctgcctcggcctcccaaagtgctgggattacaggtgtgagccactgtgcctggccttatattttttaaatcttatttgttagtttttaaacaatacttaaccttagttatttagcttcattttgaatcttcaacttagccaaatccaggtgatacaaaacccaagtaactgaagtttatgtacgtaacataagttcgtcttaactcatgataagggtttttaaagcagattcccgggtatacatacgtatacagatggtccccaatgttacaacagtttgatttatgcttttttgactttatgatggtacaaaagtgatatagattaagtagatagcatacgttgagttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcatacacctgctgtgcacacgcatacacctgctgtgcacacacatacacctgctgtgcacacgcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagcagttccaaagcagattgtttcagaatttatttttactccctggattaagagaactatatttttaaaataattctgttatgtttacaagtatgtgttgtgtaatatagtaatgcccttctccgtaaaacttgtcttcctaaaactggtctttctgtctatagcgggaatattggtcaaacctgtcaaataatcatggatacctactagttgctcagctttgatactagatagttcattatgtggatttaagttacattggcagtgtgaattcttggggaaatcagaataattattgtttctcataatattgctttacatttacatttttcagtttctgtcatgccagttattctttggcactttctcatgagtgtttagaaggagagaatctgtcgtggccacaggctgtgtcattgtacatatgtttaaatatcacatcagggtatttatttccaaatgcatattcttttaaaaagacataaatccattattaaaacagtgtaaaaatcagaaattacaactgctgtgaattacataatatttttctatatttgataataccaggaaaatgtcaagaaagttgttaggaaatttttgaaagtttccatccctttgaaaatatgttgtctaaaattataacttgctatttattttttcagacatctctttataatcattaatttatattaataacatggaatgtgtagctctctagaaggcaataaaatttgcacagcatatatcttgcctactgtcaactagtcaagacctctacctggtgtaaagatgtaaacgtatatcataagacatgcataatgcattctgtctgtacccatatgaaaagtgaaaccatccttcaggagcgtcttgttcggtaatgtctaacccagactttggtcaccatgcttcagtagttactactctttaattctttctcagccatccatcccttcctagatataatttgatctgaaaaatatgaatctagttcaattcttgaggaaactcatgcctaggaaattaatttacttaagattacacgggccatgtatggtggctcacggctcacgcctgtaatcccagcactttgggaggccgaggcgggtggatcacttgaggtcagaagttcgagaccagcgtggccaacatgttgaaaccctgtttctactaaaaatacaaaaattagccaagcgtggtggcacgcgcctgaaatcccagctactcaggaggctgaggcaggagaatcgcttgaatctgggaggcggaggttgcagttagcccagattgccccactgcactccagcctgagtgacagagcgagactctgtctcaaaaaaaaaaaaaaaaaaaaaaaagattatacgactgggtgtagtttgtgcttgtaatcccataaacccagctacttgggagactgaggcaaggaggactgcttgagcccaggagttttaagaccagcctggatgacatagtgagagcctgtttcttaaaaaagaaaaaaaaaaaaaagaaaaaaaaatggagttaataattttggactacattccagattccttgtttcagttgagtgctttttctattattccacgggtattttacacaatactgctctctttagtatgcaaggctgaattttgggaaattgccatttttaacccataaagcccacaaattcattataatttagcttaatagcataaatattgagttaacctctggaagcaggctttgactttgatattgacctgaccacttaactctctggagactttgacaagtgacatcaatgtctgtctctgtgtttcctgatttatatccacagatagaaagccatctccagatcctagggccattttcaagattcagtgagataaggtgaagcatttgaatgttctccataaatgtcagctgcttttattattactagcattattttttgttttcattattattattaacatagacccgtctaagggcagaaagaaatctgaccaagaatggagtgaaagtcggctgtgaaggttaggactccctgaaaacaaaaaagaaaagtggtaacatcactctgtatccaagggcatggataaggatgattcagaatttttttataacattgatgttaatatacatagagaaatacacacacacacacacgtatatatgtccatggacatcaaaatgaggtataggttaggaagttaccctggaagttagaattgagataattactttgattagcaaaggtttatgttagaaatatgagtggttgaaggcagcgcctttcaccttgatgcctgttgtgtttagcactggatagaaaattgctatttttactgatgactactttaatgcttggttcattcatatgaaataatctttcttttctcctttaataataatgatctctcctgatttcaagttgaaaatgtattaatttaagataacttatgaagcaatgacatatggaagaggagatgggaaattgtttctcaatgggaaagtgtttataaatgggataggtatactaaaggtatttccatttagggaaagaggaaaggaatggtattaatatatttctctaatatttttccccctttgaaagtttgccatgttaggaatcctggggatggagtgatgaattgtggcattgctctgcagttcacgctgctgagagctgccccaacacacacacacacacacacacacacacacacacacaaaggttgcacacacacaggtttgattatgctcatgagacttcttttattattgaaaatatcttaaagttttatctcaccaaggaggccttttctctttccctctctttctagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgtgagtaaatggtttttgagctatgagactaggggtttaaaaataagataaatgttttcattttatagttaaaaaataatgaactatggaaggtttataattattggatccataaatctgactatgcgttgttaatgcctttcatgttgtaaaacaatcccagattttagaaaaacctagacatgatttattccaacaagtaagtgtagattgagtgtcagccacttgccagggctgttccagggtggggtgcagcaatgatagaagagggaagactcctgccctcaggaagctcatgctctggtgacagagtcaggcaatgagggttatgctgcagtgtgtggggtgatgagagcagagcagtgatgggagcccgagtgtgtggtcagggcaggtgcatgtcagctgtccaaattggagggggcctcacttggaggtgcccagtgagcaaagagctagaggaggtaagggagttgccgtgggttgatggagctttggggagaggaaacagacagcagggaggcgagttgggggtagcagagagagcaagatggggatcggatgaggtggactcagagatgaggagctggacggcttttctttgagactggaagccctgaggatcttgatctggcgtacattacagaaggatcctgaggttgctggggaaggttggtcttagagtttccagttaggaggccgttaatgatggaaaaggatttgccagtaagtgctagagaaaagtaatatacagagtggcatcatggtttttagcctgcaaaactagaaggttggaaacacgttagatgaagagtggcaagagcaagagtggattacacagacaggtggcatgacagcctggaggcccctgttgctgtgctaagttagagaagattgctagtggaaatccaaagtaggctattgagtgtatgcgttgggattgatggagaggtctgagctggagatgtaaattaggagtcatcagtttgtagataatgtggggtgtgggagactacagaggatcaccaaggaagcaggtcctgcgcaccttgaggccagagcagggagctagaagcagcagaggagatggaaccaggagagtggtgtctgtggaggtggcggtagggaggagtagctgtatgatgccgttggatttagccatctggaggtcagtgatgaccttgacacagttttgttggaatgggggtgcgaggcaggttagagaattagagtgcattcaagacagacaggaaaggattgtagatgaaaaatagttttctgatgagttgtaaaagtgtgcagaggagcagggtggtggctggaggggcaggatttagggctgaaaaacgtgtttaggtgggagaaataacagcatgtatgctgacgagagctgttcagctttaaagatggaagaattaatgatgtaagggagtgagaggagaactggagggctgcgcagcagtggaatcccatgcaggggcttgtgtttgctggaaaagtggagagcgtgtgggtctcattgtaggcagggggtggatatgatggtggcacctgtgcaagctgtcacctgagttcatagttgagtgaggatggaggacggaggttggagataagaggagagtggagaaagcatgaaatctttctataagaaagtaaggcgagaaggcactgtggaaacccggagggttgttgggcagttttaaaggtccccttgaggttagtggtcatgactttaaggggagttcatcagcatggctgttagtggcttctgtaagcaatattaaatctgagaggtggcacttatttgctagtaaactcctgtattgtcccttggctgcatgtctgggtaatggaaaagggcttccgaaaaaaatcacagtgaagaggtcaatttagtttatatcaaacagaattctaaagagaggtgagctgatttcttacgccctggctgtgccgattgtggttgatctgtagtttgcactcccttggtgtactttatggttttgaatctttaaagtgtatattcttgatttccagccaccacacgtataaaatatctttaagttgcttttgtttctgtggcagaataaaagtgtttagtggcagaacataagagcaccgattaactgtccttgtttcttgttaggaggaaggaacctaggaagcaagcaggaagtctggcctcgctctcggatgcaccccccttaaaaagtggactcagctccctggcgggagccccttctttaaaagactctgagagtaagtgcccaaagatgtggacttcaatactcgggatattttttctctaattaaatactatgtgattattgttgattttttttcccaggaaaatcactaaaataacctatcattttatcactcagagatatttcctgttaatattttgttgtgttttgttacttctaaggtggtcctattttatatgttgttttgtattctggcccttcctatacctatataccatcggaatacttttgggaagttgactttttagctgatttttattatctatagaaataaaatttttaaatcatctctccttttttggacatttacaatgacttgagttggatttgctttcaattaatttttaaaaatttggtgataccacagtaagtatcataaaatgttaaataaaaaattattctgcagatcattttcaagaacagtgacctgacatgtcatcgtaaatgcagcagagctaaagagcactggttacacatggaatagtctagctctggcaccagttactttcccacctctccccacacacagtgataggaatttaaaaagcatagccctgaacatgtaggatgggcagaggtcctttggaaaccgtatcatagtaaatgttgtatttaattagcgtagtgtttcagagcacgtgtacctcttttgagaaagtttcctaaagtagattcactaagaatttgcagtatgcgttttgcataattgtccagtatttccgaatctttttgtattgcttgatatactgtgggacttcctagggcacataagagagccggcctgttgcttctcttaaaccagccatgtatttataatgtccgcatcccttcccatttgcttctttcccgtggttactgccacctttaagaaaggaatccaggacatcatgaacatgtcattctgacattgattagagaatgatcatttagagaggacgttgagaacaaaggactaaaaaaccagtgaggatgtcactttagtaagtgaaatagcagttgcactgaagaaaaatttagaaattcaaaggaaaaataagactcatgaaaataattaacagtctatgaattcatacctaacagggctgtttatggaaagtgatgtcttataatgaggcaaaaaatggtttttggtggttgtgttccaataaagtagtattgtttatggtttaaaaagggatgtagctgggtgcagtggctcacgcctgtaataccagcactttgggaggccgaggtgggtggatcacgaggtcaggagttcgagaccagcctatccaacatagggaaaccctgtctctactaaaaatacaaaaattagctgggtgtggtagcacatgcctgtagtcccagctactcgggaggctgaggcgggagaatcgcttgaacccagaaggcagaggttgcagtgagctgagaccgcgccattgcactccagcctgagtgacagtgatgagactccgtctcaaaaaaagggttgtgatgcatagcttaagcgttcattaatcacagtttattttttccttagttttaggttattatgctcctgtcataaagaagccccatattgaacaacgacaaaaattgatgtggtttagagactgttatattctaagtcactctaatgttaatattttctcctgttcacaggtaaaaggggaaatacagttttgaaagatctgaaattgatcagtgataaaattggatcacttggattaggtaattagatttctagtttttgtgctgatcgttttaaagtgattatttttagggtaaggctgtaaaagaagtgactccgtctgcctacgctgagcaccttcctgctgctgctcattcagcaggtgtttgaatggcttttatgtgttcaggattacacgctatgcgagagatggctacagcaacagccatcatgttctcgtgaacctctgtcttcatggagtttaaattctggtcaggaatatgaacattaaacgggcatctacagatattttgactgtaaaagggtcagtatatatgggtatagaaatggctagtaggttacctttgtccagtcttggcattcagggaagacttcttataagaagtgacttctgtgcagaagcttcatggttaagtacatgtataagagagaagggaagatatttcagttcagactgagaaaaatttgggcagaggcagagccatttgctagatgctggtagtacatggtccaggcctcagagaattcagtctagtggggaaacagacttattgaaagaaaaattgtgagatgtgttcagttctgttctatggagcagaagttggtaagcctgccatgtaagtacattcattcctatggaagtaagagtgtcgatgtgaacattaccgagccctgggccatatgttgagagcacatttctcattcagtgttctgttctgtgcaagactgtagcagtgtgacaggcatactttaggcaaactcatttatgtaaaggcaaacttggtgacctgaaggaaacggtgcagccaggttctcaatggccacttcctatgctctctgtggatgtgatgggatcccttcctggtctgtaatcactcacatggaagcattggaagagcttcacaggcaggttagggagaaagaaaggtgtgtccccatttgcttttaaaacccagccctgtccaaggggcagctccgagaatgcccttccctcttctggagagacattctggatagtgcaaagaacttgggcttggagttggatagaagtgacatctcagatgtggcactgattgatgggtagcgtagggagataaactaaactgctatttcctcatctgttaagtggaactaataacatctgccttgttttaaagagtaaataggatttaaatatctcttcatatgtaaattaaagtacagtggctggcatggtaggtgcctagtaaatgttagttttctttttacgttacttttccccccatttgcagaagaataaatgttccctgagctgcccggattcttgttccgcacagtgccctggagtcctggtaactgagttgctggttgtgctgccatctgctctttgtgcgtcctggttgctggctggccagctaggtgggcctgcctcctttccctcccttgtgcttttcctgtcagctgtggtcatggttgccattagatgttcttttccactaaatctcagtggctaactgccaccagagactttactcctgacctctgcaccgtgatggccgccttgtcccctttgtgttctgtttttttcacttttgtggtgtttcactctgttgccaaaccttttagcttttttctctgactgctctattctcttaccaaagcgagggttttccctcctgtttctgagtggggagctgccgagaattgtcatcctcaggagggaatgtcgttgctggggctgcagagttgctgggtacaggcaggagggtggtgtgctccttcacttcactttgtcttgggacttaggcatatctcgggttggaattggggtagttatgcaggtgagaactaccagttcactagctggatgtttgtcatttagctaggcattaggattcagtagaaataaagttttatttcgttttgcaacaatgttgttttctgtttgggttgtttacattttaaatatacagtactctaggtattttgagtaatatgtagacagatgttagtggaccagcctaggagaataatgatgttagtggtaagtgcctggcactgtaccaaggaattattttatttaattcatatcctatgaggtaggttttattactatctccatttttacagatgaagaatctaggttaagtaacttgcccaaggtcatgctgcttttagagtcctgatgcatcacacagagccctcaccactgtgttttactgcctgtatgttatttagacatattgaaataatcatttcaatgggaacataaattctgagttccaaataaataatctacaaataaagctttagagcaccatctattttagtttggcagacaaatattaattaaaggtgcccaaaaggagtgtttatagataggtactttgcatatttaaagcaagagttgctaagctttttccgtaaagggccaaatagtctatattttagggtttgtggatggcatgtactgtctctcacatagtctttgtgtgtttttttgtttttttgttttttaacaatctttaaaaatgtaaaagccattcttagttcacaggctgaacaaaagcaggtcatcagccagaggcaagaatgaaagtaaggaaagcagaaggctgtcaggaagtccgggccaaagatgactggggtaagggcagataagacagagggtatgggatggggaggagagactgtcaaaaaatgaagaaaacaagaatccttggcctgagggccaaaatttgctgacccttaaagtaatgtagtacaggttgagtatcccttaatgcaaatgcttgggaccagaagtatttcagagtctggatttttttggattttgaaatgtttgcatttttcttaccagatgagcatcccaaatctgaaaatctgaaagtccgaaatgctccaatgagcagtttctctgagcattacgtccccactcagaaagttctggattttattcaagtttggttttcaaatttttgaatttgggatgcttaacctgtatgtattctgttaatcattttgacactggcttaaattattgtaatactaaacaatacataaccaagaagtcagaatctgatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtggattatcattagttcttacaggttttgggataggtggtggagttaagagcaatgttttgagggaaggggttggatcttacaaagtacattctcaagggtggggagaactacaaagaaccttcttaagcatgggggagattataaagaaccttcttaagggtgggggagattacaaagtacattgatcagttagggtagggcagaaacaaatcacaatggtggaatgtcatcagttaaggctattttcacttcttttgtggatcttcaattgcttcaggccatctggatgtacacgtgcaggacactggggatatgatggcttagcttgggctcagaggcctgacaatcttgtgttttgaattggctacaaatgctgccaggtggggaatccagttagctttctttaaatccacattgcagccacagccgtcctcgctgtctcagctcagtgtccacctctgctctcctcactggccttcacacataggaacactacaatgggtccttggaggctgacattttagtagctgccactcctggttttacttagcgcttgcaaaccagccacatatgtagtttgtttaatcagatttccacttctccttctcggccctgacagtgcctggtttctggcaagcacttgcagccctttaacctttgaggctacagtggagacgagctcttgattctcaagaggagaggaagctcctgacatgtccctcctgactgcttatgatcagggatttccagttcattactgggcaaggtttggatgtagcaggaacaaggactcatgttttcttcgtttgctgatattcttcccaccccatatcatctacccgtctgtcttatctgtgggacacctgccttgacccaagccttttacccctgttctctttggcctggactttctgacagccttctgctttccttactttcattgttgcctcctgtacacatatttcttctggcggtggtacgattatctctgggaaaacagaagtgaggtagtgctaccctgcactttttcactcctgtcttcccccaccccaccccatccctttgtacaaagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaatttttaatttttgagggggtcttgcaatgttgcccaggctggtctcaaactcctgggtgcaagtgatcctcctgccttggcctcccaagtagctggattacagatgtgcgtcactgctctgggctgcactggtggtttttcaaaccaccgcaccctcccccacctcagggcctttcacatgtttcctcttggaacacactgtccccagtaatttgtacctctgcaacctaggtttccactcagttgctaccttggagttcttcccaattgcactagcagtatttggtttgttccactgttcctcttcactagagtgtttgctccctgagatcagagataccatcttagtcattgctatacctctaggggacctagtcatcactcagctggttgataaattaatcatatgatttggctgtaagagaattacattgtctaactgtctggacagagcttgaatcccctcagcagtctgaccgatttagagacagtccagccttatctgagggaagatcgaggacaaggcccgcagggtctttgaacggctctctgtcatgccaggtcttctttttgtgatctgcatcttctgcatgtggctgtacatgcttcctgggtctttcataggccatccattcacattttaagttggctctcatgtgcctccaagtctgctttgaggctgacaactctttttcctcatctagccctcagaagtcctgggagggaagggctgctgatttgcaaatttgtcctttatagccttaagttgatctgaaggtgccccctctgtcagaggcttgtggtgcactttgagaaactggtaacactgcctcactattcaccatcccaccttcattcagttgccttttattaagatcttactgtggaccaaggtctctgttaagcacatcatgtacctgaatccttatgttaactctgattggtgtggctttggctgtacgtcagagcagaggacatggcccagaaagggcacctcacattcccaggtcacagagctgttgagtggcaggtctgaggcctgagcctggctctgtctgactgaaggtgcccttatttgctgtgcttcatggcctcttcacacctcatgagtgttttttaacttttataacaaaacaattagcatgttgaaaacgctcagtagttcatctagtacctagaggggattgatgatgacttgctattgctatacgccattaagtcaagggaccttattaatggtgagtgtgccccatgttaattgccttagagtacccggagtaaagatgaggtgttaaccacattttatagtcacttgtaacagtttattatttcttaggtatttcatttgtcatttgtcttcatattatatatgcttaaaatgttatttctagtctgggactttttaaatgatgcaatataattaattttttttaaggaaatgtgtgtttaatggtaggtaaattgtgacgcacattagatataacatatcttttcttaaacttatcaggaactggagaagatgatgactatgttgatgattttaataggtaagaaaaactattgggcaaatatataaatatatacgttatttgtaaacaatttccgaacacagacaagacaaaattacatttggtgcttattttaatgtatttgattctgttgttcatattgattgaagatgaagaaaagatagttaatccaaaattaaatatttgattttagagcatgtttttgattttacattagaatatagacagtcacattatgttcaggaaacttggtaagaagaagagaaacaattgaagaattaactgagaagtcatttagaagcagttcagttgccgtgtcataagtgctgattttctcttccttccatacctttttgtggcgggaattgtctcaaaattgacctaaaataattatgctctcaaattagttttttgattcagatcacatttcctaatatgtggatatgtggtctgccctaataagattgccattctctttttttttttttttttttttttttttttgagacagagtctcactctgttgcccacgctggagtgcagtggtgcgatctgggctcactgcaacctccttctcccgggttcaagccattctcctgcctcagcttcccatgtagctgggattataggtgcgtgccactacgcctggctaatttttgtatttttggtagagacagggttttgtcgtgttggccaggctggtctcgaactcctgacctcgtgatccacccacctgggcctcccaaagtgctgggattacagacgagaaccaccatgccctgtcgattcctttcttatacacagaaagataatatgtaatgtagaagtaatatttgttgtggatatgattcgaaattttaaattagatgcctgagaattttatttaattgacaggttatctttccaattggaagtctgtatttttttttataatttattatacagtttttgagaaagagcatgatgtagtagatgaaattgtaaaaatctgggtttgtttctttcttgctattgtgaccaaagtcactgctttgaacctttgtctcctcatctgttacattgacttgactgctgctgcccttgctacattattttaagggtcaagcaagacaatatgtatgaaattaattatagttaatattatattttacttaaaggattaaaagaaatatctgaatgtttaaagaatagtaatctctttaaatgtttattttcagagttcttatttttttttccccttctgaaattagtaccagccatcgctcagagaaaagtgagataagtattggtgaagagatagaagaagacctttctgtggaaatagatgacatcaataccagtgataaggtatggtgttctgcatttcccatagagtgctttttttttttaacctatttgtcgatttactgtaaagcttcaaaattcatactaattagtagaaaaacagttgaaaattatgaaaagtcatgacagagacctggctcgagtttataaagaatgtctttgatgaatgtgtaagattggttttggttgtcacttcctttggtatgcaagtctcgctgctgaaatgcctgaggattattcctggggcactgggattgctgtggattaagagggatcagggtgggtcaggcttagtgagaattgaccacctggtgccataggtggaagtcagtatagggtactgtgatcacaggaggaagctgagcctggagtgcagagagtgtggtcatcttggccagttgtgacatctgaacaggcaagccagactgggctaaaatccacaggagacaagacagtaggccataaagttagagtccgtatttgagatccaaactttacctttttatgtgggtggagaacagaagatccttcgatggtgagctgtagcattgcagggtcacctgtcagtacccacttcaagctgtccccagctcagaggagtctaccagtcaggttggaggttgccatggctgggtggggacttgctttccagaacatggtgggattctccaagcgctgtgattgtcacacagggagaaggcctttgagagaggtagcgtttacaatgcaaccacacaatctaagtcagcagcatccgtgtttgcattcttattctttcatatattttcttatttaagctttaacctttgactctcagtttctttacttgtaagatggaagtattaatacctatgtgataggattattttgaaggttaaatgataatatataaagcacttctctaattcctgatgtattatatacccttataattataaatttagctttctcttttcaccctgcatcatcctaaagaggcctgaagaatgttgctttaaagttataccaaagaaactatgaaggattctttaaatatgagggagaggactcgaagaaatgactgttaaactaggatttgtgaaatgacgtgggttgaagaggaggtgtggcatccctttgccattgggggccttggatggcgtccaggagtctgggctttgttagactgcttctcactgggtcctactcactgggtttggcacatcaatgttcctaggagttttcacttaaaagcttaaatttagataattttgccatttacatagattggactttgacagtcactgtacttcatcaggaagcattttctaaagccttctgtgtagagaattgctactgggcacctggggaacacaaaagcatttgtattctttgcagtaagaatacagcagacaatctggtcacctttcagccaaggtgaccaaaaccagtgtccattaagcacctactatttagagagcacagggctggggatgtgggggtgtgaggaaggagatagcccagtggaatgggcaagttctgtaagttcatcacatctgggtttgagttctggagctgctacttaccactcacaaatttggccaagttatttaacttttttttgttttttttttttttagacagagtcttgctctgttgcccaggctggagtgcagtggcgctatctcagctcactgcaagctccgcctcccgggttcatgccattctgctgcctcagcctcccgcgtagctgggactacaggcgcctgccaccacgcccagctgattttttgtatttttttatagagacaggacttcaccatgttagccaggatgatcttgatctcctgacctcgtgctctgcctgcctcggcctcccaaagtgctgggattacaggcgtgagccaccgcgcccagcaagttatttaacttttggggccttgggtctcacatctattttgcaagagagatggtggtagtgaaaattagagataagcgtgtaaagcatatagctcagtgcttagcagaacaggcattcaataaatggtatctaatactattattcattgtagtcacaatagacatttctgtcgtaggcacagatatagacttcttccctcaaatttatgcaggatcagagagagaaaagccatgtacacaaacataggaaaatcaagataaaaagtgacaggtgccataaaatgccagtcattcatgggccatgaaaattcagaagcaggaactaatatttgaccgggattttgaaagatgactctgacttggttctgcgagggctgaggaggaacatggtaagctccatgagaacagaagggagatcccgggacatgtcagtgctgccctgattccagagcttcactggagggtgctgtgtgaagagacagaatgttgggaggagcagggttgttagaaggtgactttgaaccagaaatgacagaggatgaactaggagcagaggccctggggagggtagtctctgcacgggagccagcacgagcaaagacataggtagatgttggaggaagagggccacacgttcctaagggacagaacataagtgtgcatcccaggtttctgttaatgcatagcaatctaattcagcaaacgtgaacatttacacttcataaaacttttcaaaatcttacaagttcccgtcgatttgtatgaagcttgctatcacagggatcctttgtttccctttcaagactcaaaatgtacgttttagatatttttattttgtgatgtaaaatctatttttatagttttgaactaagttggtcactttgagttcttattctaaaactaaggaggcatgaaagccgcctttattagttttgtttttgtttttgtttttgtttttgagacagagtctcactctgttgcctaggctggagtgcaatggctggatcttggctcattgcagcctctgcctcctgggatcaagcaattctaccttagccttctgagtagctaggaccacaggcatgtaccaccatgcccggctagtttttgtattttgagtagagatggggtttcacctatgttagccaggctggtctcaaactcctggcctcttgtgatccccccgccttggcctctcaaagtgctgagattacaggcgtgagtcactgtacccggcggaaaggctttattaaatagccatttatttctagttagcttttgttcattcagttttctttcttggtaactactttaaatgaaactgttcttcttggaagtttctggttattattgtggtcttttctttgccttaaagcaaaactaaattaatgatctccaataactgaattatctagattaagatcgttttcagtccacgatttttcctgtattcactcttgtctgtagtttagcatttgtattaatataacactcaattactttgtaaacgagatggaataccttactgatttcactctgtaataatgatgggaagagaaaattacagttccaaggtatcagtttgttttacagtctgtctgcaagcttttctgacttttcagtttttgtgtaaattggatttgaattgaatgcataagaactgtaattaagattcctaataattttctttgtgagatagttttacagcaggactatgtttggaccaagagaaagggcaaggacttatttgttgaaaaggattttacttacaacttaaatttctgaatatccgaagaataacaaaatgagaggatatgtggggggcagatgaacagacaaataaaagcatctcacagtatctcgggatgaaactgttgcatctctacaagatgttcctattcttgtgcgttattacctggcccaggtgttggcacacttgttctctaaaaggccatatagtgaatattttaggctttgcaggccataactactccaccttgccattgcatggagaagacagccatagacgatgcctaagagtgtgtgtgtgggtgtggctgtgactgtcccctggtctgttgccacaacaatgagtctaggtgggactgggaaggttgggttctgtccttgttcagctgtcagtgggacctgcccagctgtatgttctatattctggagcctgtatattcacccgtggttttttccttagttaagaaatgttttcccagcctgcattatgcttacatatctattaatatttcctttctccattatcatgagttgtttatacaaatgaatagatataagttggttaataggttaactttctagtttacaagtagtttaaacagaagtagaaatgagtcgtttcttacaacactttgtgaacccggggctgggagtctgagactccatgggccgtcctgtctgcccttctgttttcacttcatgatctggcttcaggtggcacagtgttaaagtgtgtcacaccatgtcgagtttgatgttagaaacttaacgttctataccgtcatatgaaaacataagaagggatcgtttccaaattatacattttaatgaattttcgtgaaatttaacgtgggtaaattatggttttagagttagcaattcatagagtgatacttcctgtgaacagaatcatacattgggactatgctcaggtaaagaagtttaatacagtttttcactaatttgtttcttagattaaattggaataatggctaagatgtgttttattttaaattttcacttgaaatatttgagaataatcataaaacattgggctctaaagattgtactaacttagtagacatgattttaggcaaatcgcttctcaacacagctttaaatatgagttggtttatgaagtataaagtaatactttacagcaacagtttttttaatttttagttttttatttcttatttccataggttttgggggaacaggtggtgtttggttgcatgaatgagttctttagtggtgatttgtgagattttggtgcacccatcaccctagcagtacacaccgggcccaatttgagccttttatccctcaccctcctctcattctttctctggagtccccaaagtccattgtatcattcttatgccattgcatcctcataacttagctcctgcttattaatgggaagatgtgatgtttggttttccattcctgagttacttcacttagaataatggtctccagttccatccaggttgctgcaaattccattattttgttactttttttttttgagtcggagtctcgctctgtcacccaagctggagtgcagtggtgcaatttcggctcactccaacctctgcctcctgggttcaagcgattctcccgcctcagcctcccaagtagctgggactacaggcacccgctatattgtctggctaatttttgtatttttgtagagacagggtttcaccatgttggccaggctggtcttgaactcctgacctcaggtgatccgcctgcctcagcttcccaaagggttgggattgcaggcatgagccactgcgcctggcctatttgttcctttttatggctgagtagtattccatggtatgtatataccacaatgtctttatccagttgttgattgatgggcatttgggctgggtttcatgtttttgcaattcggaattgtgctgctgtaaacatgcgtgtgcaagtatctttttcatataatgacttcttttcctctgggtagatacccagtagtgggattggtggatcaaacagtagttctacttttagttctttaaggaatctccacgctgttttccatagtggttgtactagtttacattcccaccaacagtgtaaaagtgttcccttttcaccacatcttcactgacatttatattattttttgattttttgattatggccattcttgcaggagtaaggtggtatctcattgtggctttgattttttaaaataacttaagactactcacattctgacacttaattattttctttcttttgaacaacaaagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgatattcggttgtgcttttatactttatgttggataacaacctgtgggcagttgtgtagatgccattagtccctgcctcatgcttgcccacagctcttcctcccctccttacttccctctcctgcccatgcaccagagctgtgccagcccactgctgcacagcctctgcacctgagcttgccaaagcccttcctgtctcaaggtgtgatatttgcccctccttgtctggaatgtccttcccctagaactgcatgaagctggtttatttcagtctcatgttcaaagacgcttccagacctaagggagatgtccattctcctccctgtccctgccccaccacttgcatttaccccttttattttattcatctcagcatactctgaaatggtcttgcttattttgtgtgtgtgtgtgtgtgtgtgtgtttaactatgagctcgtgagaacagggattttcttttaaactgctgtgtacctggcacaacatttgtcccctagtatgagcttggcatctttggggctgtaaacaggcttgagcactgacatggggcctggagaatgtggtttctggctaggcagctggaacaatctacaaaatctgaggggaaagctgtccttaccctaaacctggggaggtccctaggttcaagtctgcaggaaggggatctggttcaggagaaggccgtcctgtgaatttgccccacccaccaagctcagctggagcagggcctctgaaggaggtgccctctgtgtggctctgctgtggtgttggttcatgaaggacatgggaggggggcaggacaggagaggcagctcttcctggagaaaaacacacccagcccaagttggagccctcctgtggcattgggtggggaggattcccgccatcagttctctgtccatgggtgctagtctcacccctgccctccgagcagtccgtgctcccagtgtccctgtcctcttttttttttttttttttttttgaggtggagttttgttcttgttgcccaggctggagtgccatggggcgacctcggctcactgcaacccctgccttctgggttcaagtgattctcctgcctcagcctcccaagtagctgagattacaggtgcctgccaccatgcccagctaatttttataatttttttgtagagacgggatttcaccatgttggccaggctggtctcaaactcctgacctcaggtgatccacccgcctcagcctcccaaagtgctgggaatacaggtgtgagtcacggtgcccggcctagtcttcctgctctaggaagggacgtgtttggggaggaaatccagggcagctacctttgtgagttgtcctaatgctgcgttcagagttccacacgttcaacaagcatctgacatttaaggaaagtgaatgtatgtcatgaaagacagatgaacaaagaactgatcttgaagaaaatgtaatcaggaaacgagataattcaagaacaaaaacctgtgaaggactgaatgtgtcccccaaaatgtgtatgtcgaaacctaatcccacataggatggaattaggtagggcctctggaagttgatgagatcattagcgcccttataggaggcccgggagagctgctttgccccttccagcgtgtgaggacacagtgaggaggtgttgcctatgaggaaacaggccctcccagatggtgaacctgccggtaccttgatcttggacttaagccatctgagctgtgagccctacacttccattctttataaattatccagtccaaggtactttaggaacctgaatggattaagacaaacctgattatgccactccgagatttgaggtaacatttgaatctaaaagaggctatatgaaagaggttataataaaaatgatttttgactaaaaaattgttggcctaagataattcagtagcagggctgaataatgggatgactcaaaatcagtaagctcaaaggcaatttcaaagaaatctttatgtttagcaagaagaccaagatgacaagatgcgccaggagacttggccagaggacctccaggctgacaaagtttccccgaggaagtcagattggaaaagtgtcctcaggttcaaggaaacctgggtgtgcaccgggtgaatgagagtggcagacagaaggaaacagcaaggcctctgaggtaggagggacagcgtttttgaatgtgaaatttattccctgatacatgtttttaaaaatgaatcttgctgcccttagaaaatgaacccccgaacaaggtaaggtcgagctggcccctcgtgtcatccgactttgcgttgtggccctgcctgcagaaacgtgtgctctgctacagccctgggaggaggggccgggctcccaactcctgccccgcttctagcacatgctgtgcttggccacttctctgcctcttagtttaacagcagcactgggcaaggtttgccctctgcacaccagaccggcttcccaagaaccggggaagaggagagggcatgcctggggcctgagcttagtgggccgggtggaggcaggaggtactgcatggaggagcgtggacagtggcatgcaggaggccagtcattctgcggttttagctggaggtttgtttttggtagtttgtagaatcatcagatttgatgatgaaactttttttccataaatgttaaattttcagacacttgtattttttttttccttttttttttttgagactgagtcactgtcgcccaggctggagtgcagtggtactagctcggctcactgcaacctctgcctcccaggttcaagcgattctcctgcctcagcctcctgagtagctgggattacagatgtgtttcaccatgcccggcgaattttttttgtatttttagtagacacgggatctcaccgtgttggccaggctggtcttgaactcctgacctatggtgatccgcacccctccccgccccccccgcggcccagcctcccaaagtgctgggattacaggcatgagccactgtacccagccctgtattttctttaaaaaccaattttgggccgggcacggtggctcacgcctgtaatcccagcactttgggaggccgaggcaggcggatcacgaggtcaggagatcgagaccatcctggctaacatggtgaaaacccatctctactaaaaatacagaaaaaaaatgagctgggtgcgatggtgggtgcctgcagtcccagctactcgggaggctgaggcaggagaatggcgtgaacccaggaggcggagcttgcagtgagcccagatcacgcccctgcactccagcctgggtgacagagcgagactccgtctcaaaaacaacaacaacaacgaaaaaacgattttggcatgttttgtaagttgccagactattggatatacctcttaatcatactttgtttgaaatcctttgtggtttctaaagcactagtagctttctgaaaggaaaatttttaatgaatgaagcatgcttcatcctgcacatcccctcctgccccagcacccctactgcccatgcgcctctcctgccccagcacccctactgccccagtgccaggccttttctagcagctctcatgggttcatccctgctgcgggcattgctccaccaaggggcagtgctctccctgccggtaagtgttggaacttcacgtttccctctagttttctctttacattttaacatacactattatgtgtcaatatattaattatatattaattacatttatagaggttaggtatatatggcagatcatatctgagcgtgaattacattctccaatatttttatttgtcatgatttattgcagggttcacttatttgatctaccccaacttaacacacatttccaagaaaatatccatcacactagaaagaaagaaagaggaaggaaggaagggagggagggagagaaggagaaaggaagaaagggaaggaaaatggaatggaggaagggaaaaatggaaggaggaaggaaggaagggaaagaatgaagaaagccatttgttcctgcaaacctaaacctctttgtagtaagttctggcagaaggtgtgtttctggagttaaactacaggcttggaaatggaatttcttagcctaatttctaaattagaactgcttatgcaaattaacactccgtacatttcaacaagcagttggctgatttcttctgtccactccacctgcagatgcagaggtggccccatcctgtgatgtgccaccacatcccttttcagtgaagggctttgttggctgctgtgggcattctcatggcctctccagggatggcctccactgtagagacctatgtcaccaaggccaggccctctcagggggctccatccaacgaccattctgcctcagggtaagaggcccggccctctcagcctgagtccattctggctccagagctccctgagagcttgcctggcaagttactcttgcaattctagcttccagcaggcgttgatttctggggcacttttgataaactcctggcaggaaactcaatctctgggggtcagagtccacttcctggggagcccaatctgtgacccctaggagtggggaccatggaagcacttggctctccagcatgtgctgaatagggggcgctgcctgcaatgtccacgtggaaacctggctgggagaatgcctgtgtgctctgcatggggatgtaaaggtgtgagcaaaccttcttcagagaggggatgttcaatgcgaaatttgaacattgggacctgaaaaactgatgggctgatggggtctgcccatgattggcagccttcatagaatcacgagggaggagcacaggccaccctagacaggaggggtcccctactgacagggaggtgctgtcggggcagcaggcacgtgcaggaaaacggaaaagcagagtaattgaatgtaaatcatgcaactccactacagtggctagaagcctggatgggcaacttggctgagtgatgttgggcaagttatttaatatcagtattctcagttttctcatctgtaaaggggattaaatacttccttcccttacagggctgccctggtcttaagtaatgcccacagagagcttagcattgttcttggcaagtcactagtactcagtaaatactatttttattaagaaggtaagattcacaggacttagtgtcttaactagatgttgagagtaaggagaagagagaatacttctcggatgattgttcagtttctgatgaatgtctgttcccctttcaaaacctaattcagatgtcacttcctcctcaaagctctcgccccgcgccgagctactgtgatgtatttttatgacctggcagcttttttctcatatccctgttagcggtatgtggtaagaacatgagacacagaatcagaaaccatggatttctggtcttgactccactaccactcagaggaacctcacggtggatgccgtaagtgtttacactgaaaaggattttcacgaaaacctgcattttcatttcgttcacaagagaattatgagactagaaaaacaacaattcttagtataccacagactgtggtgcctaggaataacagacaagctttaactcacacgatgagcatctttatttagctctgcttttagatatctgcatgataaagatgagtgatccaacgttagaaatcatctggacattaaaactgaattgtaggcaggcgtggtggctcacacctgtaatcccagcacttacggagaccaaggcgggcagattgcttgagctcaggagtttgtgagactagcctgggcaacatagtaagacccctatctctacaaaaaatataaaaattagctaggcatcatggcctgtgcctgtagtcctagctattgaggaaactgatgcaggaggatcatttgagctcaggagtttgagaccattctgggcaatacggtgaaaccctgtctctacaaaaaaatgcaaagattagctaggcatgatggcacatgcctgtggtcccagctactcgggaggctgaggcaggaggattgcaggaggtttgcttgagccggggaggtcgagtctgcagtgaactgagattgcatcactgcactacagcctgggtgacagagtaagaccctatctcaaaaaaaagaactaattgtaacaaactatctttcaaattatatcaaaacagtgattcataaattccatgttgcccagagatcatgaggagctcttctatgatttgacagtgcaattactgaaggggaagacaccatgcaaatacatggtaaaaatattcaaattattactgatttgacacaaaatattgatgtaaataacataaaactgtaatatgccattatgatgacattaatgaaaaattggttaatgaatgtcattgaaagagcatgtacatcactaaatgttcttagtcactgaaagtgtgaaatagcctctaaactcatatgtggaaaaagaacttgaaaaaggtttccagaaatgtgacaattctagtactttcatgacattttaaaaaagggattgtaaagactgatgaaacccttaaaacctctcaagaattaaaaatcatttttgatcaacagagtaaactgattttttatctctgttgaaagatatttttaaaatcattgtcctatggaaaagtcatatagaacgtttgctgtttaatgtagcacagatgtatcaaaaagccatgccaggcagttatagatatcttagttttctggattttgtgacgtttgtggtatttgtcagatttttaaaatttgtgatttgttgggatttgttcctcattcacaggtaattttatatacttttgtattcactttcgaaaagaaggcaactctaaattttatgaacttcaagtgctataaaacaattaccacagtaaattttgaaaaattcaccccaaaaagaaaccttgtatccattggcagtaactccctatgctccgccattcctctcagctccctgtctggcaaccacttcctgtctcttcagagttgcctcttctggacattacatataaacggaattatacactatgtggccttttatgactggcttctttcacttagcataatgttttcaagagtcatctgtgttgtagcatttgtcagtacttcatttatttttgtttcctaacaatactccattgtagggattgaccacactttatccattcattggttgatggacatttgggttgtttccactttttctgctgttgtgaataacagtgctaagcacattcatatgcagtgtttgtgtagatatataatatgctttattttctcttgagtacataaaagtggagcctctgagtaatataataactctatgtttggtgttttgaagaattgctaaattgttttccaaagcagctgcaccattttatatccctaccagcaatgcatgaagcttccagtttctccacatcatcacgaatactccttattctctctctttttagatatagacattctggcaggtgtgacattgtatctcttgtggtttagatttgcatttggagcatgtcttatgtgcacttaaaaatattaatatctattctgctgttgttgggtaaactgttctatagatgttgatatggcttcgctgtgtccccactcaaaatctcatcttgacttgtaatccccataatctccatgtgtcaagggtgggaccaggtggaggtaattggatcatgagggtggttttccctactctgttttcatgatagtgagtctcacaaggtctgatggttttataagcatctggcatttcccctgcttgcactcaggctgtcctgccacactgtgaagaaggtgccttgcttctcctttgccttctgccatgagtgtaagtttcatgaggcctccccagccatgctgaactgtgagtcaattaaacctctttcctttataaattaccaagctgcggctatttcttcatagcagtgtgagaacggactaatacaggtgttttttaggtcttgttattgtgtcgttcacgtcttttatttccttgttgatcttactcttagttgttctatccatcattgaaaatggggcattggccaggcgtggtggctcacgcctgtaatcccagcactttgggaggccaagaccagcagatcacttgaggtcaggggttcgagaccagcgtggctaacatggagaactcctgtctctactaaaaatacaaaaattagtcaggtgtggcagtgcgtgcccgcctatagtcccatctacttgggaggctgaggcaggggaattgcttgaaccctggagtcagagtttgcagtgagctgagatcatgccactgcgctccagtctgggtgacagagtgagactcaaaaaagaaaaaaaaaaaaaaaaaaaaaaagaaagaaaatgagacattggatttgtaagtttctgacaggttcattttgcctgctgcccagatagagccgatttatgaggacagggaaattgcaatagagaaagagtttaatacatgtagaactggctaaacaagagactggagttttattattactcaaatcagcctccacaaaaatttggaggctaggtcttttcaaagatagtttggtgggcaggggtttgtgtactaagaaactaaatgtttcttgtgtactaagtcagcttctgggtgggggccagaggaccagttgagccaagaattcaagaggtacaggttcaagtagggccatctggttgtcagaaatgcaaaagcctggaaagtcatctcaaatgttaggttctacaatagtcaagttatttatagtaattgggaaagttgcaaatcttgtgacctctgtagaaaataggtggtaatctttacacctatatcttagtagaattcaggcccctcacttcctcctaacctggtagcctttcattagttttacaaaggcagtttaattttggggggcagggctattatcatctaaactataaactataatcgtttgtcccaaagttagcttggcccatgcccaggaatgaccaagggcaatttggagattaaagtcaagatggagttggttagatcagatctctttcactgttataattttctcactgttaaaatttacaaaggcagtttcaaaatctgaaacttttattgttaaattatgtatttattcctttagttctgtcatgttctgcttcttatattttggaactctgttgttaggtgcatacatatttataattgttatatcttcctgatggattggtattgtaatcactgtaaaatacactattatcattgtaaaatattcctttttatctctagtattttttgtctgtttgacttaaagtctattttgtttgatattagcatagctattcttgctcttactgtggcaatttgtatgatacctttttcttttagcctatttatatctttgaatcaaaagtttgtctcctgtagatagcatatagttggataatttttagttcttttgattggattgtttaattcattcatttttagtgttactattgatatggctggatttgtgtctgcaattttaatttttgttttctatatgtctcgtgtttttgtggctttgcttcttcttctttgctttcttttgcattaagtattttctagtttaacaacttaatttcttaaattatttttaactatatttttacgtatttccttaatgaatgcttgatggctcacaatctccttctcagtttatcagaatctacttaagtttatactaacttatgtccagtgagatagaaacacatttcttctttatagctctaggtcctcttcacttgtttttgtgctattattgttatacttactacctctgtatatgttacaagcccaagaatactattctacttatttatataattttatgttttttaaagaacctgagactggaagtgagggaaatagggcgtgcaggaaggaaggaagaggaaggaaaagtgtgtgaaagggggctccacctcctttagtggataccctgagcttatttccaggggcctttgtaaattcccagtgacaactctttggaagatgaaatccccctcttccctgcatcttattagaacagtgtatcctggaggacatcccttgcctttcaccaagtgaccctatactggcggcagaacttctcgattttgcggatttcaaaatggctccacgtactcatagttttcatgacagacttcattgcgatagtcaaatactgttccacttactgcagttgcctacagtctgggttttgttcagttgaaattaaataaattttatgcacaaa

SEQ ID NO: 791 - DNA, 80950 bp, Homo sapiens
agtgaacaaagagaactcccagcagccgccagccagctgcatcaggagatgttagtcacgcccggaaggctgttctagtccgcctccttggaaaagaagctcaagtaaataattgatggagaatgaccgaacccaggacaaagctttgcaggaaaccagtgcatccgtgttcgagcggttttgggatcctctgccaagtacgggataagagaatagagcaaggagtttgagcgctgctgccaatcttccatctcgggcgtggctctggcctttttgtctctttatcccgccactccccacccccgtcccccgtccccctccccgccttcttctctttcctcttgaaagtaacctctctttggttacttctaccctatcgtcccttgcaatcccgccttctctcctgcccagttcggtgaggtcagctcatgaacatctctgcacttcctggggagcgtctggcccagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaagtgagcaagttctggatttctaaagggttggggatgaatgatggggtgggttagcaggcggataaaacttgagattaaaagtgttggtctaagccgtgcaggggttggttgggtgataattttcaccgggaaagccttgaagagatgcagcatcttgtcactttgtgggaaccacgtgacagcagccggatacctttgattgtggagcccagttactggaacacaagctttcgcctgggttaatgctgtctgagggctgagtttaaacattggcttctcagctctggaattattctgcctgattaaaaacaaaaataagtttgcattggcaatataagttagttagatagcccatgttagtgccacccatgatgataaactaggccagacattctagtagtatcgcgactgggagagaagatgtagaaaacaagttggtgggcaattttcccccgatgtcttctttgttcacctttatatttcaaagtgagttggaaggagatgccagaaacagaaagggaggtggattaggaacccttcggtaatatttctttataaaatgaggaattactgcatgctaagttgtgatgctaacaatagatgttaacaagaataatgcaagtaaaataactggcagtaaagtaatctgctctctgtatagaacaaatatttttaaaggagaaatttatgcctagtcatgcccctttcagtgctttagacagaaataattttaaggaaaaggcaactaattgactagctgcctggatccctagggagaggaacccatgaggcagtaacttgctatttttcagattaaagaagctagtgacggatttatcttggaaatacacatactggaaattgatcttaccaccatgagggaagatgcaccagccttctgggttctgtctcagaattgctatataggaggaaatgggcactttaaaaagtacaacttttgcctatgatatgcgatgtaagaagatggctaagaatgaaaatattttctatctagcaattacacttaaaactaaagtgattcataagactacaaaactgggtaagcataggaaaattcatcaccagaaacttaggaaactgcagaactgaccacaacttttccaaatgtattttaaaaattatttcccaaaagggaaaaaatacgtttttgggttgctaataactaacccatatagacaattcttaatgctattattttcttgaaactgagattgatttaaaggcattcattatttatattttcttttagttctattataaaggaagttgggtgcattttcccaaaaacaacattaagggttggagctgcctggggaaagtgtcatttatccgtagaaaatattctctaggaaccctacatcataacccttttcctctaattgaacttgggaatactaattaaatgaaaactttctccagtaaactaggctttacatatggatttgatggtaaggaaagccaaagttgtaaaagcagagttgacaactctaatatatggatatcttttctttctgaagcttcttttccactttatcctcttttcttttatatctccctttccatcaattcctgtctgactctgtatctcaccctttccaaagcctgctaccatgagaatgtaaggttcagctgctttcagatccgtcattttgctgaggtggagtgagatggagacagcgccaccctgggcaaaatgagaattgacagccctccatcctattcctaaagacagccctgcatcctattcctaaagtcaaagcttctattaagcgccatccaaatggagcaatatcaccctttgctctgcaaaaattcagacatgttgtcttcttctctccttttgtttctgtcccagcttaggaaggaaggttggcggcggtgaagagggaagaggatgatctagtaatgggctcttccaaatcgcatctggtaggttcatagccatgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggcactaaactcaattctgttcggcagcagcagctgcagcagcagcaacagcagggtaacaagaccgggagccgcacggggccgcccgccagcatccgaggaggcggaggtggggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatctcaagaaggagcgggcggcagcggcggcggccgcggctcagatgcacgctaagaacggcggcggcagcagtagccgcagctccccggtgtctggcccccctgccgtttgcgagaccctggccgtcgcctccgcctccccaatggcggcggcggcggagggcccccagcagagcgcagagggcagcgcgagcggcgggggcatgcaggcggcagcgcccccttcgtcgcagccgcacccgcagcagctccaagagcaggaagaaatgcaagaggagatggagaagctgcgagaggaaaacgagactctcaaggtgaggagggtggggggacccggctgggggatgggaagagtgggcctgggaggattagggcgtgtaccggcagggatcagaggctgctaacctgttagggagccttgaagagggaggagaacaagaaaggagggagggggtttcctaggccttgccggaatttgaatctgctctcagtaacgcgaggttttcatttaaattcaaatctgggcctccgtttctctaattataatggtttgtcacacttcttcctggagagaggtagagtaagagaacgagagagggcctaaagtgggcctttttcccccagtttcctcttctgtactcagctccttgtcactcctgtctcgtggagagagagggcaattaaagctgagaatttggaattggaatggggtgtgtacggtgtgtgtcggaagggctggaagcgagtttgattttgacacgcggcctgtcaccgcctcagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggtctgcggcgcgggggctcaatggcgcgcggcaggggcggtgggtggggactttggccaagggctctttaggctgagaagtcttcagtggcgactggcaaggagccttagggacacagtttcgtagcgctaaccacaaaatactagggtctcagaagggagagaactggcaggtggctctaaagagtgcagagtgtgtggagggcctggcagcaaacgagctaagtgtgctctcctgggagcaaaggtggctcttcaagaggtgatgagaagaaggctcccttctgggcagaagcaagggcgtggcagagcgcaggctctagcctttgatctgcccttcagtctgtctactgagagaagtccggtggaatcgggcagtcaggagctgcactaaaaggactcctctgggggagttgaaacccaaaataggaactgcactgggaagatactagagttaagatttctttcagcaagtgtccactccacttccttcttccaggacttcttcctttctgcacttgccacttaggtgactccctgagggggaaaaaaaaaacagataaccaacttgcagcctgtttggtgtgaggtaaatgaaataatctcatttttttaaagtgcaattgttccttcagaatttcttccagtggaaaaatctcaaccttgaagtgcattttctagacaggtgtggtctccagttcagtttgactgtaggcagattcattgactatgcaaactagacattaacttaatctccttgcacaaccaaataagtatacgttcattgcattaacttcattgggatttaaagatcacgtgtaatctttgttttaaagaaagctatgtgtaaacattttatgaaagacgtattactttttttcttaacttttgtcgagtgcttagtatgtactaagcactgtggcaaacactgttacatacattattatttcatttaattctcaagggaaaaaaaatcctacaatgtagggattattaaggcaccattttataggtgcagaagctacaccttttacagaggttaagtgcccaggcctggaaaacagctaataggtgccaggctgactctccactcagtccaaaatcacaacctgtgtcctaagcctctacaccagtctgctccacttttcttccaaaccctagaatttccaggataatctcaaaatatgaggcaaaaatgcacagtcattcaaaaaataataatctcaaggactaaaactttcctaagattaagcaactggaattcaagctataagattgaaattcaagcccaacccactacttgtaaaaacttcaatttttcattctttaacatagattataatggaaacatctacctcatagttttgctgaagtaaaggaaatttgtgaaatttctctacatgtgataaaatgcaatagaacattttttaccacagagtagtgcagaagttaagggaacaaaatttagagccagattgccaggcctcttagcccagcagtgtctactcattagctgtgtgaccttgacctctctgagactcagtttcctcatctacaaaatagaagtaataatagtacctatcccatgggatttttgtagggttaaacgattgatatatgtgaatggcttatatgtatactttgtggaataatgcctggcacatggtaaacaccatataaatattgggttttaatgctttcaataggaatacaattttagcccttattatattgtcattaattatattttattgttacaaacaccttaattcaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagaggttagtatttgattatttcatggtgtactatgtatttttagccctttaaaaaagaatcccaaggactaatatgactgttaaaaaatttcttttatgattgcaggacaattttttactcttacccaaatagtaaaaaatacatgatttcatactaataaatgagtagcaacgaaagattctgacctaaacacggtatctaactcgacatgtacgagctttgactgatctctgtgtttcatctctgtgtcttctaaatgtatgttaattaaatcaattccacagcatattaaatgcaaagagtgtcaagcgtgtgaaggaatgagacttgtgatagttgaggggaataattagccccatgagattacttacaattgagttcatagaaccatgaatttttaggatggaaaagactctaaggtccatttgatctaatccattcattgcttgaagtctatatatagcaaagccagcccttcccgcaatgttctaatgcttgcaatatcaccagtgactatccctgaagatcttttacagcagccaattgtatcatatcatagctctgtttaaagattttccttttttttttacatgatatatatttaattgcaactttagccagctcatcttagttataccctttagggtagaagagtaaagttctccttcatgtcagctatttgaagattccaaatgtgtttaccatgagtcttctaaaagaacagaatcaaggtaaagaaatggaggagaaaagagacagaaacacctatcaagaaatgattagctttaagataaacagcaatttaattagaattaaattatacttctctttgatagctacctgaacatgtacaatgcaacttgtgaaaactaccattgagaaatagcaaatgcacaagttgtcttccgaaaaatttcctctgcttggataagcagaattctaaagaaaattctaatctttccacagactgaggtatttacccacctgtcattgctgtgcttatctcaaaatggtacaaaaatataatgcaaataacagtgcaattatcaacagtctgattaagaatatgtcttaggactttgaagaatacagtttcagtggagtaaactattttttgtgatctgtttacttatattatcctgactttaaacattttttagcataagaaaatagtaaaaaaatattttaatgatataaaatccttggctactagctaggagtcgctctgtgctatagtagaaaaatatggagactgggagctgtgtgatctattttcaccagtaactgggtgactttaaaaggcctgtaacttgtacttgtctacttttatccagttctacactgaaagattgtttttgatgattctcaacatctttttctggtatgtaagactttcctcatgaaattcagaacattgccatttaaggaatggcaaagattttttccctaaagttaaaagatcaaatatgaaattaatatagttataagtatatatttcttcaacaataatgtacagttgaaggtatgtcaaaaattgactttcatttatagaaaaaaaagtaaagtaggtaactgtattagttctctagggtagctgtaacaaaataccaaaaactgggtggcttaaacagcaaaaagatgtattatctcacagttctgcagtctagaagtctggaatcaaggtgttagtagggctggttctttctgagggctgcgaaggcaggatatgttccaggcctccctctatggcttgtagatggccatcttcatggtcacatggcattctccctgtagctctctgtttccagacttcccctttttgtaaggatatcagtgatattagattagggtcttccctaaggacctcatttgacctgcctgggctcaagctattctcccacctctgcctccctaagagctgggattacaggcatgagccatcacacccgcccctcattttaatttgattacctctgtaaatacctctgtctccaaatgagatttcatcctgagcagctgggggttaggacttcaatatatgaatttgacagggagggtagaaggagagaacagaattcaacccacagcagcaacaatctaatagcttcctgtgagcaagcaaagagaatgttcattgtcagtctcataggcgccattccctattcatacgttacttgtgctctctcatattccttgagtgttttaaattgtaaacattcaagtacaaacaaacttcgcttgattaccagagataaaaaagaaatgccttgtaatttggtgtcatgtgaatgttttaagtggatacctgaaaaattgtacttaagaatggcataagagctttctgattttcattttacttccattaaaggggaaaatatgcatagactgtctatccattagccagaacaatgggacctctcccatcttaaaataaaagccaaaataatctggccaccaggaagaaagggtagagcttgggaatgtcctcaggagattgtaaagatgcgtttccttgattcttttgctcacactcttccctgtgactatttcctccttcagggctctatttctgggttgggagaatgctgttccagcaccaagcagtgtgggtatatatattcataccaaagaggcaatttgattgtccttggagttacaaaaaaccaaatgtcaatgcctgattagggaatacaacaataaaagtaaaaataatttaggagtatatatgcagaacatcagcctttaaagtaatcttttattaggaaaatggcattcacgatttgagaagatggaaggtggtggggaacagaaataaaaaaaaacaggaagggagaaagagtggaagataaacatctggaggatactaaatataataaaggaaaaccaaataatattctggtaggagttctctataattatccatttgaggttgaccttcatagtgttcagaaaaatgtcagaaatagaaaaagtagtttaacaatatgtttagaaatcagaaatgtttcattcagataagatttttgcaatggtaattttatgatgctctaaaacggtaaatattaaaactgagctgcaattataactggcttactctgtggataagggttgtaagctactccttggatgacttgcaacaacttcagttaaccatctgcttcattggttgtaaaatgaaaacatattcaagcccttggtgagtgttaaccaacttggttaatttggtgagtgatgaattgtcatcccttcgtgtcatttttttaaaggagaaaagtagaaccaggccaagctctccattaagagaaaagacactagttatagagtaaagtcaaaaaatcatagaatatactctagagaagcaatcctccaattccaagtttttagatctttacatggagtcatatagatgttgaacagcaccgctgggaccaatagaccatctgctacagtttagaactgtttgctaaaaatttaattagcttcaagggtattgaccaattgctctcaggactggtggctgcacaaggtcttgtgcacctcctcacatctatctgtctatcttctccccctgagaggatggagtaggcacctgggagtaagaagaattgagtagaggcaggatagaggtaattagctgcatctattgcatctcattgcttgtattgaaatagctgatgtttgaccaactgcaaacaagagggacctcttcgaatgctgccttcgaatcttaatagcattgtcatcccaattataaaacactgattgctaccagcactatgctttcttgctgtagaagaatgcctttacctttctgtaacctgtagaaaatggcattctatctttcaacattgcaaatgatcaaagagacagaggtttttaattaaagttatgtcatgtaaacaacaactagctctttgaacgtcatacacaaataggataaagtgaggttgtggaggaggctttggacaatgcattctctgtgagaggtgagtttttgctccagttaaattgaggatcactgcctgtcatgaggttccgctgctgtagcagtgaactttattttcaaagctttgaaactccttgtaatcatcaagagaagaagggtcatctgatgtcacttttaaggtctggtgcttgttgaagtgttgataagagacatttgagcaaagaattcaccaacagaagagcaaagaaaaagagtaagatgatgatgatgagaactgtttatcagatctttcttcttttcagaatctgtactccttatattgtctcatacctcacccatacacaagattcttaaaagaaaataattttcttaacttttcccagtctttgctccagagggttcttaactggcctactgaaatagcaccatctatcttggacttttattttttgtgcacttggtataatagatcttatctattacaatgaactttcattctagaacacaaaaataattagtactataaattttaacagcgtctctggttttcttgttttttagagtcccttgagagtatatctgtatacccagattctctttacaaatggaacactttaataggcaaattctgtactatatatttacaattacctatttattttcttatataaaataaagaactgatcatagctacacttggttctaatagggaatgtttacctgaataataaaatgtgaaaaagaaatgttgagtgataaatcagcgaagaagcattccaagagacggtttaatggggcatttcttgcaaatattttcccctggttctggtagtttacttaacattttaaaataaaacagtagtcattgatattttaaaatgaaatggccacacatatatttagatgcatcaattacacattattattttagtcatatcttctcagagccaatagtttgtcgaataacatgggcaggaataagagactaaatttaaaaaaaggaagagtgtgtcaggtaagcatagaaaagcttttcttccaggaagttgccatgtgttatgaatgcattttttttcttttttttttttttttttttttttttttgagacatagtcttgctctgtcgcccaggctggagtgcagtggtgcaatctcggctcactgcaagctccacttcctgggttctcgccattctactgcctcagcctccccagcagctgggactactggcacacgccactatgcccggctaattttttgtatttttagtagagacagggtttcactgtgttagccaggatggtctcaatctcctgatcttgtgatccgcccacctcggcctatgaatgcatttttaaagatgtatttatgtaggcattataaattttattggatttttaaatgaaattagatatacagttccatgtactctgaagtgatctttaatattcagtcacatgtaaatgactgttttacccagatgccaagcccccattagaagcaaagtagtacacagatcagaaatttgtggattatttttgtgcaatataatgagcttttattataaatttcaaatttcttatttacataaaaatacaggacagcatggcacaccctcatgttgttgatcagattccagttcctttcttggctgaaattttgcacttcatattattgaaactataaagtgctgaacaaatacaggtttttacctgattaagcatctcctgttgagtacattcccagttcccatctaaaatatctattgattttgatgtatgcaacgtaatgggcttcctaaaaattgtttaatacatgtatatttaaatttttgttgcttttgctgatgaagcatattcataagagttaagtctccaaccctgaactctttgaggccagtttaacttggtccaagggctcaaggctgaactttgagtgactcagctctgtgagattagcaatttatccatgttaagtatctccatggaagtatattacttatatagttactgaagtgttgtttacttcactgacttctgtatccaacctaccttaaaaggagatttgaggccgggcgtggtggctcatgcctgtaatcccagcactttgggaggccgaggtgggtggatcatgatgtcaggagatcgagaccaccctggctaacacggtgaaaccccgttctactaaaaatacaaaaaattagccgggcgtggtcgtgggcgcctgtagtcccagctactcgggaggctgaggcaggagaatgttatgaacccgagaggcggagcttgcagtgagccaagatcgccactgcactccagcctgagggacagagcaagtctccgtatcaaacaaaataaataaagacgggggagggggaatttgaaatggttcacaataaagccataaaactattgaaataagggttttaaaattaggtaaaaacgctgggaaggtgaagaaaaacttaatccaagggatgtacattgttatgaaacagctctgagtttagtatcactcaaggctggggaccaaatattgaaagaattcatttcctagctgtgaccagatacagaagcaacactgagttttatgtgaggcctctggggcaatcatgaagaaaatccatatagtacaacaaaaagttgcagttatacacagactctacatgcaaccatcatggataaatgagccttctaaatacttgacaggtcttttctatagaatctacaaattatgagttaaaattttacagaaaagataatagtcattttttcattagccatgaatttgagtgtgattgttagaaagtacacgaataatggagtctagaaactagctttgagacctcatctgtcattccctatgaccttgagcaaataacttaaaatttataggcctcagtttttaatatgtaaatgcagaaattaaactgagtgctctcgaagcttcctataaatatatcattttctactttgtcagttatccatctctgttctccctgaaagtttcataggtataaaattcagtttcattactattatttaaatactataattattttttcatatagtcagttaacagctatttcttgaatgcctggtgtagtgtggccatgtagataacacagaggatataaagatatagatggcaaagcgttgcattaaactccaagtttgcacccactgaaggtccctactgaaagtttttttccagatacacattttttaatttaaaaaaatggacatttgaggaacatgtatcttttttattttttaacttttaagtttaggggtacaagtgtaagtttgttacataggtaaacttgtgtcatgggggtttgttgtacagattatttcatcactcaggtattaagcctattgcctattaattatttttcctgatcctctccctcctcccacgctccatcctctgaaaaaccccaatgagtgttgttcccctccatgtgtcaaggtattctcatcatttagcgcccacttgtaagtgagaacacgcagtatttggttttctgttcctgtgttagtttgctaaggataatggcctccagctccattcatgtccctgcaaaggatgtgatctgtttctttttatggctgcatactattccatggtgaatatgtaccacattcttctttatccagtctataattgataggcatttaggttgattccatttttaacacaggaagtaagacccacagttatctcgccattgctactcagtactcagggcctgtgttagcgctgtagaaattacaactgaagacctgatatgtgggaatgagtacaagttgaaactccctaataatccaggcatgccttttgatgtggccttggctctacactctaggaagctacaaagaccatgtgataacaaaagaattcatcatctattccagtaaataaaccagggtgttgaatgatggcccctaaacattctaatttctgcagaaaatcttgaggtggggtttttaaccatatgattctaagaatgaaatctgcccctgcttcctgcccctggaaggctgccaggctctcaccgcagaatgtggccattaaccagcactgatcctcagctaaacatccaaatgtttgtattttgttattattgaaatttatttttattccctatgacttctctgatgttttttgaagttgcaagtctttatgttttcaagagcataataaaaaattttttgagattacttggcctttgtatgtgtgacagacatcaacctcatgcagaaaagacctcaattaacctcaatcccttccttaagagattctcagggcacagttgtaacttaaatagtccatgtggtgcgttcaggctttgggacagtaataaacgacactattctccaccactcccctctaccatggccacccttggctgcctgtgaatggccttgctcccagtagtggcagaaatagcatcttatttctgtctcagccttttacataaaaataaaaacatataaacttggacctgactttcacttagcaactatttatgaagcatatatataatatgtataaggaataacagataatgtcaccaggtggatagtcattgcccacaagttaattattttctaataggaaagagcctcatacaggttgtattttgactatagcttcacatacacattactataccaaatacttctcatgaagtcctcacaagaccaaccagactgtgagttctaagaggacaagagccgctcctgtgttggtccctgtggcaccctcagcatctagttcagtacccagcatataggcaatgagaccaccttcttctgtaatattacaataattattttttacttgatttgtatataactttttcctgctgaaactgtttacagtttcctgactgtaaactccttgagactaaagactgagtccatgttattaagaccaagtccatgttattaactgtgtccacaacaaccaaaacagaacagggcacaaagttgataaacaataagtaatttcaaaaagagaataaatggtaattaagcaaggtgtttcatgcccgatttttgcagagaaaaaaaaagtggctgtgaaccagggctctttccatggtgcttagtgcagtgcaaacatgatgaaaaggaagtagatgggtaactccagcctcaccccacttccagaaatagagatctcccaagaacttactaccttctagaaacttctagcactctactttgcatctctcaaattccatttatcccccagaaacaacaggtcttccctgaaacaaggtacaattggattcttgagaaagggaatggggacaggaacccaagaacaagaagacaactctgacatcttgggcatcagctctgcagtttaacttctttgtgctttggtgaaaaaatgtaaaatgagggtttaatgaatgagagaagactgcagatcctgtcactcccaaagactatccattggaatttgcttgatatcttcaatgtctgagacaattgatttagcagctaatttggctggagagatatggaaaattaccccagggctgcagtggctcagtagccaccaatgttgagtgctaattacatgccagtggctgaactagatagtttatgtataattatgttgttaatagcctcattttagagatgaagactctaaggctcagagaggttaatgtcaccagttagcaggccaggcccacacccaagtctgtctgcctccaacgcgtggtctgcagtcatcagtgctgcgtggcctcactgcaaggactcaggctgcccctccactgccactttcatgttcttcctgacccacaaataacctaccccctttagggaacctcaatactcctagaatctataatcctctataatactctagggtctatcagagaatgttttgagtaaacactgagagaagacttccaaggtggctgtagggaaaaatctattttatcttacagaaagggaatctttggagcaaaaactaggaacataggactagaaaagtgttttcaggtctgtcaattctatctcactttttacaaatgtaatagctatgttacttcagataagtcacgtaatagctgactctcaatttaatcaccttttaaaggaaaataaatatttttcctatcctgtctattcacaagggtaacatgagataacatatgtgaaggtgctttataaattgtatggtaccatatcagatgttactgttattaacatcacgtagctgtaagttagctaataaagacaattcctgggaagaattttgaagtctatcagaataaaattttagagctgtctaggaccccaactgtttctacagaactttgaaatgctttttctttccattttttcatgaatgtctattactctctgaaattcccctttaaatctcacttcattataaagccatgctaacttcttccatctgacccattgcctcttccactaggcctgtatttagtccttactgcttcaggatccactagctcacatttgcaaatgttttgatggacagggagataatctggctgcattacctgccactgcattcatcaacagggcaacagggctgactatgttgatttgtcctgttaaatatctctcttctaccttactgctagataaatatgcttcctaaaaagaaacagagtagcagagaaagaagaactgttctttgatcaaaagtggtcaagcacaagataatttagtttgcattgtagtttttattgactccacagctaaatttaatgttctctgaatttaagaattatatttctatttaattcacttacacacacagtgatacatataaaaaatatcaataaatgtttgggcaagagaagaggtttagaaagataagattgctgtcataggagctcatctttagcttcttaaattataatttactcagttcttttgttttcaaatacttgtgatgttacttttgagtaaatataatgtgcaattttactgtatattggaaagtattttccaaattaaaatttcagttatatgttgaagaccttagacctgactgaatttgaatggaaatacaattatttatttgatgcttctgtcctaattccattttttacatttcaggatcagttaaattgatctttatccagatggtaaatgacatttgaagatgacatttgaagttgtcatttagcctttcctaacattttccattttatacttatatatttcacttaattggagcatttatattcagcatgattcaacttagaagcacttaaaattaaaaattcagaatattctacattgatctgctggctagctcagttatttaaatttgtgtagccaattaatcatgggggtaactggttaatacaattaactgttaattttttctttccttcacaaagtaacagtttcttaccattacattagccaagaaccttgaataatagtagaaataattagaccaattgcttatttattctgatatataatgagcaactaatatgttagtatgtagttgtatccactgcctctttgcatatgaagaaaagaaaaattttcatagaactttatcaagtgatccaactgtgtgtatttaggaatatctgttatatgggaagtattatctatcaagggtaaaatgtagctattgggtttattcatttagcggtatggctaagtttaaattagaataattatgttctagagtcgttctgaaagtagttatcctatttttaattctactagtgttaattttattctgtaatacatgtacaattctcagttttcccaattgccaaaatcaaaaatgaaacttaaaaaattcttggccaggagcagtggctcatgcctgtaatcccaacactttgggaggccaaggcaggcagatcacgaggtcaggagatcaagaccatcctggctaacatggtgaaaccccgtctctactaaaaatacaaaaaaattagccaggcgtgatggcacgtgcctgtaatcccagctacttgggaggctgaggcaggagaattgcctgaacccaggaggtggaggttgcagtgagctgagatcgcaccactgcactccagcctggcaacagagtgagatcccatctcaaaaaaaaaaattctttcagttagtttaactccttacactacagcctgttctttgttaatttaatgtgagattatagataaaattattactactaaatgtttcattgttatagtatatactttccattttaaagcctgtgggaaggtgaaaggtgggagaaggagaagatcaggaaaaataactaatggacactaggcttaatacctaggtgataaaataatctgtacaacaaactgccatgacacaagtttacctatataacaaacctgcatatgtacaactgaacttaaaataaaagttaaaaaaaattataggtattcaaacaattcaatgctatcaatgattttaaaccacagcttctacaattctgagatcatagttttaactaatctttcattgattagataatacttgacatgatttttcaggaaaaagcttataaatattttctgaacctttgtatttttgaaaatagcctttggttgatttcacacaggaatggcagaatgaaattattgagtcaaaaaaatatgtcttattatatattagccctggcattcattttgcaatggagaagtatgagatcagtctgacttttattcctttgtaggtcagattattttctctctacgtatttatggatatttttcttcatcatttatattaatctgagttccccagtgggaaacagaattcacccaagatggttcaaatgaaaagagattattactcacagcagtatgggcaggattatgggaacaaaccagggctggcaaggcattcagaaaaatcttgctactcttggaaaccatcaccaccccgagaaatgaagacatagctgaggaaatagtattatagaggccagtgaaaactaacagttgagtagggtcctcccagtgggatctatcgcctgaaggggacttagctactgcctaaaaatgtggtgttgtaaaagaaaggtagtgaggggaaatactctgaaccatctcttctcccaccttccacctgtcagcgtgcctgccagtgccttctattggccaaacccaaggaggagtcaaccgatggggagaaagcctgggtaaagtttgcagaagtcagcctcctggagcacagagcagggcagagaaggagcaagcatgaatctgggtagctaaagaagaatacccggttcagaaataccacctgggcatatctaggtgatggtctttgtttataacatgtccagaacatacagaccttttactctgaaaattaacacttgtgtgttcattatttcagaaaagctttcttgtattatagatttgataatcatatgtgctctattttttcttcttagcattttctttgctttgtattccttactatcttctcatcctttcattttttaatccttttcctctgtggccttagataattttcaagtttgttttcaatattatggaatcaattttctgcgatgtcagttgtgctccttaaagacatcagtgcaaaatttcattcttgtgttgaattttaaagacctttttgagttttcttattcctgacagcttcctagtcttcagagcttcatctcccgttatgaccttcttgttagttcatagaggccatctttgttatctttttaagggtacaatattttctaacgctatcttctgtttctcatagcaaatagttttcagaaatatttgggggatctttttctttttttagctgactttttaaatcatcctgatgcattttacttttacagctttgaggtttgatttacataccataaattcacttaattgtacaatttaatggtttttagtaaatatgcaaagttatgcaaccatcaccataacccaaatttaggacatttccatcacttcataaagatctctcatgtccatttgcagtcaccttctgttcttagctctaaccccaatcagccactaatctatttttggaatctatagcttttattttctgaatatctcatataattacaataataaaatatgtaaccttttgtacctggcttctttcacctagaccagtgtttttgaggttcatccctgtagcgtgtatcagtaattcatttctttttatttccaaataatattcaattgtatgtatataccacattttgtttattcattcagcagtttttggacagtggatactttataattttataaataatgctgttataaacacacacatgcaaattttcgtgtggatatatgttttcatttctcttgggtagatagctaagattagaatttgggggtcatatggtgaatttgtgtttaactttttaaagaaactgccaactgttttccaaaggggctgcaccattttacattcccaccagcaacggatgaggattctaatttatccacacccttttcaatactgattgtatatcttttttattattgttagtccactgggcatcaaatgatacatcattgtggttttcatttgtttccctaatgatgttgagtatcttttcatctgcttattgtgcactcatatatcttattttgtgcaatatctattcacaatgtttagcctatttttaattgggttttctacttatttttgagttccaatttaagctctatctgtattttggatataagtcttttatcagatatatgatttgaaaatgttttcttcttaggcttgtctttttagtttcttaatagtgtcttttgaagtgcaaaagtttgcaattttgatcaagtccaatttgtattcttttgtttcatcacttatgtttttggtgtcgcatctaagaaatctttgcctaacctacaggaagattcacttcaatgttttttcttttcctaagactttcatggatttagctcttacattcagatctacaatccaatttgagtcattttcatgtatagagtgagtcgggagtctaaattcatctttttgcatgtggatctcgaattgccccagcaccgtttgtcgaaaagactatcctttcctcattgatttgttttgactcagtgcaattttatcttcttttttcctttttctttctcttagaaaatatcatcattgaatgtcaaacattctttatacattcaatgttggctttagatactcactgtgtggctttttttcttagttcctctcactctccatttgctattagttgccccttctcagagccaagatatagaacagcttgacgtgcacaattccagctcaattactgatgatagtaaacattcagctagttctggcctgtttgaagtaggaaaggctgctactgcagcactcaggtacactgactctgagggagacatatcttagaaatatttgaagaagtttgtagttgttctttaactacctttaatatatgaaaaagaataaacctcaacatgggtgctcccaagtcttttctacctatgtttcttcccctgaatgtttggataaggaaagaatatatctcataattgattgcacagctagtcacctagctctttttccttgcctaattcctacttgtttgaatatttaaccaccagagagctacagtattgtctgtgcagtacttatgcatgtactggggaaaatatgattggggtgcagaagttttagctacctgattgattttttaaataactttgttgaatcatattttacatgtaatataattaatccatttccaatggtacaattcagtgattttgtagtaaacttccacgttgtgcaacaatgactataaatcagttttagtacattttaattaccatagtagtgagattcttcatgcccatttattgttaattcctatttcttccttccctttgactacctccaggcaattactaatctacttcttttatctatgaatttaccttttctagacatttcatataaatgaaattgcactgtatgtggtctcttaggtttggcttcttttacttaacatagtgtttttcaagttcatctgtgtcataccatgtatccgtagttcattccttttgtaaattgccaaataataccccattgggcaaatatcatattttatctattcattcatctgtgtcatatcatgtatccatagttcattccttttgtaaattgccaaataatattccattgggcaaatatcatattttatctattcactcaccagtaggtggaattttgggttgtttccaacttttggttattatgaacaatgctgctaggaatattactgtgaaagtccttggtggatatatgtttttatttctcttgagtatgtacctaagattggaatggctgggtcatatggcaaatttacatttagccttttaagaaacaggatttctagttttcattggtctgcatgtcaaatccttctgtttcacacattgaaggccatacattcgatagcttatatttcttgtttgaatttcactgatgttatttttaaaaaaaaattttctcagattctggttaatgcttgactaccatgttagtttttgatattactgtgtttacgtttttgtcttggccttcagatatattttaatcagaagtaaatgatagctttatactatattaactcagaattctgtcaatttgagtaacaatatgaacagggtaaattttctttaaaaaatattactttaggaaataagtctggttcatctttgattactttccttaacttcattaatatgtggaatattttattcctgtggcagtggtatctcatgctcttgtgtacatgcatttatttcccccagctagttttttgtattttagtagagatggggtttcaccatgttgtccaggctggtctcaaactcctgagctcaggcagtccacccgcctcagcctcccaaaatggtaggattacaggcgtgagccaccatgcccagccgagagtgtatgtcttaatattcaatttaacccagcgttgccatgccataatctagacccaactttacccgttcttcaagtgtttcaagtgaaactggaaatttggatttttcaaatgtaaatggtttacatttttaaatttggtaactaattccaaaaattttaaagtgtaattgtgggctatcacatttaacccagtccaggaattaccctcagaaaagtgcttctatatcctttcagtgcattttggaaattaatgaatactctgacctttaaatttgtattatgaaatatcttaaatatgtaattgtgtaaagaataattttaaaacactcatgtaatgcccaccccttagtgtcctgccatcttgtaatggcacattcaagcatatttcttacaagattctaatcctgatagaacaatgttgctaatttcactgcattaatgagttcgaagctggttgagatgcagtgtagaatagactggacagctcatcctttcaccttataaatgttggccacagttttttttctttgcctgaattataaacaaaggccttaaggaactctggtcaccacccagacataattttctaagtgtcttttaattactcaatgcaatgatggttagaacccaatccattaacaagagtaaattagaatacatctctgcatttgttgttgtcatccatagtttaataaacatatctttactgtggatctaagatataaaataattttttttttttttttgagatggagtcatgctctgtcgcccaggctggagtgcaggggcttgatcttggctcactgcaagctccgcctcctaggttcatgacattctcctgcctccgccttcctagtagctgggactataggtgtccaccaccatgcccggctacttttttgtatttttagtagagacggggtctcaccatgttagccaggatggtcttgatctcctgacctcgtggtctgcccgactcggcctcccaaagtgctgggattacaggtgtgagccaccaggttctcagattttttaaaactctaagctgagaaatatcccagtcttaaatccatttgcttgggtggagttctctgaggcttttgcatggtgccaaccaagtataatacatgatatattaaagaagcacttaccatgttggctttgattttttaaagcaaggtggtcttgctttgtgatcagtttattattggcagtttgacagaccctctaataacccataccctgctccaaaagaaggttctacaatgatgaaagagttaattgtatcataaactacttcactggtagccttgagtcccttgatgaatcccagagaagcttagaaaatacagaggccaattcttcctaaggatccaggaaatattttgatcatatgatatgaactacataatgcaaggcagcccatatggagttctaacctgacttttaaaggggatgttttcacaaggatcttgtaggcctcaactgttacagttttttgtcagtgctatttcctccagttctgttgtaaccacatcccattaacaagagaagcctctatttttttttcttctttctgatatcctatggtttttaagctctcttatattttctagagttaagttcagcatcttactttctaagtttctgatgtacctaaatttcactgtacacttaaattggtgcaaaagtaattgcagttttgccattttaagtttaatgccactaatagttacaaagcatgggttccaatttaaagacatttaagctttattaccaaataatacactaggaaaagggcagatatgttctaaagtaattcctggcaccaaagaatggcttaaaaagacactgtacaactgaagggccatgcaaacctatttggccctgtgaagataattctgattcccacaccaaaaaagacttaaaagtttcctcttttattggtagcctggttcaagggtatgctctacaaattgactcattaatattccttaacgataaagaattcacataactctgtcgtcaatctgagctctgctgtaggtatctactttatcacatgggaaaagaatagaggaactaggaaaaggaaaatttattggattctttaatttaaaaaaataaaacaaaataataccatgatcacagctattttagtttggcattgtatcagtttttagagcagaaaaatagttttctcagcttttaaaatttgcttttatttaggcattcactggagataggatgaaataagtttggcagcctcataactcaaaagataggaacggtacctggccttatgggatggagaaagggtttagctgtctagcagaagagggctggctgatttattggcaaattcaggtctctgccttcatgacataaacatctgtatgccagatatacctcctcacctctgacatgtgcctctatgaccatctttagaagggagtcaaagtgaaaaatccaggacttttaaaatttattattaccttctggaaacaatttccagatttaaattgccaatcaactttccttcccatatcttccaacattatttattagaatcaatgaattaataatgcttcttttcttcccttctctattcttttctaaagtctggctttttaaactatcactgtaagtttggaaaatcgaatccttaaattaaaattgataattttctgggtatagttcactttgtatttgtgcttcaactctgtaaatttacataagtaggaaattttggaatatttaaagttattgttcttctcttgcctaggaaaactatagaaacagaatgataaacaaagtttgctaaaactaagggtgggatgaacaaatataaatcagaggcatagataaaggcattgtgaagatgtatatatcacttcttcctaaaaatgaagaataaaagctaagttcaaatagaagaaacacttcatatataataagcttaaatgttaggatgaaatttattagcttttaactcctatatacctttggtgctaattgaacacctgctattagtaagggcagcatctgcaatttagaactggaaaagtgaactttaaaaataatttatttaagctcagtttcattaaaaaatttttctgggggctgggcctggtgactcaggcctgtaatcccagcgctttgggaggccgaggcgagtggatcacgaggtcatgagattgagaccaccctggctaacacggtgaaaccctgcctctgctaaaaaaatacaaaaaattagccgggtgtggtggcgggcgcctgtagtcccagttactagggaggctgaggcaggagaacatcgtgaacccaggaggcagagcttgcagtgagccgagatcgggccactgcactccagcctgggcgacagggtgagactccgtcttaaaaataaaaaatttctggaatcaaaatagtggcaaaggcaggggagaaataaaaacaaggaaaatacattaagctttatttttcttgtgtttgataaccttctcaactcttcctcttagccttttacattctttttttttcgcttttatggaatttgaatacaggatattgtttataaatctgaactaaatttattagcctagtgtattttttaatcccggggtgaagaatgtttggtagatgtgtcagtggatttttgctgtgtagcaaaccatcccaaaactttgtggcttaaaacaacatttatgtggctcataattctgtggtccattctggtctcaggtaggtccatgcatgtatttatggtcagataacagctagaaggctctgcattgaggattaactggctgttcactagggcaataggagcatctgggccacatgacttttcatggagcaggccagcccagacttaaaacacagggtagcagatttccaagagagagtgagcagaattgtacaatctctcaagggtagactcagaaccagcacgccatttctgccaacagattttacaggtcaaagcaagtcacaaggccagttcagttagaagaggtacggaagtagagtccatcttttttttttttttttttttttttgagacagggtcttgctggagtctagggtcacctaggttggagtatagtggtgggtttatagtttactgcagcctcgaactcctgggctcaagctatcctcctggctcagcttcctaagtagctaggactagctgcatgccaccatgcctggctaacttttaaaaaatttttgtagagataaagtctcaccatattgcccaggctggtctactcacatattcccatttataggcctacctcagagatattgcaggttctgttttagaccacagcagtaaagcaagtcacactattgtttggtttcccagtacatgtaaaagttatgtttatactatactgtagtctgttaagtgtgcaataacatggtatctaaaaaaagtatataccttaattttaaaatactttattgctaaaacatcctaaggatcatcttagccttcaacaagtcatcatctagttggatggcgggtcttccctggatgttgatggctgctgactgatcagggtggtggttgccaaaagttggagtggctatgacaattccctaaaataaggcaacaatgtgatttgccacgtcagttggctcttccttttatgaaagactgccctgtagcaggcaatgctgtttgacagcattttacccacagtagaatctcttaaaatattggaataaattcttgcaaaacttgccactgttttatgaaggaagtttatggaatattctaaactttttgttgtcatttcagcaaagttcatatcatcttcacaaggaatacagttcatttcaagaaatcacttcctttgctcatctataagaaacaactcctcatccattaaagttgtatcaggagctttcagcaagtcaatcacaatcaggctatacttctagttctcttgctattgtcaccacatttatttcctcaactgatgtcttgaacccctcaactcatccctgagggttggaatcaacttcttccaaactcctgttaatgttttgaccgtctccaatcaatcatgaatattcttttttgtgtgtgtttttgtttgtttgtttgtttgtttgagatggagtcttgctctgtcccccaggctggagtgtaatggtgcgatctcagctcactgcaacctctgcatcccgggttctagcaattcttctgccttagcctcccgagtagctgggactacaggcacgcatcactacactaggctaatttttgtatttttagtagagacggagtttcaccgtgttggccaggattgtctcaatctcttgacctcatgatccacctgcctaaggctcccaaagtgcttggattacaggcgtgagccactgcgcctggcccaatcatgaatattcttaatggcatctagaatgccatttctttccagaagattttcaatttactttgtccagattcatcataagaatcactacctggcagctatagccttataaagtacatttttaaaataataagacttgaaagttaaagttactccatgatctatgggctgcagaatggattttgtgttagcaggcatgaaaagaacattagtctccttgcacatctccatcagagctcctgtttgaccaagtgcattatcaacgagcagtaatcttttgaaagggatcctttcttctgagcagtaggtctcaaaagtgggcttaaaatatttggtaaactgtgctgtaaattgagatgctgtcataaaggctttgtcctttcatttatagaacagaggcagaataggtttagcataattcttaatgaccctaggattttcagaatggtaaatgagcattggtttcaacttaaaattatcagctattttggcacccaacaagaaagcctgtctttgaagctttgaagctaggcattgacttctcctttttagctatgaaagttctagatggcatcttcttccaatagaaggctgttttatctacattgaaagtctattatttagtgtagccaccttcaccaatcatcttacctagatcttcccaatagcatgctgcagcttctacatcagcacttgctgctgaaccttgcccttttgtgctatggagatggcttctttccttaaacctcatgtaccaatgcccactagcttctaacatttcttctgcagcttcctcacctctcttccttcactttcatagaattgaagagtaagggccttgccctgggttaagctttggcttaaggggatgttgtgggttgtttgatcttttatccagaccactaaaactttttgcatatcagcaataaggctgttttgctttcttattatttgtgtgttcactagagtggcacttttaatttatttctagaacttttactttgcattcacaacttggctaagaggcctaggtgtttgtcacaagaggcctagcttttggtttatcttggctttggacatgcctacgtcaccaagcttaattatttctagcttttgatttaaagtgagagacatatgactcttcttttcacttgaaaacttagaggccattgtagggttattaattggcctatttcaatactgttgtgtctcagggaataggcctgagagggagagagatgggagaacagccagttggtggagcagatagaacacacaccacatttaagttagccaatttatatcagtgaagttaatcgtgccccaaaacaattgaaagagtaacatcaaagatcattcatcccagattatcataatggatataataataatgagaaagtctgagataatgggagaattaccaaaatgtaacacagagacacaaaatgagcacatgcttttagaaaaattgcacgaatagacctgctcaatgcagagtttccacaaatcttaaatttgtaaaaattgtggtatctgtgaagtacaatacagtgaagctcaataaatcaaggtatgcctgtgctttatatcaactctagattacttatgatacataatacaatgtaaatgttatgtgaatagtggtttttactgtatcatttttaagtttgcattattttttattgttgtacttaaaaaaaattcaatctgtggttggttgaatccacagatgtgaaacctgtagatacagagggccagctatatgtgatatgtcctgttttaaatacttttcagctcatacaattttgactctttagtctttttgttgaaaagcctaagacatttttatttttccagcttctttccattttatattccagctttttaaaggtctacttttaaagtagaccttttcaaatgggcttttgtttacctgttatcatttattgacttttagtaacgcttccaaaacaaatctaggtaagaaataaagctacagtggctgtttcctcattgaactgacatagactaaacaactactttgtgtcaggtatatttctaagagcaggagctataacagagaccaattctaggagcctgctcttgtggagctcacattgcagaatgagaaaacagacattgaaacaaacaaatatacaagtcagttggtgagattagaggagctatggggaaaaattaaaaagcagaattaggaagacaaggaatatgcaaaggaagagaatggccgaaggatttgctttttgatatgaaatggcctgggaaggtctctcttattaggaaccctgaagagactatggaagtgggtcatgagagtatatgatggaagaatgttgcaggcagaggaagccataatccaaaggccccaaacaagggcatacttggtatgtttgaggaactgcaaggatgcctgtgacactagagcaaagaaagcagtgaggagtgtggtgggagatgaggttgaagggcttgtttgggatgtgggattggggggtggggtgaccacatagagtgggctggtagttgacagaaccagctacacattctagtcactctgggagctttgaaaaaatgtctgggcccaatcccaaaatctgttttaattggtctgggttgaaatctggtcaagtctttataaaacattaccagaataaatccagtgtgtagtcagggtctggtataccttagtaaagcatgactctaactcagtgagatgggaagccactgaaagattttgcacaggatgatacagcttgatcaccctggcatgtgcctcttcttcacccacattcccctctggaccttaagatcatgccttagtatgaagcttgggatcctgcctcacccttttagggaagagagtgaatgtggtcctaagtaagctctctgggcacttcacctgttctgcctctgccagtctgtctgggtaagtgtcaaggatgtaatagaaggaaaagaggaagacttctaggaacaagagcccattctgtccccttccaagacaagttggagacagagcttctacctttttcagtttccttccagcaggcaatccctgggcctccctcccagtgttaccctatagtcacagtatttacagattgatttaagaaccagtaagtggtgtatgtcacttctgctgatccctgtgttgaaaatattaaaacttctgcacatgtgtcatatatgtaacctagtaccccaaaccttgctgtcacgctctgttaccataaaggatatgctcagaaataatataagcctgctatctaaattgcacctttttctgtcgaagtaacagtataatgtagttgttcagagtgggaactctgaaactggctaatttgcatcctggttctaacactagctagctgagcgataaatccattgtgtgcttcagacaatggtgtcaataagtctgttgtcagtctgaatgagtagatacatataaagtgcttagaaaagtgcatgacacatatttagggctcaaaagatctaaatattaatgtctctatagtttccttcttgatttaattaccacacaaatgaatctctctttaattttatcaacagcataggagacttctatatgcataatatgtcttttggtagcatgttaggcacattcttctctgtggtttaattgctgaaaacataaagatgctacatactaagtggagtaaattttaattgagaaaaggaagataatctcaaaacatttttagaaaacaaacaacccattttatatcattgctgtgaaaaaataattactggcaaaactctctaattcctggccttctcatgatcaaaaaaaacagcagcctcttttggacaagctgaggctgggaatgtaaagaattaagaagtggacaataaatgttttcaacgtatttatctagagaaccatctagagaagtgcctgctttgccagcaaatatgaaaatctgagatttcattgtggcctccccaactgctcccctagcagaggttacaagatttagtggatgatggtgggggaggatgacaaggggggaggttacacagtttcatcctcacaggaaagggactacttggactcacattatttctctaactttctgtatccatagaaatgtctcatctttgtttcataggattcagaaagttaacataaacttactggaatatgaaaatatgaaatatttattgaaaatgcaaatgtgatacttacacatagtagcagccctaaaggcacctgaaagctaatgtatctttattcaaggggaaggctttacttcagagctttatttgagcttaacactccacctgagtgatatttaaataaaagcaaaatagaaaatgcctcttaggaaagaatgccctaatttcagcattgctcttatattaatttagaggtctcattttaacattgcccacaggataaagtctaaatttctcagctgcacaagctgacctcaatcttttctgcatcttcttttaccccatctctacagtggccctacctccatcacttcttttcaggagttagtgcatctgaaaggcaaactcattcctctatatctttactcctacaacagtttgttcagttttatttctgttgaaattttgcatatccttcaaaagtcagttctcttgaatgattttctctgattccccagatctggaattagagcttcttcctttgccctctcagtccctttttgttcatttattgccctgagttagttctgcccactgtttttgctaattgcatcctttttatcattataaacagttagctctttggggaaagagtacaatatttcttagtcacatgtgtttggcatatatacagtaccacatatagaccagaaactaaatacctatgaaatgaatgaaacacaaagaccaaaaaacatttccagaactagaacatactttcccttgaaacccctgcatgtaacatctttatctcacagcgatttgtactgccacccttgtgtctttgtatatctctatgacagtctaattatgacatttcttgctcaataggagcatttagtgctccaagttgaccctaggacaataatttgacctgaataagataaaattcaatctttattcaatgtccttcaagatctgacttatgccaccagcaaatctcatgtcactcctctcctctcactctgtaacacccatatggaatttctgtcccagaaatggtttttctatgtggaatgcctttttttttcccttttcctcctcttcatcttccattggctaactactcatgcaccagattctagataagatgctactcattttggaaattatccctagctccccacaccatctctagccctagattagataaagtctttctccttagtgatctaatagctaacagttagatatgagaaagacttgggtcaaggtctgaagttattgttaccaactagtaactttagacatttgcaaactttagcttattaaatcatagatcactgggcctcatcctcagagtttctgaatcagtggttctgggatgaatctcaagaatttgcttttccaacagctttctgggtgacactgatgatgctgttctgaggagcacagagataactgatgcttttgataatttattcatctacttctgttacccctgtaaactttagtttcagcacctgcaaagtgaggctaaaaggagtgtttaaaaattagctgagataatgtatgtgaaggggttgacatgaattagggctcaatgacagttaatattgttcttgtattatcattgctttcataacactgtgttgaattccagactgaacagatcatgccaagtaagctgagaacccccaaaagagcaaagatcacattggtttcattattattgtgtcacaggtatgttatgaagtgcattggtagtcactaaataaacacataattgagtgaattcaaatacaagcattcaataagtatttagtgaaacaaattcaacgcttcttgtaggcagcccctacctagaatgttccaggtttcttagtttagctcactttattcttggtattcttgggactgttttgttgattacttcctaaattactttttggttatggtgagtcagtccccaagctttcctttctaagaagattatacaagcaacagaaagaacttcttcctgtaaagaactagaaatgaataaccacgtgggctattcatttgtctgtgtagtttcagtttcatactgaatgaaagcagttgcaccaaagtattcccctgccttctgtgcttgaacgtatgcctttacttaacagtggatatgggttagaaattaacatgtgaagaatttaattttcatttctttgcgaatttatgaagactcctgtttggaaaaggcttccctatttttactgtcagtctatacccctgtccttctctttgacctcagaacctcgatttggtattcatatatcattagttcagcaagtatttttttcaccacctgccatgtggcaagcactatttttatggtggtgatgccacactaaatcaaaacccctgcttcacagaacctaaagcatagcatttatcaatttgcactgtaattgtttgcttctctgtctcctcccctgctaagtttcagcttcctgatggtagatgcagtatctaatcaaactttgagtctccccctcaatgtgtagtatatggtagacagtcatacatacggataattattgtttacatacagagacccttcttcttatattggtgtgagaaatggaactgagcaccagagatcatattacgcttgtccttgaaacagtttggcactagctgtgtattctttgacttccaaagtgttagtttgaattttaattaggatcagccagtaaaatgtgggagattttacataagaatccagattcccagcttctcttgtaaaagcccacattcctgtatcacacaatgagctgaagctgtggctggtccacctgtttcttgagatggggcatgccttctccatttcactacaacccctaccatgccctatcattttgcacgtgtcgaggaggagcaagggggtgatgtgtggtgaggggagaatgaagtgcttccgattctacataaattcactgaaagtgtgtgttcataagcttatagcaacctaactcccaacattggaaataataacttactttttttccttcagtgatgtggaatgctaacaagcatttgtttacatttgaactatatatcatattgagtcaacaatcaattttgtctgttgtttttctgcattttcacagtaggtttcctgtatttctcaaattaaataattgccagctacattctactgtgatgtgtatcctagtccaaagtaaaaatatatctaaatctatctggtttaggattttttttcctccttttatgattattgaactaactctttttatttgtcttggttttgtcgtttgagactagaatacttaaaaacataaaattgaattaaaattatagtttatccaactaaatatattcatgctttgtttcagttatccttaaaaagaagaggaagcaaagatttgccaaaatctgaaaaaaaggctcaacagactcccacagaggtatgtggaaataaaatttcaactagtacaccaagtacctctaagtgtatataatcacaaactacatttataaatagatataatggccagataaacttatgcaaaacaaagtcaaatttgcatatcaattatgtagctgtagatacaggtagtataaatcagaatatttacttataaagccaaccataacatccctattataattgctttacattgtaagcacacagaaaaatgtcattcgtattttatacgctgctatatttgagaactatactcatgatgctaatcttgtccttttataattaataaggtcaatagaaaggctgttcctatagtgtcaggagaaagtaaagaaaggaatgttgcagagggaagtcagaaaggagagaaaggctcattatatctttagagagccctggaatgaagtaattctccataccagtgattggagaagcaaaagaaaggagacaaaagaataaaaatgaaagttgaaagatgtactcaacatgggtttgttaaaaaccttagaagcacagccacagtaaagactagctttgctttcaaggtaaaaagaggtgccaatggttgtaatgaagaagattttaaaatggaagaggaaacatttgggataaaaatgacactattgttaaggaaggggatcccaatccagaccccaagagagggttctcggatctcgtgcaagaaaaaattcagggcgagcccatagagtaaagtgaaagcaagtttattaggaaagtaaaggaataaaagaatggctactccataagcagagcagccctgagggctgctggttacccattttatggttatttcttgatatgctaaacaaggggtggattattcatgcctcccctttttagaccatatagagtaacttcctgatgttgtcatggcatttgtaaactgtcatggcactggtgggattgtagcagtgaagacgaccagaggtcattcccggttttggtgagttttagctggcttttttactggaatgcgtttcatcagcaaggtctttatgacctgtatcttgtgccaacctcttatctcatcctgtgactcagaatccttaaccatctgggaatgcagcccagtgggtttcagcctcattttacccagctcctattcaagatgtagttgttctgggtcacacgcctctgacattataactctccaaaagcacttggctagatattaacctttaaactatgtcagttggaatctatggtactgtagtatacttttgtgattacaaggtttttttcacattagatagataatttaactaaagtgattttaaatattcaaaatttgaaaaagttgatctcagacattttttaaagcataacatattaactatatattattttcctttttcctctctgtacctgctctgttcctgctctgttttctcctggtacttgcaccagaacatgtatggacctcagcatttttagaatcccagagagtctcacagccaagaccatgatatcattttttgtacctttctctctgttcccttagtaagtccaaatatactctgtcactacagcttttccactctgtctttgctgtcactttatccaactcactctaaatattttgttgtgaatcatttcacgtgttgccatgaatcttctttcctaccttgtttatggagtagacgctgtatctacatttgtcctattcttacacttcctgtgttaaaagtttatttattcttttcaaccatagtctctgatgcaggaattcttaactgtttagtcttggctttatggacctccactcactatgcatgtgggcaactttctgcaaaaacatccacaactttaatcagtttctcagtgaggtcagggaccttaaaaaagtcaagatgctatgcaatctaccagcttttatttcatggacaaaaacttccttttttataagtatactgtagcatttgaagtttctgctatcatttccaacacatttattttcagaggttatgacctgtcacttttaaaaaacccacctcaggagactgatcaggctatctctgatgggatatctcaattataaaatggtcaatttttacaaaattataacacgattccaatgctcagtcaaggttgcaaaccatcgatccacatatttgtattactgaaaatataccattctattgtaattcttgtttatgcattcatctctcctacttagccagggcatttttgtggacaggagccatcttattcagctttgaatcatctgtgtctagtgattggcactctgcacatgttcaatacatgcttttaaatactcccatgtctcctttttctatgcgaaatcacacaaaattgccaacatgctattgaatttgatctacagaagtggcaatttcatatggtccaactctctattattcatttagctttgtatttcattttgttaatttgcttcagcttctttgatctctttctcacatgttcctccagcagcacagtgactttatttacagagaaatgatactgcacagcaattaagaactgtagctctagggccaggctgcctaggttgaaatctctggcatataccagctgtatgaacttgggcccattacttattctttttagtgcctctatttcttcatatataaaatgggaatcataatagagagttgttgtacaaactaaatgagttaatatatgtaatcgattagaatgcaatttagtttctagtagtggctcttaaagtgaaagccaggagtagctcatttcttactggccttcatcatcatcatatctttatgttcccctcttcacatgtaatttgtatcttcaattgagtgagtctttaacatacacaaaaataagaaataacttgcttcacacctcagagcattttaatttttcttgcctacctttcactgtggaaaataggagaaagtatttactgctcaattactgtggaccaggcactttgcatacaatctcctttttttatcaataattatgtatgatatttctatgccaagtttccaatgcagcctacaatagttgggttacaagatcaggatgcaaggcatattggcatacagggtggtaaactcttggcattgcagaaactagcacattttgtatcttgaaaatatttatttttaaataaataaaataattaccatgaccattagcccttgatgcagctctttccctcctaatgactctattatattcagtctatgtccaagtgttaaaataattgttgttttcattcctttgggcaggagcgcttacatacacacaaatcagatattctcttttttatttgcttaatataacccagtgaagtgttattctgcttcagtgtgtgccttgtatcacacccactgctgttttggttagattcaatttgcagtatatgccaactatactagcaaataaaggccttgccttgcaatcaaggacttccaccacatatgcaaccctacctggcttcccagtctcatctactcttgcatgtcaaataaaacctagcctatgtaaaagcatatttgacatttatttgtgctgataaaatgcgttccagtaaaaaagccagctaaaactcaccaaaaccaagatggcaacgagagtgacctctggtcgtcttcactgctacaatcccaccagtgccatgacagcttacaaatgccatgacaacatcaggaagttaccctacatggtctaaaatggggaggcatgaataatccaccccttgtttagcatatcatttttggtcatgtttctgttcaaacattgtttctaattattggcctacatgaccttagatttcccctcccaaacctttgactatttcttacctgtctccccctttctcttttttttttttttttttttttttagatggagtctctctctgtcacccaggctggagtgcagtggcgcaatctcggcttactgcaacctctgcctccggggttcaagcaattctcctccctcagcctcccgagcagctgggactacaggcgcatgccaccatgcccagctaatttttgtatttttaatagagatggggtttcaccctattagccaggctggtttcgagctcctgaccttgtgatccacccacctcagcctcccaaagtgctaggattacaggcatgagtgaccgcgcctggccatatgtctccctttcttttcttctcctcattggttgtgtctgtgaccattatgataggttcaaccatcacctctacacatctcatccacacgtcctcacttctagacctgagctctaagtgccaagctgtaatcttagtaatctaatcatgagcctgagattctacatgactgttgatggatgtttccaccctgtatccctccactggaacacctcacagacagcattcttaaaaccttaaacccacattcttcacccaaaaccatttccatttctccttttgtacttttcaatttagttaatgactgggctttgaggttgtcatgagaatgtcgtgagaatgtttgagaagaacttctgtaagtttcattccactgtcctttcagcaggcagaaccaactttatccattttagattgatgggagtacatcctattttgaaagcgatctaaatggaatgctcctctttattcattctctatccttgctattggccatacaatccaatgagacccctcaactcaaaaattcagggtcatctttgattcctctgctgatgtgatccaaaacattgtaacatgtccttggtctcatcctcaaaaaatcttccatcaaagctttccatgacatgccctcttctcctctctggatgctgctaaggctctctcatctcttctggtagtccttctcttctttcttctaaacctctcctagaggaaagtgtacaaggcaacacatcttacttctttgattttaccacattgctctatttttttttcttttatgcttcttttctagaggcagcatgtgcagtggaaggaatatgagtttgggactcagccagaatatagactgtgctctgtcacttattaacttgtgcactgcaatgttaataaatctcccctatcggtaaaggggagatagcatcacctatcttgaaggactgatataagtatttaatactatatggaatgtaatgttcaggctctgcacacccagcagctctcaaacccttcatattcttcatattcccattagtagataggaagacagaagacctgtgccctgttctccatctcttccatctcaaaggctctgtgtggtatttactgagcatctctggcagaagctcattattctcctcaccttctcaccagtggttgctccttctttaccagaatgcatctcaaacacagatgaccgagtactggataaggaaagaatttttatttttgtttttttaatgaagaaaccaaagttcacagaagttatatgattggctcaaagtacacacttaaaagagaattttgagaaattgtccttgggagaaatgaccttagacataataacatgcttcagtaatatccctcagagaaagatttccattcctccttttgtacttttcaatttagttaatgattgggctctgaggttgtcgtaagaatgtgtgagaagaacttctatagttccactattcttttgccaggctttatccatttcagactgatgggagtacaacctattttaaatgtgatctagatggaaaacttaacagtttctccttggatggaccattccaatgtcaaactttgctgacttacaggcctctaaaacaattttcctttgaataaaaacagggggcagattatttcctaagtgacacagaaatcaagagcctgagcatttgtttcagacagaactggattcaaatttcacctttgtcctttgctattcattagctgtgtaaccttcgaacggttactgaacatctttaaaccaggaactgtaataactactcctaagtttactctgaatattaaattaggttcatatttgtaaaacacttttcagcacttggctcagtgtaagtgacaaaaaagtggccgcaaatgcatatgaaccacatgctcgttgaacagattttatatttattactgcaataatgaaacaaaagaaacactgctgaaatgatcaccaaacagttgtatgcagttacaacatataataatctctgaatagtgatgccacagttattctcttttcatattccttttcctttttgcttccaggatgtaacattgttctaatctttaatttgccagagaatttaagtgatctgaagaaaatacacagtatctgcttctgtttctctctgtcattaaatctggattgcaagaaaaattatttatccaggtgtcctcttttggttgtttccttgatttacataaaaatgatctcctatccttttccctcttttcccccaaatgaggaggacaatgaagatctgaagtgccagctgcagtttgttaaggaagaagccgctttgatgagaaagaaaatggccaagattgataaagaaaaggacagatttgaacacgagctccagaagtacagatccttttatggggatctggacagtcctttgcccaaaggagaagccggaggccctcccagcactagggaggccgagctcaagctacggctaaggctggtggaggaagaagccaacatcctgggcaggaaaatcgtcgaactggaggtggagaacagaggcctgaaggcggaactggacgaccttaggggcgatgacttcaacggctcggccaacccgctcatgagggagcagagcgaatccctgtcggagctgcggcagcacctgcagctggtggaagacgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcaggtacagttctgcctattgcgagccacggcggtggccaggctggcccgtggagccgcgtccctggggggcgtctcggcgcccggactgccgcgccccgcttgagggaagcccccgctcagggccgcgctggggcctgaaacccccggcctcggcccaccagttcttccacactgtccttctgcagggctgaggtttttgtgactccatcacatagtcaccatttcttcctctgttttgtttaaaaggaaaactgaacaccattaccctcaattgttgtggaaagagtaacggattttgaggcacgttattattttagaaggtcaatatttttctctgttactctgctagcagatgaactgcaagatggtcctggataggaatatttaactgctgatatgtggtttttgagccaagatccatattgagtttaggatttaaaaaaaatgactagactaggaggccgaggagggtggattgcttgagctcaggagttcgagtccagcctggtcagcaaggcaagatccgtctctccaaaacatatgaaaaattagctgggtgtggtggcacgcacctgtaatccaagctactccggaggctgatgtgggaggatcacctgagcccaggcaggtcgaggctgcagtgaatggtgattgcactactgcactccagcctgggcaagagtgaaaccctgtctcaaaaaaaagaaagaataaaactaaaacagaattgatggcagggcactgtggctcatgcctgtaatcccagaggccaaagagggcaggaggtcaggagttcgagatcagcctggccaacatggcgaaacccgtgtatactaaaaatacaaaaattagcctggtgtggtggcgcactcctgtaatcccagccactccggaggctgaagcaggagaatcacttgaacccggggagagggaggttgcagtgagccaagattacaccactgccctccagcctaggcgacagagtgagactctgtctcaataaaaaaaattaatttaattaaataaaacagaactgatggataactactggtaaatgtagaaaccagtggtaaagagacatggttttgtgtctacaaccccctggaaaggaacaaatgaaagccacttttttttttttaccataagttgaaataacatgatcattatttccagagaaaatcactctcagttgtatagtggagaatctcaggactggggaaggagtctatacggtagcttgaaggcaacactaattcagagaaatagtaataactattccagaacagggaaaaccagcatttttcctccatcctgatttgtagaggcacaccggatgaattggactgagctgctttggccaggtatggtggccatttaaagaccaatgcattttgtcagagttaaccacatgaaagataatttatgaaacaaaacaggcaatgctgtttcctctggcaagcctggtgtcctgtatccattggagaacccacggaagtacaacagcatgcatggcttttaagacacggaagacatttaaaagccagtttacgtacagaagcatggttttagattaactgcctgttggtacagctagaaacattgcagccctatcgcttatttatcttgcatgttgctctgctttgctatgaaaaatatcgttttatgataaaacttgttgaattttgatatgtattcggttatactcttagggaaaataatagaaattagagtgagagaaagtgctatgtatattaggctttcagattttatagatataggcttaagggagggtggaggttcttttttaagttgaatgactacttaaatttgttgatgtgaatttaagttttaaagattattattaattaactcttctctttgtctttgcatttaccttcccagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggtaagaaagtgtgacatttttctgtatgaattgttttaatttttacttctttttttcatcctgtttgtctcctcttgataaataattggcatactgaatataaaaatggactacatgtctcataattatttctcagtagttcactattattattcaaaagctggacggacattcacaatttggtcacatttccaaaaagtatatacatttgtaaagtatctttgccaggttgcatcaaactaacaagataattttgacatccaataaatatctgaaaaaaaatatgggaaataaatgaaatgtgaccctcatgaaaactaagtaatatgtcgtaatgccaatgtgttttgtctacagagatatgcttggaagcatgagattggattaggtcttagttcatttaggaaataattatccctatcctactctatttgaccagattcccaccaaacctgccactcctgcttttacttattatacttgaagtcgtgtattgctaatcgaacttattgcttagagtcctatcctctataatagattgcctccagagtaggaaatactctataaatatgatatgtgaattgttttgaatagggaaaaaatacagtcattctctagaatttcattaaagtatggtcattttctagaatttcattagatcacaatccaagactggtagcatagttcaggcaggaggtgctctcgagatataaactaacttcaataaacctgagcatccccctttctcctcaaacctaaagtggcctggatagactccatctacccaaaggacccattctgtccatctcattgatagtttatccagtgccacccaagagtcagcaatctccgcacttgttgaagtcacatacttgtaaatattcacaggttggttgacggatatgaaaatctgtggaaagtgaagtatcttgcatgtctgcaaaaaggatatgtggaaaaactttgttataaaagttgctattggtaatggtccttggaatcccaggaatttaactttcaagggactataatttatttatagtctcatcctcccacacatccgtttgagtattaattaaacaaacaaacaaaccttcacaatagtctaaaactttagtttagaataactgctcttactctctataggatttgtttggttttggtttttggttctgtttgttttttgacggggaggagagacttggagtgaggagtggttacccaacagttggaatctgtcaatatgcacttctggcttttcattttagagattctgagagctaggtaaagcttcattacaaaaatgaatgaaatgagataaatgccatgtttaatcaattatatataattcaggtgtttgctttttaaaattttttcatctcagagataacaaacactttaaaacctaaagtttgtctgttagatccgtgataagtttccaggccaccatttcaggaactgaaagtaaatgtttgagggcagaaatgtagctgaaatatttatcatctttggagccagttatacctgttaaaaggttctcagccacctacagagcatttggaagtgtgtggagtgttgcaggttattacaatgactgggaagttcactggcatttaggaggaagggatcagaacttcaaggtccctgaaatcccacatcacaaataattggcttgtccaaattgctgatgttgtctttgtggagaaacgtgatatggtatgcacttattcacttcagaagcatcatgcatattcaccaccctgtgtgactttaagaaactggctttacattttagctttctttatcatgagaggaatcaaaaatgaaataactagatcagtagttatcaacactagctgcacatcagaatttctgggatgtttttatttggggacctactccatactaattgaaataaaatgtacggacctaggcatttgtatttttaaaaatgccccagaaccactactcttagatatttgaattatctaaaatacacattctatatagcctcaacaaagcttacagtaaactatgtgataccaagatataggatcattagttgtctaggtttgagtagactttaaagtttcagctgctcagtggatgtctgaattctctctacagcatttccacttagttgtacagcctttgccagaagggatatcacctccagtgataaagcaattatatttctgcgctggtggtcgtgccagaaaacttggcttgcattaatacaagttttcaaaaacacaaaatcaaaggtaaataggagtaatacctaacagaaaagagaaccaagatgaatagtgtgtgggcacagggtcacacacccactgaaagaaacaggcatgtgtgcacactgaattcaagactcaagatgatcccacagtgatctaacatgttattacaacaaaatccctaggcattcttagatgggctgacagcctaaatatatgcaaagatggtgcaaacacctcagtgataacttatgacctgaataggaaaggagagatgtctgagctaaccaaaacaccagcctcaactatagatctcattttaggaactatggtcatgttccctatgttgcccttctggcaacaggggtattaatcttacctatgaactcctaaagcagtgataaggtttgactctgtgtcccactcaaatctcatcttgaattgtaatcctcacaggttgagggagggacctgtaatccccacatgtagagggaggcaggtgattggatcatgggggtggtttcccccatgctgttctcatgatagcaagtgagtcctcacgagatctaatggttttataaatgtttggaagttcctccttcactcctctccactgctgccttgtgaaaaaggtgcctgcttccccttccaccatgattgtaagattcctgaggcctccctaaccatacagaactgtgagtcaaagctctttcctttattaattgcccagtctcagggaagctctttatagcagtgtgaaagtggactaatacaggcagttattttatagaatttcatgagacttaaacctcatccagatcctccatatgtgaaactcctgtgaaatactggggagaggaaagtaggctgaagcagtactgacttgactgctgctcacagattctgggggatatgggatcattccaacagctcctctgaagttagtgaatcaactttactgaacagttgaattccagggaggctcttttccactctgccccactcactgcataaaccagcttcccggttgtgcctgtgtgtacacacacagctccatcacactgtggtgtataatgagaaatgcatccagggtcagggcattcagaactgcctctatcttaggggacatgctggggaccagttggtggaaggtggggtcagaaaattgccagcaggcacaaagtgacctttttccttgccatcttttccctataacttcaagctgttcaatgggcgcccagtatccagggtgcacctatctcttaaagcgtagaacatagacttgggaagataagttgacaaagatggtgcccaaaacctcagaaagagagtccccagcatcttcccctttgatcctgttgcttgcattatttttgttatattaagctgtttctgaaagaggaacaaccaggcttcttgattcaccaagagagcaaagactcttaattattaagacaaggcgtcatcttttgtttggacctttgaagctgtgctatttaaacatcacaccaaagtaaactcaacagagcaagccttattctagaaaattcccttgtatgcacattcttggccataggaagaagtgtcttcttgttaatttggcctagatctaagaaaaaaggaattcagttggctatttttaggcataagtaactaaactcataaaacaaaggaaaattcagtcctgagcctggaatgtgttttggcctgcattctccaatcttcactttagtttgtgtgatagaatgggatatggttatttaatcagctgccaacgaagtttggagtgtcaatttggtagctcagccctaattccaaatattcgtgcagagtttgtaactgcattctgatagaactacagtccagttcatctagtagagtcatgctttgggtcagacaccataactgaatgtagaaattgaagagaaggtagtggagaatattaccagaaagtaagaaaagtcgaccatttattaaactactgggatatggtacagttaaaacacagtatgcatgaagacataactgcttaaatcctagttgtaaaccaattaggtctaatgaaagatttcattctacgtttttaattttgatctggtttttgataagtaaagtaatttcattcatattttgatgaaactcacatttcatgggtaggtcctgatattctcagcagtctacttctagaatttcagatagaaactcatacaaaatagaatgtttcatggcctggacatggcagaacacctttgtagttacagtaataaatgtggtaatatcttaaatgtggtaatgcttctaaactgtactttcgagttgatcagttgagagaagggaaagtggtagtggctgtttttcatgtttgccattttgaaaatgtgtgcaaatcatagaatctctaaaggtcctttccatgtaacttaaatacattttcatccatgtcttccctgcttaaaggtgtattttctgcacttactggcagttctagtctgtgtctgtcctagtgaagttgtgggtaatattttaaatatttctgggggcatcttttgagtagagtactgttataacccacttgatcaaagaacaagagcagcaaatataacactttttagatgtaaagagaaacctcagaaatctctaccttgcactgctcactgttaagccaggctgtgttgtctttttttttttttttttgagacggagtctcgctctgtcgcccaggctggagtgcagtggtgcgaactcggctcactgcaagctccgcctcccaggttcacgccattctcctgccttaggctcctgagtagctgggactacaggcgcccgccaccacgcccacctaattttttgtatttttagtagagacagggtttcaccatgttagccagggtggtctcgatctcccgacttcatgatctgccgacctcggcctcccaaagtgcagggattacagttgtgagccaccgcgcccggcccaggctgttgtcttaaagagccccatctgatcttatatcccagatatttatgattaataaacttaagtctattgacatttcctgattattcaatttcagtgttaccattataaaacttttttagttcagagttgtatgtatttttctgtagctatttttcaaaataagataccaacaaaactcaacatctgaagataaaattgcaaacatttagtttaagatgagaatacataatcagtggttgttagcagttattcagcctttacaaaaatgttaataaaattttattgacttgcatatttgaatgtttttctcaatgtttttgaatccaaattcctatttagcatatattaaactcagataataaaaatttgcgtttgttttgatgatttttatttaaattatcagcaaagttttagatatattttaaaaatgattttaaatgattattttttactaaataaacattaaataaacagtaacagtgtagagcattacactaatttaaaaactagaacttttcagaaaagtttagaacatcaactcacttaagaaaatggcaaaccaccctgaggtattcaggagtggtgcagtatcttgactatttgaagtgttacaatgtcatgcgtactccagatatggagctgtggaaattactgactctgaaaaagtgtgctttatgcgtttattttctgtagtctcttctgaatgttttgagttgagctgcttatgttaacaagcatatgcataagtgattattgaaggctgggaaacggcatcacttctttttgaggttgtccaacatgatgtacctttaaagttagctctttaagtttatgtcaaaagtacctgccttaacctgtgcattcaaatattaagagagtatgaggggcagagagcagctcatcagtttacttacttgcctcaagtgatttagtaagggaagataatttaagagcttttttaaagaaatgacttatatactcttatttcttaaagtcagaacactcagtttagtttgtagtttataactcccttccatctttcttataaacagttttttcacattctgtgttactccttttgcatcactgactccgggacagacaaaatagagttagacttcttaaatagaacatcctgtgtattggcctagatcagtcatttataactgggtttcagcatgacaagttactgaaattaatttttttctggacattaggtgactcctgggaatccaagcaggaaaggaaatgtgtatctgctgagcctttgcccgaaaggaaatgtgtacctgctgaggctgtcggcccactgcatagagggccttagcgtttgtaaataagcttagattacatctagtggaaaaagccgtagtgaagctagttgaggtagtcaaggaaaatgaggactccctggccttggacctcatcttgatatgaaaaaaactgtccaagaggggaaactgaagtctctattcagcctccgtacttcagagggaatgtaattgattcagatgcagctatttgtttgaagatacctgatatttgtagaaagtgactggattcaaaatagtagtgtggattaaaaagagttggataaagaaagagtgaggttggctgggcacggtggctcacgtctgtaatcccagcactttgagacgccgagttgagtggatcacctgaggtcaggagttcgagaccagcctggccaacatggcaaaaccccgtctctactaaaaatacagaaatcagctgggcctggtggcgggtgcctgtaatcccagctatttgggaggctgaagcaagagaattgcttgaacccgggaggcagaggttgcagtgagctgagatcgtgacatcgcactccagcctgggtgacaagagtgaaactctgtctcaaaaaaaaaaaaaaagaataaggttgcagaaatcttattttgcaatatatattgatagcgtcaacaacatcagaatacagtggaagggtcagacacagctgcttttgaggatgtactaaatacctactgtttccttcctgcacttgaaatagcttttgccctacatgataccaccattttgtaactctctcttcctaaccccttttcctttatgaatttttgagatgttcatgggcaaattacccatcaaggtattgtgcttataggctaatatggacttactgagggaccttggccatggaaaatgggtctgcatggttctgcagaagaccctgaaaatgggtctggctgattctgcagagtgggcctaggagctacactgaagtgtgactttaggcctcccgttctgtaactttacctccagatcctttactgtatccctctcatatcatgatgccatattccttttgacctgaactccaggggctcaaaatctaacacccacctatgcagttccccattcagatcttccacctgtttccccactccatgccctgtgaatgaaacagatggctttcctgacctctaatcaaagcctacccatattgatctgttccttctagtccttagtatgtgctacctcttcttttctgtgccgaagtggtgagtagccaatagttatttcctctaccagtggtattttactaggcaattattggaaatagaatgctgccacccggtagtgataaatctaacatttctcgtagaagatataggtggattagttactccctggggcaatatggattagttcctgtgtccttcaaattgcactcaccaagcctgagccatgctttactgctgaaacatcctagcagagagaagtaagtggctcagggtggccctcttgtggtggacaagcattcccaggactctgctggtcactaaagaaaaggtagccctcaaacagtcctttttattatttttgattttattgtcatcattatcagtatcctccaagtcaagaatctgtaaataatacaatgagatgctaaaaacaagtttgaaaaatgtgagcaaggtctgtttctagttttaaaatagcccacatttctcaaatatgttactgtttggttcagaatttggaccactacctaaaaagaacagatcattcaaacgtgtcttttgaatatttctgtcatctggaaatgcctgcgcataagccccatgacggatgtgcttggctaaaaaacctgttgacgtgtcctcagccttcagaatagaagagacagccagtttcccatgattctaaggataaacatcccccactggaaaaatattacattagctggcaagtaataatccaaacatgtacatggatagtaaatattctgtgtgtgatcctcataattttatactccaaaacagtattttaggaggatcaaaattatatttattaacacacagttgaaattgccattctagaactcaaataacacaggaccaaatttgacagaatcagctgtggaactttatcaaaagtctgaagccaggacctcaccactggatggtctgagtcagaagtctggggagagttccagcattactatttttctttttcattctctgtgtgattatagtatgcagctaggactgagtgagagtaacactaaaccgtgatctccttggtggaatgctgtgggtactcctaggagagactctccaaatttgtgaatttataccagtgtagtgggctactcagaatgcaaacagtcacgctacatgtcacatttcagggaatcttcagagctgaccagacctgttgaagacaaggatttcttcctcttctttgagtcctcttggtctaacctggcacagaattggtattcacaaatatttgttaaatggaatgttaattgaagtacccaagaccttaggaattgaagataatttaagatttaagagttctgctaaacaactgagatctcatgatcttaaagtactttgaaaattgcaaggggcagacattattcaagaaggaaggatttcttaaaatacgtcctttatagtagcctttgaactttaacatgcagaagaatgagtttaggcggggcacagtgtttcaggcctataatctcagcactttgggaggcaaaggagggaggatcatttgagctcagaagttcaaaaccagcctgagcaacatagcaagaccttatctcaaaaaaaaaaaataaataaaattaaaaaattacctgggcatggtggcaagtgcctgtggtcccctactcaggagtctgaggctggaagactgcttgagccccagaggttgaggttgtagtgagccatgatcacaccactgcactccagcctgggtaacagaacaagaccatctcaaaaacaaaactaaactaaaacaaacaaaaaagaacaagtttagtttttttaaaagttgttctctttttcaatcttttctatcttctttccaatgaaaatagaaacacagtaccccttttattgttaaatatgtttaaagggtaaaagaataagcaatggaaaaacgttataaacaagaaatcagaagctctccagtctcataacaaccaggttgtcataccataaagagaacaaatgagtaactgctttgtaacacttcaggatcattctgcaaacaaaaccatagattaaatatgtactggcactagcatgcttaaggccatgttgccatgtttatcttcagattttttaactgctaagataaaatccatttgcctttttattttgacccagtgtttacaattagctaaggacacgagcctctttagatagtaataaatactcagctggctgggcacagtggctcatgtctgtaatcccagcactttgggacgccgaggcgggtggatcacgagatcaggagttcaagaccagactggccaatatggtgacaccctgtctctactaaaaatacaaaaattagccgggcatggtggcatgcccctgtagttccagctactcaggaggctgaggcagaaggatcacttgaacctgggaggcggaggttgcagtgagctgagattgcgccactgcactccagcctgggtgacagagcaagactcccatctcaaaaataaataaataaatactcagctatatgattcttatgtcatacttgaaagatagagtatcttctctctcatttggacatagaagaaaactgaatttaaaatttgccaaagccagaaatcaacttctcagtctcctctcatatccagcattcttatttcgattttcttcccttgcacttcttggaattttgaacttcaaggcactccaccaggaatgaggagacctggattctattcttggaatggccactaagtggctttgtgaccttgagcagatgagttactctcagggcctcttccctcaactgtaaaatgagaaggttagctagatgatttcagaagttctttctggctctaaaattctgtaagtctggaaacacctgctagtgacatttatgcacgcattagttctcttttaccctttttaaaatgtttttgattgtgccttaatattattattaatatagatcttttccatttctttttagaattttcttttttgtttcttgacagcaggcagtgtttctacatttattttccattaagtgttattatgtacatttctttacatatctgttatacattgaaataagattagtatgtcataaggtatgaatgatgtaattctttctaaaacatagggcaatcatttgtgaatttcatatttgaagatttaaatgttcaaatggtttaaagaaaaactgcattacaaaacaaattgcatttttttcataagattttcagtcattctgacacctgcttgaaaacctcaggcagttcaagatgtctgaatgtaactgtagggctgagtataccagcatcagtcttttaaatgcattcattttatgtatataattgtggtaaattttcttttaaaagttttcttaaaaaacaaaaagttttcaagggaaaatatcaaaagctgtgctgaacatttcttgactttgcaccgtatcacctaattgacttactttctgtcttttgggtatgaaatatggcctggaaattatatattttatataaataacatataatataaattatatatatataaacttcaacagaaaaagttggtaaatactagaataagtggtaaacttggagtaaactttttgtcaaagattttcattattatttgattctgtgtacaatttaagatcagctttaccatgacaagaagcagatgaagcacttgaatctgatatacattgaaataaattagtatgtcatcaggtatgaatgacataattctttctaaaacatagggcaattatttgtgattgccctgggacaatcacactgggacagccattaaaagagattgaaatgggtactactgagtgacacttaggaagtatagtccaacctaacatctcttgtaacttagacacatactatctgaattttcgataggatttacaaaatagtcttagtttgatttacaagtgatacatagaagttaagaagtttggagtagaagaaaaggtaaaggaaacaatgttttttgttttgtttctctgagacagagtcttgctctgtcaaccaggctggagtgcaggaatgccatctctgcttactacaacctctgcctcccgggttcaagcaattctcctgcctcagcctccctagtagctgggattacaggcctgagccaccacagccggctaatttttttatttttagtagacacagggtttcaccatgttggccaggcttgtctcgaactcctgaccccatgtgatccacctgcctccgcctccagaagtgctgggattacaggtgtgagcaaccacacccggccagaaacaatgttaagacaattctgtattgatgtttttgtgcaactccctcctccctttccctctctcaaagaatcttcttcctagcctcataagcatggaggcagacatgagctaccctttattgtgtgcttggcgctatatatattccctcatattcttatggcctcttaaagtaaatataattatgtctttaaggaagaatcagggtctgcaagatcacacagataagtggtggcagcagaattgaaacttagatctctatgacaaaattccatggtttgcaatcagacaaaacagttcaaacccgtttcctccacatgggtgcatttctatgaacttttgcatgatgctttaccacaatgagccttgcttgggttttatcagtaagatcagattatcagtatctagagacagaattgctctgagggtgaactcagataaaggtctgttcaaagtacttagcacagaaccttgcagagggttgcccctcagtgaataatcactattattactataactatcactgttattgttgttattgctgttgagattatgatgtcaggctttccagacacagagtatggtttcatttgattgtcctacatgtattaaagtcctactgtgagcaggttactattactaaactttagctcctcatgaaatgtttatctggaagcaggtgaaaataatgtgagtgaatatgtattactttaaagaccacaccagggaagctcttcagacttgaagataagaccttattgtttaaacttgtgtatttgctaagttaggcaaaaaattgctctagagacttttttgactaaattaaaccaaatatcatcagatgcatgtgtgtacaaagccacaataaacctgaaaatgtcgctggggaggcaagatctcctagcatttcagaacaggctgatttgatcatgatttagagagcttttccatacacttaggctgctttctcttcctatggctgcagcacactttagtggaaaataagcccataggtatctcatttttggggtgtgtgtgtgtgtgtgttttgtcctcccacaataagaaatctcatcctttcccatgggctctgattttctctaacgtaaagacatcgctactactgtagataaaagcaacacactgtcagaatcacagagagctaagaggttggactttatgttccatttctattttatttgaagatagaagtttgataactttcacagatcttttgagagtgcataatatatataattatgctacacatattgttctgccacatccagatgcaaacttctaaaggtgcagcagagtacatcctgccaccagctgagaaggagaaagaattatggaaggagggagataattcttgcctataaaaaaatgagtttactttcctaataaaataaatctaaaattggccattgtcattgtatgatgttaacaaccagctcttttggcaagtttgaaaatactgggctccattataaaagctaaaaatgtcctggacctggagttgtttacccagagcatgagctgctctaaagttacagagctctggttggaagaggtggcttgaaggccgcctccaagtaactgacgtcacagtagtctcagctgctgctgtgacactaagctgagcagctttttgacttgtaaaagtggtgaaggtttcaaagggacttgtcagtactgctctgtggaatggttggacttattttgcatccccttttcttgtaaagaatcgagattcaccgagctgagacttttctctttaagacagctagccatccactttcttccactgctaattgaccagtggtcgagcatccataggatttctccccagtgtgaaaggtatgtttctttccggcaagtttacaagcaagtgactaattatggcaggatacaaaggggctgctgttgagatgttttaaactatggatactgtttaagtggagtgtaatttcaacatctgtctctgctgttgtctgtgtctgggcttaaaaacagtgggcggggtgcataacagattgtactgactcctaggaaaaaggctgttcagctgctcagggtggatttcccaactgtggactgacagtaccatccgctctttgagactgtttttccaacactgcttctcagttgtttgaaaagcactttgcccatcattgattttcactaagtatatttattcaaatgtgattttttttattcatataaagacttttaacatttgcaaattaaaggtcacaatcctggagacttggtatttgaaaattgcggtgaaaaataaattttagttttatctaaggtggtggtggactcactgtagagttagtgtttctgtaatttgagctgaagtctatgccattcataattgaataatctacgtttaggagggaaacttaccactatgtcttttgttcacgatggttagttttagacatttgtttactcaaaccaaatgtttgcttttaaagtttgcattttataagtaaaatcagtgtgcatacagcttggatgttttctaatttgagtaaataactgtaaagaaaacaaggaagaagataattaaatgaaacggtaaagttgattcattcggaattgcatgtggtagtgtctctttgaccttgttggagcatgaggaatgtgctaaatcagcaatacacagcaatgaaaaaaatttcccttttactctaacaaaatcaaatcatggtggtctttggaaagattcaattgcaagtgaacaatagagaggaatgagatttattaattcattgaaataattcaagtgattataatagcctggagaaagggatagagaatttaggaggtaaatggtacattactctgataggttataagctggggaattcctaatccatcaaagttaagcagaagcaaaacatcttcaggccaaatgagtcttctaggaattgtgagattagcagtacctactgtgtgtggcatttctattggaatatgtaacctcttataaatgaaaaatctttaattatgtgaaaagtgatatgtttagcaaaaggaaataaggacagcaagaaacaagtactctaaacaataatctaaaaagagagaagtagcaatggagcagctgcccctaaggaacgctgtttagtttgtttggatgcagtccagttttcaatgggcgagttggaggttgaaagggtagtgacccaggtgtcctaagaatggagcacccctcagagaaagaattgctgccatgaccaaactgaggctaatttgggggtgaaaataatttcttgtgagacttgtgtgttactcttaaactttgcttactggtagggccggaaggctagcagaactatttgcctcccatcaccatacttatgcaacccactcacaactctttataattctggctttcagccctggaaaggggaagtaagttaaaagggattatgcaatgctggtttagagttggggtgtgtgactaagtaatgcagctcactctgtcctcttacatttgctctaataaatttttattctgaaatggaattctagaaggaagaacataaactggagagccaaagagatatggggtaggggatgcagatagcagaaatccttccttctctcccacatagatgccagtatctgtgggagaaaatgagtgacaactaggaacaaaaagaacttttatttttgccccagtagagagcacttaaattgagtttttgaatctgctgaaccactttaccccataacttctcattacgaaacattctatctctacaaagttgccccttcagtttgatattttttgtaatatttaagtcagatttataacaaaagcagttttacataagatttgttcacatttttattaacaataaaacttttttctttaaatatgtgacatgtatctttaaaatatttgaaaaaaggcaaaagaagatcatggagaatatgagagttcacacaattacacttgcttctatctcgttttaaaataaagaccaaaataatctgttttttttccagagaacaacatggagagggatagatggagaaagagaggagaaagggaaggagggaggaaagacaagaagaggaagggagggaacaaaggacagaaggaagaaaacaagaaccaagtatttttcaggcatttgctatgatccagagcagtgtttaggcacttcttttaagcatttttcccttttgctcacttaatctccaaaacaattctatgccccccccccaccactttatatttagaggtggaagcaatatgtttggctgcgttacatctaacattatatttacgacaagactgagatgctaagaaggccaaatccttccacaaaaaattggcacagatattgctctatagaaatgttcttgcaaaggcttgtttctgatccataactattacatttcttggcactagcaattgctctgggcctggaaaggaaaagctccatacattggtccttctccatattaagggatgagtttggctctttgcaaataggtgcaggattcggtctgcttcaggactgttacctgggtttagatatagtcttgttatcaagagcaagactgatctagggtattcctgaatgatcttccggtaggttaaaaagagaaaggcctggcatctttcaacagtagcatggaagcgattcaagaagagttaggaatagaaggaaaaattggagccatttgctacataattgtagaaaagactttatggtgatttctgaacatttccaatgtttaaagacagttgggataaaacatggatttatcatagctcctcttttccaggtagcttgaaattagtctgcatccttttttagtttctttggttaaatctgcatttatctcttattatctcaaaccacaccattcttcctaagaagttccagtggcaaatactttctagtcagcaaggtagtttcaccacacagttaattacgtatagttttaaagcagtctgctagtttcaagacaggcactgtctgcatttcctatgaagaattgttagacgaacctaaaagattactaggtattcaagatcaagatcaatggaaattagattagccaaaacaaacaaaaaccaaaactctgtatgttctttaccatctttattttatttgttcttcactgacatttattatggcaagtacttgtggttactggtttatatgtgggaaagatagcaaagaaaggggtgacagaggaggtggagaaatgaggtcagaaattgagcatggccaaatggataaaatgagatatgatagcacctttaatagccagatatgaaattatgtatttttcgtgactgaattaatcataatagtgctagtgccaaagacataggaaaaaattatcaaaatatctttagtaaatagtttgagagtaaagtaacaatatagatcccaaaattattagggtgttttgaaggtagaaccctgcatatatagctaacatttttcatttcttattctattctaattcattgatcgtgactcaaaaaatacagattcaaaactgtttactagtcagatatgtatgttcacaacagtctgacaaaaataaaattagtgttcgatatttagctgatatttaggatttgaaatatgcagttatcttctgtgaatacaaaattggcacttgctgcttgggtatgtggccttaattcggcagtgccagcacccacaaagctattgactgttgggatctttgtccgtaattagcattagctgccaccagtaagttatagcattttgataatggcttagtgactgaagagttagacatcttataggcataattatcttaaacagagattcaaacattttaaacatgcttttctaccccctaaaaaggcacatgacttatttaatacaaaattatttttaattgaagtcacaatgaaattttgtaaagcaaaaaatagaaaactttcttaaatttctcaaactactttgcattcagtatgccatttaatctttttaacagttctatgactatccccattttaatgcaaaaaactaaatcccagaaattttagacttataccagttacatagctggtattttaaattctgacttcaaaccttaagtacacgtccctgaaggctagaaagttaattatttcagtcactacttaatgtaatagaggattccctgaaaactgagcaaaatgttttcttcagttccctgtattcaatatcctaagcagtttatggtatatagcctattcaaaggaaaagagagcatggataaattttaacgtatatttcacaggatagttttgatgcttctagattttccttgatgaagtgacataatgaatatattttttataatttagattagtttctggatgatacatcagtcctaagttgactaccaactttggggtcttcataagtaacacagtaatgacatttggcacaggcttgatctctgaatatagaattaagactgcaaaccagctctgtttcaggaatttaagtcataagaatatataatcaggttgcatcagaacagaaagaataattttattgcagcagaatctgtcacagtgtgtagatgtgagcatacatttgaattgtatacttacactcttattcatgaaaaaatctatttttagagtaagtggttaaagggatgattacatctcacatgcgcatttaatcatcttgtccactataattttgctgtctggtctcagaaagggaaaaaaactttggacaatacttattactttattgactgtgttagtttcttcttcttaagtagactgttgtcatctcttttcttttgagtccaattttcctatagtttgtttatgtcaatggctcgacaaaatgataaaatatatttccagaaagcacatggatttggaactctctcttgttatgtttatattaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagaggtacactttaatttgttttggatatactgtaatgtttaagtgcaggatgaaaattctgtgggctgttttgtattggaaactgtttttgatttccttattcgacctaagaggtacatttctcagtgacatttactagaacaaaaatagcataatcttatccaatggtattgtaaggattattttatatcattgcatgaaaattaagcatttgaaatgtcactctataatgtttcaacttattattttctggctagagagcttttttatcaaaagtgaggtatgtattttgcatgaattttcaaataccaggtccaggagtaaaatgcaagaaagatatacttggtgggacatagattagcaaaattatagttgggcattagaacatagatctttcctaagaagatttatgagtaatgtctattaaaggaaattacatgttagataatgcagtataatcaaaaggagtatcatatatcaaacagaaaatggcagtagacatgagatttattctatcaaggtgtgcacatttagtggcatatttattggaaaaggagttatgaaaaatgacatatcacgactctgacacagtcattttgttcccgttaaccctccctcagtccgttgaccctgaaatatttccttcaagcatttgcattgatgtatattcaagcttttgcaccaattggaaataatttatgcttatcttgctttcttttggtaacatccttagtattgactttatatggttttatgcacattaccaaagttgttattttaagacttcttggccttttttgcaggcaaagtaagtgctttatgtgtttatagtacagtcatgtttcttattaacagccatgtaattgactgtgaataaaatatgaattggcatagtaggaagaaagctgaagaaaagtaactattaagcccttcctctaaaatagagctgagaaggcaggcatgtggtgtatgattagggattaaaggagaatatatacttcttgtccctctatagtttagaaaatgtgtcctgcttgctcctttaacccctctacccatactcggattggatcaacaaagagattccctggtcaaatcagaatccaaaactccagcgcaatcagaaactgacctgtagtcctaggtcattgccttccaaatgtttgggaagttcagttcataacagtctcagacaattctagcatccaagcaaaataactaagggatgcaggattagtctagccaattttttaaagccatgtagttaaaagaagctgctgtctgattaaatttattactgtccaataattattctgacaattctatagagttcatctatggtaaatattagctttatcaattagcaggcatgaaatatgctttaaacatcaaattatacctcatagagataacatccctttctgtatcagagagacaaacgggctgtcatatttttttatcttggagagtagctgtactgctgtttatgttttgctgcctgtgctatacagctccataactaaactaaaattaagaaatcaacacttggaaaaataatctcatgccacaagcataaaagattgtatttgtttaacatttatcacaaagttctgtatgttaaatcagatgtaaattattaagccatgtactagagaactgtagattcccaggtatgcacatatatcttcagtgactttaagtgataatatctaatgagaggatgcagtgttggctattaagatgctcgtagttccctgttcagccactatccacagtcattgcatttgctatggcaaaaccaagatgttcatacttggatcatttgaaatttgaaataatccagatagaaattctggatagaacttatagacgtctggggttttgttttgtttttttccacactgtagtctcctgcctgtatcctttggtagaataatcagataaccattgacaagggctgagtaccaagtaacatagtacctttgtacaaaatagttttccatcaataacattgttatttgttgattcatacctcacctaaatcaagaaaatttaagatggcataaaattaggtatgatataaaatatgcaaaaacaaaaatggaaagatgagctgaagacaggaggaaggatcatatatgaaatgtaccagtgagtctttctagtaactaacaaaaattatcaggtgcatataccttcaaattcaaatgataaggcaaacttatttcccaggaatagcacatttttcccggttttgcaactaaagcaattttgttttcactcatgacttcgcaaaaacaggacagtgtcaccaagagcatccttagatttaacatgtcactttttagggttccttcttatatccctcaaggtcagctcaaaccataatgcccgcagaagttcagtacaaataatttggcagggaccaaacaatcaattcatggctgcagtttgatgctatcctgacttcatacaataaatactaatacatttgtaagcattagaaaaataaatacactgtatatttttcaggcatcaactctagtgcttctctcaactgagttatcggtatgtattaagcagcaataaatctattatattacttgaataatacatgtagtgtagatattgattgcggctgttaaacatagagtcatttgctttgatagtcatctgacagtctcttttgaagtttgacaagcttttacatgacccaagcctaaagagaaagccatttctttcctctattcagaagtgaactgaatgagtgtgtgcaggttcaactaagatctcataaagaagtaatctggattctaccttaatacagactaatagatgatcaaagccttgcagttctattatatcacgtagggtattgtcatatttgttttaatctggatgagaaatattttaaaaatgtgtatcactttgagattttttaaaaatctcagtaatatctagccctcacaatgtaattgaccaaccaaaggaaacatcttttgactgacaagtgactgtttagggaacaagaataagttgacttactatctgagattgtcaagcatttagacagttaaatgttagtgtacaagtaggaccagacatttgaaaactatgactttaatgttaaattcttgcatctctctgaaagcaattatataatatggccagtaattgattcaggtcattctaattttgtgacagtgtttctgtatttatatacagatacagatttattttatttttgaatgattgattgctagtcaaaagaattagcatccatgtgttgccctactaaaagtagcctttatgtttcatcaaacttgttccagctaatccatattttagaggcactatttggaggccgaagcattaatacccaggaagtatattttaatatggcaaagagaactcaaagcggtttgcttagtatcaagaatattagcaaagtgaattaggggaaaagaagttttaattttgttttgtttttcttacagctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagtaagtaagatgtgattggcctagaactgtttctaaagaaatatttacatttcaaagtgctaacgggctgttgcttatatgtgtaaaggctcttgaagaacttgcgaaggtgagtgaagaattatgcagctttcaagaggaaattcgaaagcggtctaaccatagaaggtaggctggtacatctgattattttagatgggtaaataaaaaataatattgtttttagttaatgactccaaactgcctcctccttacatgtaagaactaatgagttattaaaatgtactatctagggtgggagatagaaactttaattttttgtttgctcgtttgtttttgagatgttatcttgctctgtctccaaggctggaaagcagtggcatgatcttggctcactgcagcctctgcctcccaggttcaagcgattctcctacctcagtctcccaagtagctgggactacaggcacacaccaccacgcccagctagtttttttgtatttttagtagagacgggatttcaccatgttggccagcatggtctcgaactcctgacctcaaataatccccctgcctcagcctcccaaagtgctgggattacaggcgtgagccaccacgccaggccagaaactgtaattgtatatttctctgttcactaattcttaaagcaaatcttccaattctctttgtaatctattagtaatactttactctttttcgtgtctaattaaggtagaccctccataaaaaatcagtaagtaacctctaaagtagttctttctcattctgagcatttggacaatgaaagtgtacaactgggctaattcagttaaacgtatcattaaacgatgtcagaattaacagtgtggcgttttgcttatataatcatgttctactaaaatatttaatgcttaagagcactttattttgcttcaattcgtgtttatgtaatggaggcctacatacttttcagaacaacatattgtaaatatgtacacatgtacgcgtgccacaaaaaatgctgtttccatttggaaacagtatatacttaataacagtaagttttagccaaattaacaaatatattggaattctctacaagtttagtaaagatggattattctaggatcaacatttatctctcctcgtgggtcagtaggcttcctacattcccttatttttcattagttgttaggaagctcagaaagaatttttgtgctgacttgcaatagattttcttagccaatcatgttttaaacataactttgtcctctatttgcctatttagcttttctattctctgttaataggtatttatccacattttattgtaagctatcccataatcttttataatttgaagaggtataaatatgatttatatttatcagtgtgattaagtttgaattgcgatatttagttttttatttaatataactcagaaaagacttacttgccaattttcttttacaaatcacacctaatataatgttcttattgtcaccccatggactttagaacaaggttcaagatatttgtaattcaaagacattacaatttgacataacctaatgtttctctctcatttttcattatcctccccactctgctttataattaatccatatcaaagtactcattttccttcgagtagccatagtatttaatccttttgccttttacttcaatcctatatgccttttactcaagtcatccaaaaaatttttactttttttcaagaccaaatgacactttccatttggaattactcatatctcattgcacttttattcagatttgtatctgactacttaaaatgttatttcaaattcaaggagaagaacttgagctcacattacataatgaataagaattcagcaggcagagagaaggtaagggaatggcaagataaaagctacagagagagaaatgccagtagcagaaacccaggagactacatagtttaatctgagggtaggtgaagtctcaggtaatagtgaaaatgagagacaagtttggaaagagtttgagtcagagtgtgtagagcattgaatataacactgagaggtagacttcattccaccataaaaggacttgaagtttttgactgggagatttatgtaaaaatgatgtatgaggcagttgtgaatccttttcttatagcagaaactcattgctttagctatgtttgcttttgagagcttattctaaataaagttataaccaatacaccatgttttatcattgtttaggatgaagtcagattcttttctccaggaaatgccaaatgtaactaatatacctcatggggaccccatgatcaacaatgaccagtgcattcttccaatcagtttagaaaaagaaaaacagaaaaacaggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggtgagaaagcaaatataacataatttggtagcatccatattagcaatggctctgaatcatgtttatatgtccaattcatataaatagaatgagggcacaagttttggactcttcttagcctcttgaccctgtttgtaaataaatataactcaacatgaaccttgaaggtgtagtttttaacactgagaatagtacattgtaacttttgaaaaattctgaaatgggataacataaatacagtaagtggatttaggaacctgaagaagatcaaatgtttgctctttcttgaaaaaatactcagaatggacattactcaatttatagaatttcattattttaaaggttcttttttaagtgtatggaaaatatttttaaaatcgttttcatttttcagttattaactatgattggttcagtcattctcagcatttgactcatgttctttctcataggattaatcacattaatatgaatatgggaaatacacatcatttaaaacagtgcctaatagagtccttttatctgtggaactaaaagatagtatatataaataaggttattcttatttgtatgtattcttagcatagaaattgaccaaaaaaaccccactcaaatggacattttaagtaaactgttatctttttttgttcctgtctatttatgaaagagtttaatcttcattagttataagagaaaaagaggtcaaagaaattggtatttacaaagaagagttatacaacactctcttttactcatataatttttaagaagctaacaaaaattacaaggtgacatattgttgttattaaccaatacttcagaactcctagtttcatagaatgcagtgagtacgcagcatggttttaaactattatgcaagttgcttccttctggtgtaaaaaactactatgtggatttcaaaccctgcaaaaatatcagttttcatccatcttatgagaaatcttgcctgtttttataaggtgcagaaagtatcctgcttttgtatttctctgctttttaattgagcccatcaatgcccacaaggtcctatagctaaagatgggaaatagatatatctgtacaataaccaaacaaaattcttgttaactaacaagaaataatactgagtgatttccctttttgcattcattgggagtttggcagggaggttctctactatagatcctcaggagcagtttttgtttttgttttttgttcttcctcctgtgggaacaaatctagaaaataagtctccaaaaagaaaaagaaactgcagtttactgtcagaccatggctaaaatagtagaaataggaggccatcctcactgcctagctcagatgaaagagcacaggctttgtggggtctaagaagggtcaataagaaccaagtgtataaagtgtgtcatggaagctttgtacttttgttttaattttaaggaccaaggaatgctttttttccattaaaataaaaggaaagaaggaagaaaataaaagaaagagaagaaaagtgaaggaaaaggttttctctcatcagaacatgcccaagagatagcaattttgtattagtaattagaatgaagatgtatttaaaagtattttaatgataattttaaggttttgatagatagtgccagtgatagtgaaaaaaaaaagcatcagattaatcatttggtttgtgtgccttttgcgtatcacctctaaaagtgtcaatgaatttgacataaatgaacagtttcttctataaattatctttttatttttaaataacactgtaacatactaacagcgcactaagaaacatctgtatttccatgatattcaagttatttaacttgaaattttaaatcctgagctcatcattagttctacagagagattaactgtattaaaatttgtcagtgtaaggaaaggtacaaaattatcaaatatcatattccatattaaaattgaattgctttaaaacattcaaaaccacaaatattagacaactaccttctttagttttcaatgctttttctttcttgtaaatttactaacggactaatcttatagttgagacccatcatatattaagcctattgttggtacccagagagtgagaggaatgtttttacttgtgtcctaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatggagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccgaaaaaaggcttaaactaaaccttgacatccacagtagcatcaggaatagaaatgtgtattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctatataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaacaactgtctgtggcatttgtatacatcgagaacatttttctttccctcattttctgcagtgaactccagtaaagctaagtgtcttatgaaatctaaactcatatatgtacacagttcactctagcttcttccaaaatatctctaggtagtacaactgaagccaaacctgcctgacttcctgctcctggccacccaaaactccatatggcttctcgtacactgacatcctctctctacccatttaactgctaattgagtctgataaaagtcttctttgaaaaaagtttttacttctaagatttgcatttacatcataaaattaaaccattttcaggaaaatcagatttttttattacagtactatttgctttaaattcggcatgtttttcttaagtagcaagtacatgtatcggaacttagaactggtgggcgcggtggctcttgcctgtaatcccagcactttgggaggccaaggtggggggatcacgaggtcaggagatggagaccatcctggtttcatcacggtgaaaccccctctctgctaaaaatacaaaaaattagccaggcattgtggtggtcacctgtagtcccagctgctcgggaggctgaggcaggagaatggcatgaacccgggaggcagagcttgcagtgagcagagatcgcgccactgcactccagcctgggtgacagagtgagactctgtctcaaaaaaaaaaaaaaaaaagaacttataactatgacttgttcatctcaccctgaaaatatgttcctacaagaaaatgtgctttgcaaagcaaaaaaggcaaaaattggggatgagttcttcagacaagtaccaaaaatgatttctcgtcatttttattgtatgcatattcatcatagaaaataattttttgttttattgggaataaaatcatgatacttaaaatctgatacacatttcaatgatagtattaatccaataggttaaattaacaaattcttaggaaaaaaatctgtttatatgaagctatggagaaatctagaaagtaggtaacggtttagattttgagggacctatgaactcagaacaagttcatttagaggtgggaaacctgagattcaaagaggtctgcatggctgccaagattgcagggacagaatccaagcctgggctcactcatgatctgctctcctgtataaatgtcccatgtgcatctatgaccttattgtttgcaaagcaaattcatattccacgacttgtctgcttcttacaacaaactacaaggcaggcattgtgatttctaagtaagaaggaaaaattaagtagtcaagataatatttagaataaatatttttgaagatgatagttaaatagatggctcttcagactcctagctcaggctatttttccagccttcttttcccaaggaagagaagacaaaaaaaaaaaaagattgaacagctctttttcatttttgttttgttcattttatacatgacacaaattgtttatcttgctctcattgggagtttctgttgattccctctttcaatgatcatcaaaagtcatcacccctgacttaaatggttttatgaaattcaagaagttgtgaacaaggctttaacaaaatatttccacttttaatgcctatgctctgattttatataaattttgtatgtaggacatgatgttgaagtaaaaccaataaatagccaatcagtattcatctctagcgtcaactgaatcctgacctcaatcttcaaaagaatcagaatagtttcacacttcataagttacatatactccagaataaataaaagcagtttgcttgaagtattatcttggctcatttgtgctgctataacaaaacacacttgagactgggttatttataaagaacagaaatttatttctctacagttctggaggctgggaagtccaagatcaagctgcaagcagattcggtgtctggtgagggctgctgtgtgctttcaaggtggtgccttattgctgtgtctttatatggcagaaggggccaacaatggagaaacagcagaatagcaagaagcagctgaatgctatgtgatgcttcttttataagggccttaaatcccattcatgaaagagaagccttcataatccaatcacctcctaaaggccctacctcttaatattgaagattaagtttcaacatgaattttggaggtacgtattcaaaccatagcaagcatacagtaatttccaatataaacctcactcaaaattacagtcacatgctgcacaaaccagttcaatgcacatatatgatgataagattataatacaatatttttgctatactttttctatgtttacatatacagatatcattgtgttacaattgcctttagtattcagtacagtaacatgctgtacaggtttgtagcctaggagcaatagatcatactttcaagcctaccatctagatttatataattacactctgtgatgttcgctcagtgatgaaatcacctgagaacacgtttctcagatcatatccctgttgttaagcaatgtgactgcaattgtgctctgctgccagtttatttttgaagctttatttttcaattacttactcatggcaattttataagaatcattaaacaaatttaatccagcta

SEQ ID NO: 792 - DNA, 5078 bp, Homo sapiens
aaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccaggtgggtttcatcgggtgggcccagcgggacagggccgggtgaaattagggagggggctgggctggggcgcaatggaggccgagccaatcccggactcctcaatgccagcaaagcttctggcgccgccctgtctgaacctggagcggctgggaggatccccctcccaggagaagccgaggaccccaggatgctgcagaatcagtgagaggtgcgtaaggccaaaccccattccccggaccccgctagcacttcaccacctggctcagtgatcaaggggtcatgacctctctttgctggggttatcgagaagtggcaattttataatagttactgaaacttacaaagaggttctggtgcccagagacacttggggtcatctagggatcagaggccatgcaattccatgtctctggggctgatgtaggcactccccagggatcatccaggggttatggagggcaactcaataataatgaaaatgataaaaatcgtaatcatattatggcaagccagcggcgtggtggcgcgtgcctgtaagtcccagctactcgggaggctgaggcggaaggatcggtcgagcccaggagttctaggctgcactgagtcctgatcacgcccctgcactccaggcgggggtacagagtgaggctcggtctctaaaagaaacacaaagaaaaaaagtaacctttttctcgatcctgcagccagaggcttgatatcctgcctcggtcacctagggcggtccctgcctgggtgatctacgggtgccgtaaggggttgattgatgtggagggctgggcgtgcctgggaggcccacagtgggcgaggtgagttgcaattactgcaactcttaaaccttccacccagagttagaaatgactgaacctcaggtggggtgtgtagcctgtccaagggtacacaaagagccggcccaagttggaaccccctggccggctaaacccaggagtcacccaagaaaacgtgaccccactgcccttctccccaggtccctctggcctgcatgccaggagtcggtcaccgccctgtgcttcctccaagagacagtggagaggctgggtcagtcccctgcccaggacaccccggtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacaggtaggggccggctggggccaggccgccctttctcccagttacaacgcaaacaccagtgtgggaggtaggggtgctctctggcgtcggtgtggaccctcacctgtgctctacgttacacgtggcccagtctctggttgacaacttgagctggtgccagatacagtcctgccgctcctgactcagtggctccccactcccaatgtgagacctggtctctttaggaatcaggcctggccttgcttaggctgcagctgcggctgcggtgatttttcccaataatgctaacagctactatttgttggtagtgacaacaataagaggttaacaggcagtattttatgtgtatgggctcattcaaaagcctggggaggccgggcacagtggctcacgcctataatcccatcactttgggaggccaaggcgagcagatcacctgaagtcaggagtttgagatcagcctggccaacatagtgaaaccccatgtctactaaaaatacaaaaaattagctgggcgttgtagtgggtgcctgtaatcccagctgctcaggaggctgaggcaggagaatcgcttgaactcaggaggtgaagtcttcagtaagcagagatagcgccacctcactccagcctgagccacagagtgggactcagtctcaaaaaaaaaaaaaaaactagctgggaatggtaatgggcacctgtaatcccagctacttgggaggctgaggcaggagaatcgcttgaacccaggaggtggaggttgcactgagcagagatggcaccactgcactccagcctgggtgacagagcaagactccatccccttaaaaaaaaaaaaaaaaaagctttgggaagctgggcctggtggctcacacctgtaatcccagcactttgggaggccaaggtgggaggattgcatgagcccaggagttcaagaccagcctgggcaacatagtatgacccccagctctaatttttacctatttattgttattataaaaattataattatgacttttttaatcatgccgccaaaacaatatttttttttttttttgagatggagttgcactctgtcgttcaggctggagtgcaatgacacaatctcggctcactgcaacctctgcctcccggattcaaacgattctcctgcctcagcctctggagtagctgggattacaggtgcctgctaccacgcctggctaatttttgtatttttagtagagatggggttttgccatgttggccgggatggtctcgatctcttgacctcaggtgatccatctgccttgccctcccaaagtgttgggattacaggagtgagccgccaccatgcctggctgcttttttttgcttttgtttgtttgtttgtttttgagacagggtcttgctctgtcacccagggtggagtgcagtggcgcaatcatggctcactgcagcctggacctcccaggcccaagccatcctccctcctcagcctcccaactagctgggagtgcaggcctgtaccaccactcctggctattttttttgtttgtagagacggggtctccctatattgcccagactcccatctctttttaaaaatcaataaatcaaattttcaaagaaaaaaaaactgttgtattgggaagcccattttacagatgaggaaactgaggcacagagtaggagataatgtgtccaggctcacacagcaaggacatggagaactgggattggaacctggcaggctgtccctgtgcttactatttttcaaataataataataataattaggtcgggcacggtagctcatgcctgtaatccctgcactttgggaggccgaggtgggtggatcacttgaggtcaggagttcgagaccagcctggccaacatggtgaaaccccgtctgtactaaaaatacaaaaattagctgggcgtggtgtcgcgcgcctgtagtcccagctgcttgggaggctgaggctcaagaattgcttgaacccgggaggtggaggttgtagtgagctgagatgacaccactacactccagcctgggcaacagagcgagactccatctgcaaaaataataataataataataataatattactaatgagaggcaaagccaggccattcagatattagttgcctcctcgggggatggctgataccttgatactaaatcttcatttcggagggctgttggggacaagctacagatcccccccagtgctaataccttgtctgccccacagcctgccctgcagtagccgttctcaggaatcccctgcagatgctgttgggggccctgcagcccacccaggaggcaccgaggcccactcagcaggcagcgaggccctgggtgagtcctgaaaacccaagagctataaatattttgggggccaatttcctgtcttccctgcctttctccctgccccccccttctccatcttgcttccccatttagagccctcagggaggagtcgcagcacccccctccacttgggctgagtcacccccacccccagcttcctcctctgcggaatgctgccatctgtctcccttcctggctttgctgtggcttagagctggcaactcccagggctgatccagagctaggtggggcctttactgagacccccacaaaatgcccgactccgcacaggcatcccgagctcacatgcttggcctctgacccctgccctttgacctctgacccttcagagccccggcgctgtgcttcctgtcggacccagaggaccccgctctggagagacgctgaagatgggacccctctctgcaacgcctgtgggatcaggtccttagaatggaggagggagttggggcgggggtccccaaatcagtccacgtgtaaccaggatggcctgtggggaaagcaaaaagcaaaacacctacctcttgggaaaagtggtttccttgtggcggtttccgggcccccactgcatcctaaatggcagtttcttgtcccccaaccctaggtacaagaaatacggcactcgctgctccagctgctggctggtgcccaggaaaaatgtccagcccaagaggctatgtggcagatgtggagtgtccctggaccccattcaggaaggttaaacccagcttcaccctgctgagctgctgcttctgcctccgtttcaccagtgggagaatgggcagaagcagctctcctaggaggattggggaaagagccggcctgcctcctctctgccatctccagattcaaggatcccgggggaagacccaggcctcaggtggcagagcctgctaggggtcaccagccccttctccagtcagccttggccgaggccccctcaggagacgctctcaggaaggatgagcattgttacagcagggacaataaagtacagagatatgccgaga

SEQ ID NO: 793 - DNA, 15879 bp, Homo sapiens
gcgcgcagtttcctggagacccggaagcagattacgtggagtgacggtcatgctgcggcgtgtgagtttccctttgtttagattaaatctgggatgctgagtcccctcgcgcttctgtacccggcatctcaggggtcacacagaccttgaaatccccgcatcgctccctccaccccgactaaactcagacgttctaatgagagtctggcggtcgcttccctgagtgttaaaatcgctcggaggctggtcctgtccccggtctttcaccacagggccatgtagacagctcctgtcgcggagtttgcctgcttcaaatccttcagtgacccctagacacggcccgcgctgcgtaaagttctcacccgcgagatggatccacgtctttccggtcccccaagcctcgccctcttttcacaggcctgcccccttttctgtgccttaaatgagaggaaatcgatctgatgtttactgctgattgtgatgtttcagcctccattgggcttttgctaacacctaaataaatatttagtggacaaaattaggttagtgcaaaagtaatggcaaaccgcgatcacttttgcaccaacctaatatttatgggccggggctggaattccatcttctccggaggcccaggctggagaattccttgagcacaggagtttgagaccactctggacaacatagtgagacccccatctcaatttttgaaacatatgtttcagtacgggtatttaatagagattggaattctcgtttctatgtttttacatggtctgactttttgaaatagtttgaaataatgtttataaactgaattgagcacagtttatacatttttattgttgcaaacatgctgaaatgcacatttgcaaaaacaacgacagccaggcacagtggtgcacgcttgtcattcgagttactcggagagggtgtcatttgaggccaggaattcaaggctgtagtgtgccatgaataagccactgcactgcaacctggacacattaaaaaacgaacaaagacaaatatctaaaaaagaggttattgacagacaactctttcagttgtcacatatatgtttactagagtatatgtgtgtgaatgtatatatgtatatgaataagtgtgtacatgtgatgtgtgtggatgagtgcacagatgagcaagtctattgtttttatcaaaggcgcatcatcagtttatatacgtcttatatcttttaacagttgaaattacatcttatatattttcatgaccttaaaattgttctacactgttatgatagtgagtctatggctgtaaggatagtaacctgttatggggatacatgtgcgacagtttcttgattttaatcccggaacttattttaactatactcagttaggtcattgtctgtcaatttacttttgatgctgatctgttattgtttgatgtttttttttttctttttctgagatggagtctctctttgtcacccaggctggagtctcgctttgtcacccaggctggagtgcagtggcaccatctcaggtcactgcaaactctgcctcccgggttcaagtgattgtcctgcctcggcctcccaagtagctgggattacaggtgcccaccagtacgcctggctaatttttttattttcggtagagatggggtttcaccatgtttgctaggctggtcttcaactcctgacctcaaatgatccacctgccttggcctcccaaagtgctgggattgcaggcatgagccaccacgcctggcctaattcttaaagtttgattctaatgcccagactcctgggatctggcgcttactctgccatttttagccttcacacctggggcaagtttcttagaatgtctgagaaagagttgtctcttcaataggatgggaacagattgttcttttatgggcttttgttgttatagccgttagtacatgtacaacatttagaaagtgcctgtcacatgggaggtgttcaaaagcttcatcctggctgggtgaggtagcttacgcctgtaatcccagcactttgggaggccgaggcgggaggattgctgaggtcaggagttcaagaccagcctgaccaacatagtgaaaacctgtctctactaaaaatagaaaaattagctgggcacagtggtgggtgcctgtagtcccagctactcgggaggctgaggcagaagaatcacttgaacctgggaggcggatgttgcagtgagccaagattgtgccactgcactccagcctgggcaataaagtgagactccatctaaaaaaaaattatatatattgtatctgacgcttctatagaaataactgtgggttaattttttgtatttcttatgttgtccacaaaattagaaatctctactaattttttttttttttggagacagagtctcgctcagttgcccaggctggagtgcagtggcaccatctcggctcactgcaagctccgcctcccaggttcacgccattctcctgcctcagcctcacgagtaactgggactacaggcgcccgccactacgcctggctaatttttttgtatttttagtagagacagggcttcaccatgttagccaggatggtctcgatctcgtgacctcatgatccacccgccttggcctcccaaagtgctgggattacaggtgtgagccaccgcgcccggcctagaaatctatactaatttaaagaatatcaggttgggcatgcagtggctcatgcctgtaatcccagcactttgggaggccgaggtgggcggatcacgaagtcaggagatcgagaccatcctgtgtaacatggtgaaaccgcatctctactaacaatacaaaaaaaaaaaaaaattagctgggcgtggtggcgggcgcctgtagtcccagctactcgggaggctgaggcaggagaatggcgtgaacctgggaggcggaggttgcagtgagccaggatcgcgccactgcactccagcttgggcgacagagcgagactccgtctcaaaaaaaaaaaaaaaaaaaaaaaaagaatgtcataacttctaatggagaagtatattaaaacacaattagaaacatataactagctaaaaaaataccttaacgtggatttgtcagaacatccacttcaatcaagtcagtccttacaactgtctcctcattttgtgtgatatcctgttggtgaaatgtgtttttcattttagggacacttggcattcagggacgtggccatagaattccctcaggaggagtggaaatgtctggaccctgctcagaggactttatacagggaagtgatggtggagaactacaggaacctggtctttctgggtgaggataatgtcccttcagaagtcaagatctgccctggtgtatttttgcattttgtcgtgtgcctcttagcatcttaggagtcactgtattgcttgactgagattgaaaccctgttgactcagaaatgaaaacctccataatgctttataatgctgtatttttcagaaacaataagctccataatactttctggacttaaaataattgctttcttcagaattctggcccctttgagattcatcattgagtggtaccagggcttaagtatgcgtcaaaccttatgacagacttaagatatacagttctgtgttatccacccctgtgcttattatttattagttcttgtaagagagcttgatgtctgcatgttacaatgttccctcagcattcagaaggaggcagtggatgaattcatgtgaaatactgtaatttttttttttttttttttttttgagacagagtctccctgtgttgccaggctggagtgcagtggcaggatctcagctcaatgcaacctccgcctcccgttttcaagcaattctgcctcagcctcccgagtagctgggactacaggcacgtgccaccacgcctggctaatttttgtatttttagtggagatggggtttcaccatattggtcaggctagtcttgaactcctgacctcgtgatccgcccacctcggcctcccaaagtgctgagattataggcgtgagccaccgtgcctggcgaaatactattcttgattcatttataatatcctctctcctacctagacatggggcttgcattttggagatgccacagtacacatttattctttctttttattattattatttttttgagacagagtctcgctctgtcgcccaggctggagtgcagtggcgcgatcttggctcactgcaagcttcgcctcccaggttcacgctgagtatctgggactacaggcacccgccaccacgccccgctaattttttttttttttgtattttttagtagagatggggtttcaccgtgttagccaggatagtcttgatattctttctttttttaaataggaatctgtcttcctgacctgagtgttatctccatgttggagcaaaggagagatccccggaatctgcagagtgaagtgaaaatagcaaacaatccaggtggcagggagtgcatcaaaggtgtgaacgcaggtaagagcttggatggccagagtggaggccccataattttttttttttttaaacagggtcttgctctgtcacccaggctgtcgtagagtggcaatcatcagtggcaatcgtggcttaactcatagcctcaaactcctggtctcaagtgatcctccttcctctgcttccgaaagtggtgggattacaagcatgagccactgtaccctgcaaaaccacactttgagtttctgtttgggagctctctgcaagtgagagaattctttgggaaaataaaagtttaaatcctgtgagttctgattgaagtttgttttgtcttgttttgttgagacaagttcttgctctgttgcccaggctggagtgtagtggtggtgtgatcgtagcccgtgtaccctcagtctttgggctcatatgatcatctcacctctgcctgccaagtcactgggactgtaggcatgtgccattgcatcttgctaatttttaaaaaatcttttgtggagatgaggtctcactaggttgcacaggcttgtcttgaactcctggcctcaactattcttcccacctggcctgccaacgtgcttggattgcaggcatgacccaccatgcctggcctagaagggaaatttttctttgccccctcttactgctgctgtgttctttgtttttggcgttttgtttgtttgcttgtttgtttttgagatggagtctcactgtgttacccaaactagtattggttttttttttttaatttttaatttatttttattaatttatttttttgagacagagtcttgctctgtcgcccaggctggagggcagtggcacgatcctggcttactgcaacctctgcctctcaatttcaagccattctcatgcttcaggctcccaagtagctgggattacaggcgtgcaccaccaagcctggctaattttttttttgtatttttagtggaaacggggtttcaccatgttgaccaagctggtctcgaactcctggcctcaagtgatccacccaccttggcctcccaaagtgctgggattacaaacatgagccactgctcccgggcataatgttattattataattatttcaatagggttttggggaacaagtggcatttggttacgtagataagttctttagtggtggtttctgagattttggtgcacccatcacccgagcattgtacgctacattcaatatatagtcttttatccctcacccccctcccaccttttcccccaagaccccaaagtccattgtatcgcctttgcatcctcccagtttaactcccacttatgagtgagaacatacaatgtttggttttccctcaggctttgggctcatatgatcatcttgctctgcctgccaagtcactgggactgtaggcatgtgccattgcatcttgctaatttttaaaaaatgttctgtggagatgaggtctcactaggttgcccaggcttgtcttgaactcctggcctcaactattcttcccacctggcctgcctaagtgagttagttcatttagaataatggccttcaattctatccaggttgctgcaaatgccattatttcgttccattttatggctgaatagcattccatattagtatgccacattttctttatccatttgttgattgatgggcatttgagctggttctctatttttgcatttgtgaattgtgctgctataaacgtgtgtggaagtgtctcttttgtataatgacttcttttcctctgggtagatacccaggagtggttttgctggatcaaatggtagatctacttttagtcctttaaggaatctccccgctgttctccatagtggttgtactagtttccattcccaccagcagtgtaaagtggtccctttcaccacatccacaccaacatgtagtatgttttgattttttgattatggccattcttgcaggagtaagagggtattatattatagttttaatttgcatttctctgataattagtgatgtggagtctttcttcatatgtttgttggccatttctgtattttcttttgacaattgtctattcatgtccttagcaccgcccccccccccccttttttttttttttttttgagacagcgtcttgctctgtcgcccaggctggagtgcaatggcatgatctcggccccctgcaacctccacctcccgagttcaagcaattctcctgcctcagcctcctgagtagctgggattacaggtacccactgccaagcccagctaatttttgtatttttagtagagacggggtttcattatgttggccaggatggtctcaaactattcacctcaggtgatccacccgccttgggctcccaaaatgctgggattataggggtgagagactgtgcccggcccttagcccactttttgataggattgtttgtttttttcttgctgatttgtttgagttccttgtagattctggatattagtcctttgtcagatacatagtttgcaaagattttctcccatgctgtgggttgtctgtttactctgccgattatttcttttgctgtgtcataggcaaagtctttatcatgatggacaacaccctgtcatatggcttatgagaattctttgattccatcattctgaaggacatagggagggctgtgtcaaaggggtctctttttcccatggtctctgtttctgtagtgattttatctgatgctaagtttatacatcaaacctggggtctgcatagacctgcctccttgacctgtgtatggtccacacaatttcctatatgaggaagacctcatcagaagataggaaaacattggctgctcttttttttttgcatgtggggctcaaagattgcatgaaggcgtctcaacccctctttgcctcttgaggtcttgtggagatagggaaaatccagtgttttttctactctcaaatgccactcagcagagagcgcttcacttctggtcaaccgaatgggtggggatttctacgcaccaacaaccagtttttcagtggccatctaatagttttctatgatgcctttctgatattatgtatctggaattagagtcagatcccacaggcaaagggctgagttcccaaacacgtcccctacctcagcaaccaatcacaagtagcaggttgtcacctttccttcttaccaaccagctacaggttggggttccctcaagccccttcttggggttgattactttgctagggtggcccacagaactcagtaaaacactttcttaggttcactgcctcacgctgaaggatgttttgaaggatacagatgaagagccggatgaggagattcacagggggaggcacgtgggaagattcactgggtgtgccaccctccaggcacctgtgtgtcttcagcatttggaagatctcgtgaccccatagttcagggattattttttattttttattttttttagacagagtcttgctctgtcacaggctgtagtgaagtggcacaatctcagctcactgcaatctccgcctcctggttcaagtgattcttctagttcagggattttttatggaggcttcatcacataggtgtgattgatattatctcagtctccagcccctcttcccttcctggaggatagtggatagggctgacactttcatgcttgtaatcatggcctggtctttctgatgatcagcccagtccagggaacctacagaggttgcctcattagaacaaatcacattcctatcacccagaacattccaaggagttaggagctctgtgtcaggagccaacgaagagaccaatgtatgcatttcttattttacaaggttcctcagccattcttcagttgtgctttgtccatactttagtggtgtgtgtaacgggagtaggtggctcttctgagatttttactcagcagaatgggaaagacagttgacagaaggatcctttaggccggggcggtgtctcacgcctgtaatcccagcactttgggaggctagggcaggcggatcagaaagtcaggggatcgaaaccatcctggccaacatggtgaaaccccgtctctactaagaatataaaaaaaaattagctgggtgtggtggtgcatgcctgtagtcccagctactcgggaggctgaggcaggagaatcgcttcaacccgggaggtggaggttgcagtgagccaagatcgtgccactgcactctggcctggtgacagagcgggactctgtctcaaaaaaaaaaaaaaaaaaaaagaaagatcctttattggatgcccgagtcctcgtgacagaatagctcactagaatgatacatctggttataagactaaagccactgctgattttattttgggcctttccatgtattagaaatgaacttggggccaggcacagtggctcacacttgtaatcctagcactttgggaggctgaggttagtggattgattgagcccaggagtttgagaccagcctggacaacatggcaagaacttgtctctacaaaacatataaaaatttggctgtggtggtgcacacctgtagtcctagctactcaggaggctgaggtgggagaatcacctgagcccaggaggtcaaggcagcagccagccatgatggcgtcactgaactccagccttagtacagagtgataccctgtctcagaaaaaaaaataagaagaaaataaaaaataaatgaacttatttgtatttagtcaacagttccatatggtactctttgtcttctttgttttatatgtgtggggatgttgtatcagggaatggccattgatttatatatttttgaggacctttattttattttattttttgcctaggagtttatgtaacacttatatacactccaggagttttggaatgggtagtataaatatttcttttcctttcctttacctgattaagatattaaataatatttttgtcagttacgtttattagaatgtataaattgggaatttattttcatttttctttttttttttttgatagagtctcgctctgtcacccaggctggagtgcaatgccgcgatctcggctcactgcaaccttcgcttcctggattcaagcaattcttctgcatcggcctccccaagtgctaggattacaggcgtgagcctccgcgcctggcctcatttttaatttttttagagacagggtttcactctgctgcccaggctagatggcagtggtgcagttttaggtcgctgcatccttgactttgagggcagaactgctcttcccagctcaggtgatccacccgcctcagcctcccaaagttctgggattacaggcatgagtcactgtacccggctctgatatttttaataatgcttcaatgaacatgggtttctaaatatctctttaagctgctatcttagttcttttgtatatatacccagatgaggaattgttgcctatactggtaatttgattttggattatttgagaaaatgtcatacttatttttttttttattattattttcgagacagggtttcactctgtcacccaggatagagtgtggtatacaatctcagttcactgcaacctccgtctcccaggttcaagtgattcttgtacctcagcctcccaagtagctgggattacaggcgtgtgcctccatacccatctaatttttgtacttctttaatagagacaggtttttaccatgttggccaggctggtctccaactcctggtctcaggtgatctacccgcttcagcctcccaaagtgctgggattacaggcgtgagccaccgtacctggcccatacttctttgcaccattatacatttccagcaacagaacataagtctcccatttctgcacatttttgccacttgtgatgtactgttttttttgtcttttgggttttttttttaacaataaatattccatattggatgtgagatgatagctcattgtgttttttatttgcatttttccaatgattagtggtattttgcatgtttaatatggttgctagttatttgtatatcacctctggaaaaatgtgtattccattcttttccttatttcttaatttttcatttacttttattcaataataatattaaatgaaatctttttatttgtatgagttacatatattttagatattaacatcttatcggaggtttgatttgcaaatattttgttacattaagtttccttttgactctggcaattgttttctttcattcacaatcattgtcttgtagtgcgttttatgtatttttgccttctttcttgttccgttgttttagatatattcttgctcttttgcctaggctggagtgcagtggtacagttatagctcattgtatcctgcatctcctaggttcaagtgatcctcctgcctcagcctcccaagtagctgggactacaggcatgtaccaccatgcctggctaatttttaaaaattttttgtggagacagggtcttgctgtgttgcccaggctggacttgaacccctaggatcagtgatcttcccacctcagccttgcaaagtgttggaattacaagcatgagccactgctcccaaccagaatcgtctttttctttattcttcttctggttctatccattttcaaaactggaatattgaaatcaactataatattgtggagctatttctctttggagttttatcaagttccattctatacttagtttttttaaatttacttactacttttaatagagatggggtcccagtgtgttgcccaggcttatctcaaactcttaggctctagtaatcctcctgcctcagcctcccaaagggctgtgattacaggcatgagccactgcatccagcctcattctgtacttaggagctctgacacttggtgtttatatatttataattgttgtatcttcttggtgaattgagtctttcatcattttataataatctttgtctcttatggtttttgaataaaagtctattctctcatattaacactgctacctgtactttctgctggttcctgtttgcatggaaaatatttttccatcctttccatttcagcctgtgtgtgtccttagaattaaagggagtttcttgcagatgggatttagtaaatcttgttttcttctgattgcaaagttaaatcaggccaacattacatgaaaaggagaatatcaaacatagtaactattaaaaacaaaagaatacatattagattattatctgtagattttttaaatcttgtagatttttttcccctacatgtctttcttactgccttttgtagtattttgcttgtttcatcatagtaacatacttgaatcccatctcttgtgtgtgtcggatagattttctctttgtggttagcattgcagctacttcaaatactgtgaaattgaaacattctatttttaaatattaacagtgtaactttaggtacagaaaggtctacttcacaactctgctctcactttctgctattaatggcagaaattattttgatatatgttatggtcccattaacatatatcaaaaaagcttctgagaaaaagcagggattcttaaggaaaatctatacatatatagtgctttttaaatgattttgtcttttaattactaggaaagaattatgggaggctgaggcaggtggatcacctgaggtcaggagtttgagaccagcctggctgacatggcgaaaccccgtctctactaaaaatacaaaaattagccaggtggggtaacgcatgcctataatcccagctactacttgggaggctgaggtgggagaattgtttgagcttgggagggggaggttgcagtgggccaagatcacgccactgcactctagcctgggtgacagagcaagactctgtctcaaaaaacaaacaaaaaccattaaaagtcaagttacaaaagaaaagagtaataataaatatctctatatttgattatttactgacctttaatggtgaactttctattttcattgaggttaaagatactatttagagaccttttattttatattgaaggagtccctttagcatttcttgttgggtaagtctagaatactaatgcactccctcagctcttcattttctaagaacatctaaatttcttatttttgcaggtgaatgttactaaatatagtattcttggttgatatttttgctttttttaaaaaagtattttcaacatttcctctcactgccttctagcctgcaaagtttctgttgaaaaatacacataatcttatacagtttccctttatgtgacaagtcttttttgttgctgctatcaagactgtttctttgtctttgacttttgataatttctgtatagtatgtctctgaatgtccttgggttcgttttagttagcattttagtttagttagttgaccaagcttcttgaatttgtatatttatttctttccttagattggggatgtttgaacattatttctacaatggtgatttcgaatcttctgtcttcctgtgaatctccaatagtttgtatattgttccacctgatagtatctcaaaaatgtactagggttggttttcttcatcattttttctttttgctctttggagctgattcttttgaataacatatctttcaatttgctcattgttttctgttccttttgcagtctgctgttgaatcccttagtgaaatattacttcagttatcatatttaagctccagaatttctgttcttttggttttagtagtttctcctgtgattggtattctttttcttttcatgtaatgtttgcctgattttatttagttatctgtctctgttatcttttttagctcattaagcatcttaaggcagttgctttaaatacctgtcaagtaattcagagggctgcctatttttaggcttgttttgtggagattgattgattgatcataattttagccatatttccctgtccttttgtaggcctcgtaatttttggtttaggtttggtaaagcaaccacttctcccagttattttgtgtaagcgttgtgcaggatacctttactaattagcctgctataaagggtataggaacagccactccttttctggggatgtgtttttttcctggcgtgtggaagtactattactaatgactatacagctgctctaaaagttctgattttccttaagaggctcatccctgctttttctcaaaagctttcaatttctgttgtatttttctgctcataatctctctcaaactcacccataatccacctgactcctgcaggttccccactgctccagtgcatccttccgtcccttttgttttctgcactgccagcatgatacacacagtatgctgatattccttcccatgtctgagtcaggtgaggcagaatctagtctctctgtcagacactgaacatgccattgtcatgggttgaagttccacttttttctttcttttttagagagcagctctaaattgggaagcaatgccggaaacaagtctcttaaaaatcaacttggattaacctttcagttacatctgagtgaactgcagctatttcaagctgaaaggaatatttctggatgtaaacatgtcgaaaaacctatcaacaattccttagtttcaccacttcaaaaaatttattctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagacttgctaacaatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcaccttgcaaatcatcacagaatccacactggagagaaaccttacaaatgtaatgagtgtggcaaggtcttcaacagaaatgcacaccttgcacgacatcagaaaattcatagtggagagaaaccttacaaatgtaaggaatgtggcaaagcattttcagggggttcaggccttactgctcatcttgtaattcacactggagagaaactttacaaatgtaataaatgtggcaaggtcttcaatcgaaatgcacaccttaccagacatcaaagaatccatactggagagaaaccttatgaatgtaaagaatgtggcaaggtcttcaggcacaagttttgtctaaccaatcatcatagaatgcacacgggagagcaaccttacaaatgtaatgaatgtggcaaagcatttagagactgttcaggccttactgcccatctactaattcacactggagagaaaccttacaaatgtaaagaatgtgccaaggtcttcaggcatagattatccctaagcaatcatcagagatttcatactggagagaaaccttacagatgtgatgaatgtggcaaggacttcactcgaaattcaaaccttgcaaatcatcacagaatccatactggagagaaaccttacaaatgcagtgaatgtcacaaagtctttagtcacaattcacaccttgcacgacataggcaaattcatactggagagaagtcttacaaatgcaatgaatgtggcaaggtcttcagccacaagttatacctaaaaaaacatgagagaattcatactggggagaaaccgtacagatgtcatgaatgtggtaaggacttcactcgaaattcaaacctggcaaatcatcacagaatccatactggagagaaaccgtacagatgaaatgtgtgtggtaagatctttagtaataattcacaccttgcacagcatgagataattcattcatgagagagttcttacaaactgagtatggcaaactcttcatgctaagttctagcattaatcaacatcagagattccatactaaagagaaatcatagcaatgtatgtgaatcaggtctcttgaggcctgccaaatgactagatatcaaaacatacatcttggatgaaaccatacagatggattatgtatgctgaggctattattcaaggaccattactatggaacatgataagatttacacaagcgataattcagtctctagttctccaatatttatgatactgcatgctgcagaaaagtcacagctccaaatacgttgaatctcatgacgcgatgcatgtcgaaggtccaagggcatgtggaaatggtcagttatattcaggcaattaaaaaacctaattatatggggttttttgaaaa

SEQ ID NO: 794 - DNA, 11051 bp, Homo sapiens
ccccacatcggtccgtcctgcttccagctgctgcagcgcgccttcgccgccaaagcatccagcagccccctgctccggcccagcatggcgaccccgacccagacccccacaaagggtgagcgtcgtttggggagggggttgcaggggggctccgggatctgagagcctaggagagagggtgtcgggagattcaagcaatggtaaggcaagggagttgggggagggaggtccgctcctcctgtgggcggaagcccctgtaatgcgcccccccgatcgcccctccgggtctctgggacaccccctccccggcaggcgtcctgtgccagacctgcggttggagagtggcagtcccgggagaagggatgctcggacaggtcgctatggcaaccgggtggctggtcccgcaccgtggtggtagcagacggggaagagatgagcttgcagggtgggagcgggtgggtctgcgaccagagacgttctggaagatttcagggtccctggggtgggcaagggaaggggaggaggttcatgtccctcttctttccagtgctgtctcctagggtgtctgtttcctgaaacccttgacagccaggttcagaggaaaggagtgagagctgaaggaagagacagagagaagggatatagcaagagacagacagggagaacctggaagagacagagaccaagagaggcaggagatccagagtcacagatacaaagacccaggaagacaaatagatggactcagagagattcccagtggaggggagaggctgagagcagtagacagagatgcagagagagagagaaaaaaaaatgagagcctgggagatagtgggattgagaccgctatggagagagaagcagagagacggagggagagagacggacccatggggagagaggggagtagaaagagaagaagggagccatgtggggtggggcccaaaccactgcagtgagaccctatgtgtgggaatggggcgatgggaccctccttccagcccacagcaggggtgttttccaatcccagaggtgctgttgggtatacacctagctgcccctactgcccccatccagccacacactgatttccattccacaccaattaacccagttatgcacccacttaaacacccacttctaccgtcgccccctaatagcccccactgctaatcctgcttctgcagatgagcaaggcacagactgcttcaagagggagccagtgcccagcaagggtctccagcactgagggcaggggaccaggggtgctgagaagcccctggcagtgaagggaacccgaattccacttggatggctccctcccttccgcgcttcccagcaggcgggggctgctgcactgagccatatctgcagaatccgaagcagggcggggggtggggggggctgcagaggctggaagctaccctagggaggggggcagggctgaggcagcaggcctggcgggagcccagggcttctttttgcagaggtggtggttagcaggatcgatggcagcagacgggcagaggtgggaggacagactcctcaacccaacctcctctgcctccccctttcccagtcacagcatgacaggggaccgcaggtctcgggaaaccccgggggaggaaaagcatgttgtgcattgcaagctgcttaaggaaactaattaatgaattgttggggagcgaggggggaagaggggagagtctccctccaccctgccagagaacaggagggagagttaggagtgaacagaagagggatgcatgagcacagctgggtccgggtccctatccctgaaatggacccttagcttggccagaagccagtcctgcaggggcaacggcaggaggtgcaaaaggaggggagagggtcaagattgaaacctgcatctcacacaggacctcacaggggaccccacccagcctggggtggcgggacctatcacctctcttcacctcccaagatgccccagttgccatagcaaccacctccttcctgatatctctttggcagctggccaggagtagtgcacattcctttgcctgactcctggccccacccttagcccagccacgcctgagggcccaggttgccggggcagcagggaccagaggaggatcttccgcatggaggaggatcttccacatggaacaccagattctgggacaggggctcacccagtgggctcccgataactttggggaaggacgggtgtgtggaaaacagacaagtgagacaatccaccttttacagcctcctgcagcctaggactgcctcataatcattccttcattcattcatcccagaaaacttgaagagcctttcataaatgtcaggatgaacagcagtgatgagtcaaacaaatttactctctggtggggaaacttacacagagcacaagggaccctgaagcagcgtctcaccatcttggcgcttttgagtactaccgtcacaatttttgctttattcaaatattcctcacactgctatttatttaatttttttccttaaaaggattagcttttttatttttattttttgagacaaggtctcactctgtcgcctaggctggagtgcaatggcacgatcacagctcactgcagcctcaacatcctgggctcaatctatcctcctgcctcagcctcccaagtagctgggactacaaggcacttctgctacacccagctaatttttgtatttttcatagagactgcttttgctatgtttcccagcctggtctcaaacttctgggctcaagcaattcacccactttggcttcccaaagtgcttaggatgacaggcgtgggccaccatgcccaacccaggattagcttttgaaaacaacgagctttattttatagcaccatcacaactggaaaattaatcttctttttttttttgagacagagtctcgctctgtcatccaggctggagtgcagtggcacgatcttggcttactgcaacctctgcctcccgggttcaagcaattcttctgcctcagcctcccaagtagctgggactagcagcggcacaccaccacacccagctaatttttgtattgttagtacagatggggtttcaccatattggccaggctggtctcaaactcctgacctcgtgatccgcccaccttgtattcccaaagtgctgggattacaggcatgaatcactgtgcccagctggaaaattcatcttctttttgccttaagttgaaggcagcataagagcaatctgaagcaggtgatttcgcttttctgggtctggtgtcccccttccaggaaatggggatgaagatcgcacccatatgaaagagttgctatgaagattaagagtaaatgcgctgatatctgtcagatgcttagcagggaggctggaatggagtcagggctacccactgctggttacatcaataaataaaggagaaaaccaaataatgccacaaaattctgcctagattttattgcctgctgaagacttggagcccaaggcctgttttctcttaggtaaaggggggagattaacaagggttggaaggtggtaaagatacctcagcaccaacctaagccatcctctttgaagactagacagagacctgggaagggtaaacttacacattgtgtgaaccgtggtcttgctttggggccacctctatcagtcagtttcggctacagcatgctgtggtaacaaacaggtgttgctttggggccacctctatcaatcagtttcagctagagtatgctgtggtaacaaatagtaccaaaagtctcaggggcttatgacaaccaggttcacgtatacgtccatcacaggttgaccagtcaccaaagaaaactagagcagtcaccactgtgaacattcaggccaccaggctagaagtgaaacagagctttggcctggaggcctgaatgttcctgaatgtttaaatgccccagcctggaagtgacaatgcacttctactcaccgttccttggccagaattagtcacatggccctacccaacctccagggagccatccatctgagcctggaagggggaaggagaacaccaacgacatcaggcatcacctggcacccctcaccctctccccatgtggcagacagtctgctgccaaattctgctctagggaaggccaaatataataagaactgtcagaggcattcgagaaccatcaggatgaacttgttgaatgggaaggatgttctgagctctcctgcaggggaacatgattagggtccaggaaggtgggaagtggagaaaagtgaatccagagacacacacacattttatccacatgtgaacatttctgaaatcattatgtgtcttctaatggatggggacatttcacgtggtagagttccaaacatatttacacatacacacacacacagggaaaactattacaaactcaattttgaatcttaaacttgatggtgccttagaaataagtaataatgggccaggcatggtggctcacatctgtaatcccagcactatgggaggctgaggcgggcagatcatcggaggtcaggagtttgagaccagcccagccaacatggtgaaatcccgtctgtactaaaaatacaaaaattagccagcagtggtagtgcacacctatagtcccggtccttgggaggctgaggcaggagaattgcttgaacctgggagatggaggttgtagtgagctgagatcgcgccactgcactccagcctgggtgacagggcaaggccctgtctcaaaaaaagaaagaaggaaagaaagaagaaagaaggaaagaaagaaagaaagaaagaaagaaagaaagaaagaaagaaagaaagaaagaaagaaagaaagaaagagagagagaaagaaagaggggagggagggagggagggaggaaagaaaaagaaataagtaatgtggggtatgaatcagcacagcttccctgtactggatggagtatcaggagtgagtggatgtcagcagtagcagcaggtgcctgtcggagctctcaggtgactgagaagttttagggagtattcaggggaagctgagacattcattggttcaccagtggaaatggggtctgttttaacctcatgacatcatgtgcaagtgggagtgtgtctgtgtttttcagggaatgagtccatagcttgcatcagacctccataggggtccagaaccaggactgccatgtagtttgagaagattgtacactgcatagaggatggtgctgactgatggagtgagtaggggctggaatccagcttgagctatgctcttccagccttgcggcctgccatgaggccacatcatccaaaccaaggggtctctatctgacttccacaaagaaatgattaggccagtggctccatctggatcctaaaaaatattaagaaatacactgttaagttttttttttctttctctttttctctgcttctttccctcagctcctgaggaacctgacccattttactatggtgagtgttggatttggggatagggctggactggggagtagctgcaggtgctcacagatcactccggacatggcttcagctgtggccacacgatacgtgctgggccactggccacgggaccatatatgtgggtgtggttcacatcagctgagttcatggagggcagaaccagatgggggagtggggatgcctcacactctctctgagcccccttcaggtctcaccgggatctgggctggtgccttggtgtcgccagagaagcagatgaaggaaaaccttagaagcaatgactctgagcccaggctgcctggatttgaatcctgccttatccactcactagctgtatggccttgggcaagcaactttgcctctctgggcccttctgtaaacaagggatagtaatagttcccacctatgaggactgtgggaaagatacctgactggtggcattaaatctcctccatggcactgaagctcaaataagctaccccaggcctggtagatcgggctccagtttcccctctgaacaccctcctcttgcccccaccccacccctttgctcattcatactttttccctaggtgtcaatttctctcccatctcaggacctttgcgtgtgctatgattctgcagtaatgcttctcctttgtacacgaccggctaaggctcccccttattcaggcctcagatcaaacatagactactctactgggataggccctcctgactccctggcaaggaagagccacaccatactcagctggtgtcgcatgacttgtttttgagggggattgtttctttaatgttttatcacaatacgaaagtcaactccttgctggtagaggcctggaccactactggtacagagtgagtgctccataaattcatatctcaacaaatacttagcgggcacaggctctatttctggcaatgttccaagcagctggagacactgcaatgaaccacacagacaagaattcaagaatgcaagaattcctgccctcctcctggaccttccactcaatgggaaagggacagatactcaagaaaacaaaatatgaaaattatatattagacaagaatattattggccaggtatggtggctcataactgtaatgctagtgctttgggaggctgaggcaggaggatcgctcaagtccaggagtttgaagctgcaatgaactatgatcgtgatttttttttctttttttagacaaagtctgactctgtggctcaggctggagtgcagtagcacaatctcggctcactgcaactcccgcctcccaggttcaagtgcttctcctgcctcagcctcccgagtagctgggactacaggcccacaccactgcacctggctaattttcatatttttagaagagacaggatttcaccatgttggccaggctggtcttggactcctgacctcaagtgatctgcctgccttggcctcccaaagtgctgagattacaggctcattacaggcatgagccactgtgcccagctctacataaaaaatttaaaaattagctgggcatggtggtgtgtgcctgtagtctcagctacttgggaggctgagcagggacaatctcttggagcccaagaggtagaggctgcagtgagccatgattgcaccactgcaccccagcctgggtgacagagtgacactacatctcttaaaaaaaaagacaagaatattatgaggcaagaatattaggcaagaataattcctatgaagtaaaataaagaagggaatgagattggaaagtgtggaggagaggatggaaattctgaataggacagccagaggttttgctcacaatcaaataaagcccagacactggtgagggaaggagccacgtggatatttgggggaagagctttcaggctgcaggaacagccagtgcaaaggccttgggataggatcatgctggatatgccccaggaacagtggggaggccactgtggctggagtaggattgatggggagagtgaggtggggtgaggtccaagaaggaaaggaactggatcatatgggactttgagggccctagtgaggaatgtggtttctaccttgagggcaatgggcgggaggagggctctgagcagaggagaaaccagatctgactcaaatgttgatgggtccttgtggctatcagaggtgggagtgcaggcaggccagcaagaccctagagaaggctgctgcagaggccagatgggcgacaatggtggacagaaccagggccagggaggaggtggtagagggagagtattatatatatatccagggtggaaagcgcagggggagagggcaagggaggaaagtagagggtacagagggcaaggggagctaacggtgcccaagcccacaccctacatcctcacatcaaccccctgaaggagtgtccagcacagtccacagcctccctgggcgattctgggttcctggctgggccacccagagccaggactgggctccaggtgcagccaaggtgctgtccctgcctcgatgtcccccattatcttccccagactacaacacggtgcagactgtgggcatgactctggcaaccatcttgttcctgctgggtatcctcatcgtcatcagtaagtgcgacccattcctgggctgcctcagcctccgcttcctctgctggctttcatccatatcctacccgctatgtcctgtcttcttgttctgtctctctctcccaacaggcaagaaggtgaagtgcaggaaggcggactccaggtctgagaggtctggcagcagtgggcaaagagcgggagggggcctcggggtgcctccctagcagatgggcaggatccactgggcctgccatgcgttttccccaaagcctatggttattgaacctctttctacttttctctctcatctctgcctccacagcccaacctgcaaatcctgtaagtctgagcttccctcttcaggtgagggtgagaaactgtgtggttctgggagagttttaggtggggcagggaagggaaccctcagaagggaagtcgcggggatggactggacgcagggggcggagggggggtggtgcctgcagatatcacaggacaattccctaggaagctgaggaaattccgcagatgaaagatgctaaacctggctgggcgcggtggctcatgcctgtaattccaacactttgggaggctgaggcaggcagatcacctgaggtcaggagatcgagatcagcccggccaacatggtgaaacaccgtctctgctaaaaatgcaaaaattagccgggcatggtggtgcgcacctgtaatcccagctactcaggaggctgaggcaagagaatcacctgaacctgggaggtggaggttgcaatgagctgaggttgtgccactccactccagcctgggtgatagagtgagactgtcaaaaaaaaaaaaaaaaaaaaagaggaaggaagaaatgaaggaaggaagggagggagggagggaaaagaaagatgatgctaaaccgtggggaggctgtgggatgtgacatgtcccagagtccacagagattcccagaaacaaatgctcaagcctataaaagccaggacaagctgatttgccaggagaggaagacacaggcctgtgaagagaagggccccatgtgggaggagctctgtcaatcaggagggagagagagggagcactgaggaagacggggagaggctttccagacttgatcgttcagccaggcagatccaggatgaaatagccgaggaagcgggacagagggagggagggaaggtttctgaatagttgcatcaaaataacaaaaagagagatgaatagaatgcagattttagaattcacattggaaaagaacatatgggatgcagggaatgtgaggatggagaagaaagctgggaagaacaggaggggagagagtggagaggacggaggtgttggggagaatgtgggaaggaggagcccaggaaggaaggggaggaggatgggaggaggagggcgtggagggtggaggagggagaatgggtgtaagcatggaaagtgtaaagggagagcgagagggatgcagggcaagcatgtcaacgaaagactgatctctttgaggctgttaattttaattatgtaaaaataacttgacctgtttttagtggaaatgcagcctttctggagacttgtaaaagaacagaaatgggaatttctgtgtctcttataaagttcttataactaaaaaaaaaaaaaaaaaaaaaaaaaatgcgggagggggacacgggttattcaatggttgagaagtatttggtgtggaatttgtttcacgttcctttttttttttttttttttttttttttttgagacagagtcttgctgtgtcctctgttgcccaggctggagtgcagtggcacgatctcagcttattacaacactgcaacctctgcgtcctgggttcaagcgattctcctgcctcagcctcccaaatagctgggactacaggcacacaccaccacacccggctaatttttatatctttagcagagatggtggttcaccattttggccaggctggtctcaaactcctgacctcaaacgatccgccatcctcggcctcccaaagtgcttggattacaggcgtgagccacagcgcttggcctgtttcatgtttatttaatgagttttaaaacatgaacaaggcacttatggatgcgtggggcagcatgggggttggccttgtcacctggggcacagctgaagactttgcacaggtttctggtctatcctaggtgaatgatggtctgcagcgggtggggaatgggggacttcccgttgtatccaaatgttcaggacagggagtgtaggaaaggagtgagggtgtaggaggagattgcaaatgggaagggagatggggactccctttctggcaggcggatagccccaaaagcccaggttgggtctggggtcgccagccccgtagcaggtgtttctctccatgacagcagccaggaggtgtccccaagggaacaagacattagagtgtgggaggcaagacagctcctcagtgttagctctggggtgacagtccctggggtctggcttccatggtgccggggaatggagagccaacgagctgtggggagggaggcagtttccacctttctagtggctcacgcaccccctctctccccagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagccgctgcaccctgctgtccctctccaggccttggcaatgacgatcccccaaagagcccgtctgcaccccagacccagggcctcaggcctccagctcctgggatccgggagtccatcccggcccagcacccccagcatccccgtgtatggcccccctgcacctccttgtctcatccccgaagatccgtccccctggcccctcagtgtccatgtcttgagcttaataaatgtgcatttggttttttcctct

SEQ ID NO: 795 - DNA, 1765 bp, Homo sapiens
tttcctcccatcagaaaattactcaaaaagggagtatttaaaggaaactcaaatcaggagaacccggtaggcatcagaggttcagggcaccaaggccttagggcgggaacacttttcaacccaagccaggcttcaggggcacgcccaccaacagaccccaatttccacaggggaggcagatcttctatacctacagtgacagaaaatacactaaagtgcagtataaaatataaaaaggtttgattctgaatagaccaactgctaattttccttaaaaaaatttttaatttggttgagtaaaaaccaaattagttcactgaatctcattttgtaggtaagagtcttatttgcaatacgaaaactggagcttatgactgctttgattttctctgtagcacaggataaccagtattagtggagaacactacaaaaggtggcttgtggtgagttctttgcatagtggttttaaaaacaacctagcatcagaattaagagacttctttaaaactcacctctaaaaaagctgtttaagtataaagatatatctcattaggaaattctattatgttttatttggttaacagataaaatcgcagacgaatcaacagtatagaattatagcagcaaaactggttttaggtgttgtgtacaaacataaaagcaaggaagcaaagatctccaagtggtgtgatgtggtaagcagatggccttgcaccaagtcagtgtatctttctacatcactaggcacacacctctaccactaaggaacattatggtaaatctgaatgttctagataaaaatcaggagtgctcatcaatggttagtcagttgttaagtcagttaaatcaaagaaattcagtattaagtatacatgccgattcttggaaatcaattctaacattagtggttagggagaaagaaaaggaagacattcacctcacaaaacacagagtgtgacacagcaatgaaatacatacgttaaaagtacttcatacaaaaacacatcaaagtcttttaaaaattaaattctcaggcacaggtactgttaaaatgtggatggcaccctcccaaggattgaaaacacacagctggatcatgcatctggaatgttttcttttttatccaggaaagtgttttctagaaaaaagaaaacaaaacacacttaagtgggagtgaggcaatgtctgctgcgttaattattaacagttctacttttctccttaacaaaggtcataaactgagcaaaaggcagggcttacatgaccacaaagttaactaaaccaaaaagccattcatgaggctcctggaaactggaaatgctgcaaaactagaaagtatacagaaataaaattttatcgatctaaaagtaaaattttcattccataaaggttgaaaatgaagctcagagaaaataagcaaacacctgtcactgcttcctgcttcaaatgagctgcatcgctgaggcatccttgtctctttccactgtaccctcacttccccagtcacatgccattaactggttatgcaggaccagcctctagagtcagcaggccatcgtttaaaagtcatggcaccatcagcaaatacttttaaactctcggagcggcaacaatttcctcatcagtaaagtgtgaactaagcacataccctcaggactattctaaggtgtcactgtgatgatgaaactaaagcaaccaacttggactcagttgggggtgacatggatgttttccttacagtaacttattaaactgtacatacgta

SEQ ID NO: 796 - DNA, 7923 bp, Homo sapiens
ctgccatagtggaagtttctcaagaggcttggcctctgcaggaggcttctgcctggaaacagtgggcggtggtgtgggtgcaggatcttcttgatgctgatctcctgatagtgagacctcatgtgatctggttgtctaacagggtgtggtacctctttcctctctctgtcttgctcctacccctgccatatgaaacatctcattgccacttggccttctggtatgattaggaagggcctggtcagtgtgggcctggtcagtgaactagtcagttgggacttggtcagtgaggcctatttactgggggaatggtcagccagggtctgcttagagagggtctcattagagggatcgagtagtgcaggtcttggtgagtggggacctagtggcagacaaatgtttggtgtctggtcagtgcaaacctgggctgcagggcttggtgagtggagacctggtcagctgtggcttagtggtagccttgtcagaatgggctgggtcactggtgacccggtcaaggggtgctattcagtggaggcctggtcacatggcacctagtcagcagggcatgtcctcatcagtgagacccttgtcagtgggaccctggtcatggcagcctggtcaggtcagtggaacctaatcagtgggggcctggtcagagaggacttgatcagtggtggcttttgtagcactggtctatggggtgacctggtcaacgggggtctgagcggtacatgcctgttcagtggtgcctagtcactaggttcctggtcggggcatctggtcaccgcaggcctggttagtagggacctggtcactggcagcctgttccctggagacctggtcagtggggcttcatctgtggggccaggcaatggggtcatgattggtggaatgtggtcagggaggccttgtcagtgaggccctggtcagtgaggccttgtcagtgaggtccttgtcagtggggtcctggacactgtgggcctggcagcgggaatctagttagtggggcctggtgatgggggcctaatcagtgagagtgtggtcagggaggacctgatgtgcgggatctggtcagcagggacctggtcagtggggctgctgagcactgctgggaggtgtcaggggaaatgcatgttatcaggggccctatggacagctgggatggcccagtggtgtccaatggcccagtcaaaagtggacaaagcaggtgtttggatggacctgggagatcttgctcagagattctgaaagaacaaaggtaaaggaagggccagagtggctagagagatggtaacagtctatgggctgcacaggatggaggaagccagggaacaggcagggtgggcagtaggggtgcagggagaggcaggtgcatgctgggaggtcggaccctgtgagggctgtgggggcgtcaggtggggtgggctccaggtgcactctcagtgtgcactgggcaggtctcggtccaggctctctggaccctggtcgggtgatgtggtcactccctgggggactgctgtcaggcctagccacccacccttggcagcactgtcccatctcaggactggactttctcagatcctgcagagggcacagcctccagcccaggaggggcagccccttggtgcagcctaagctctccatgggcctggagcatccctgccagccctgcgctccctctactcccaggtcccgcttttcaagtgtcagccagcagagaggctccgtcctcccttccctatgtgtctcctgggctaaaacttggggcgcattgggacagggatggtgctttcctcaggcccatttagggaggggactggctcccagcctggcacaggtcctcagctctgccttggttgccttagagtgacatggatcagtcagtgccctgaaggtaaatggaagagactgtccctgctgtgtgggaggctggtctagggatggaggacttggcaggtcctcccagtctgtcaggcctggacagcactgtcctgtctcaggactcagaaaatccggtcttgggatgggacggtgctgcccagggtgggtggccagggcttgacagcagtcccccagggagtgaccacatcagccaaccagggtccagggagcctggcctgagacccacccagtgcattgagggtgcacctggagcccaccccacctgatgcccccacagccctcgcagggcctgacctcccagcatgcacctgcctctccctgcaccccagatgtccaccctgccttttccctgatttcctccatcctgtccagcaggatgggctggtcagtgggatagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccagtgccagggcactactgggaggctgggacctgaccaaagcccatggtgtctgtggcctgaggacagggtgtcttggggccatgaggacaggccaccaatggccgttgggtcatagggcctgagccccagtgtttgtccttccctggctccttctggttcagtcccatcagggctctggatcccaagacgcagcatccaaggttccctccaggaatcctggtggctcggcttactttgtcatgtttcatctgatagcaaaaatatcagatcggctgcacagaaaaatggctcaaagtgcttaatgaccagaagaaatctgggagtagcaagaaggtaatgtggagaggggaggacctccatgactggtgtctgcagagccaggggtacagggacccagtgcagtgacctggcaccacctgcctctcagagggtgggtagcacactgtccttacctgggggacagcaggcctggtcaccggcttttctccctgtccctgcaagcatcacattgctggaagagaatctcatgccagagcttggaccatccctagcttgggggttaggggttgtctcttggtgacctaaatgaaaaaataggtccagatcagagttcgtgatgcatagcactcacccactctttgaatcatgggaggggaggcctagtcctaggtaaacctaaactctttgaggaaccacagagcccaaggctggaaacctccagaatcctccagcccctgatcccccccccccccggggacctctgtggcctgtctcaccagagcactcttctgtctgtagaggtctcaggtgctctacaagggagtcccatttcaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggtaagctgggtttggtaccccttcctggcttcagaaagaagccaaacaaggagctttctgcagaatgaaacctcttttccatccagaagcactgctgactgtttggtggttgctgttagggcagtgagccttttgtccattctgagattaggctggtttctcctcttggccctggcctacagaccataaaggaaaacagcaagaggtccccagcaaacatctacagatggccctggacatcagccacattcagagaaacgtgtcatgttctgggagggctaaggcatcgagtaaggcctatggggctggaggatcacagggcaggtggggcaatccagagctgtgggggcttccatgggaattgggaggtcccaaggcagaggtaggggttccacaggaggagtcacagagccaccaagggctctcctggcccagggagcagtcaacaccatggactgaacacccactgggctaagccctgggccaggctggggcatgtggggccaggaggcagctcagagtgggagacagagagacaagtgtgctcagagggcacccatatctgcatataacgtggtcctgaatttctggctgggaagtgcttccagggtttcatatgtgttatggagatgcttcctctctccaacctcaccgtgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaaggtgggcttctccgggatcttaattcaggaggtagaatgcagcttgagatctagtgtctgatcaaagaacttgaacttgacctggagggctctggggagccatggaaggtgctggataaaggaagggacagtcatatatattttagagatgactgtggaaggctgcctggaaggagtgaacaagagccaggagaccagggagggagtttgtggggcaggtctggagatggcaagggagggatcctgcttggatgaaaggtcttcagggactgtctcaggttacactcaggtgccctcagagctactgtgttcagggttcttgtctccaggatgaaaataaggaggagttgtcagacaaggacatatacatggaggctggcatcttcatgagtgccaatcgtggtcctggtgtggactactgtgggagcaggggtctctccatccagggacatggtggatggaccctacatcactccattctgcccttcctttccctcccattctcctgagggactcaatgcatgggcactgtccaacctctggtgctgaagcagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatggtgggtgctgggcctcatggctgttccccagcccctctcattggctctgctccaggtggagaagggggatgatgtctctgtcagttctgctgttttagcctagaaggaaaagaagcagagcccagaagcagggcctggtacccagcctgcctaacaagggagaatttgtaggctttgtggacagaaagatctgggactccatgtcacccactaacttgctgagacattagtaaaatcagttttcttttctgaactatgtttctgtcatctgtacattgagaggaatttcttttactccacgaggctgcttggagaattagtgacagtgtgtgtagagcatgtgccacccagcaggcatttggtgtcgagaccacacctcctcccccttcattttcagcctaaatttgcattttgttcttaagactttcactcgccttaattttactctttcctctgattcccaccttatcgtctatcccatggagtcactaggatctaagtgggtaacagtcatgtatgcatgtatgtgtatgtacgtatatactttgttggtgttggagtgtggtgtgtgaatgtgtgtgtgtgtgtgtgttggagttactgggtgactgaaactgtacacatcaggctgtggttctgcccattgctggaagcgctgtcaggggtcctgccctcaaccccaggtctgacccttgcagcgcaggcaggacattctggaggaatcatgcccttgggaggatccctgaggagtgactggtgggtattggtggataaatacccctggtcccttgctctgggtatgatgactctgaagcacatgttctgtgctgtctctcagaggtacctggcagggctgagtcctggctgccacagtggaaactttcttgatgaaggtccctttaactgctgcattcctttcctgtctcagttccccactcctccactgatgtttcctgggattagcaccctaaggaagaactggcagtcgaattaatatcctagcgttatctccaaacaaaatttttgtatttgaatctttgcctcaggatctacttccaggaaattcagactaagacacacatttttcttttggctccttgaatccccataggcctgacattttgctgtttttatcaaaaaggaacatgaggatcagagagggaaagtcacttgcccaaagtcacccagctgaacagtggtagagttcaactttgatcatgagatgtctggcccccaggtggaggcttgctcctctcccatgagactccttccttatcagggtcaaatgaatgaatggaggatgttaaaagtggggtctctgatgcctttgccagataaaccccaggctcatggctggcgcctgttttctcattcttacctcattaagagtagtaatgaaaaacatgctcagtgctgaccgtgtgcctgggggtgttgtaggcactccacttactttaattcatttaattttcacaataaccttgtttttacttctagttgttatatgaaaaaactgaggcaaagagcaatacagagagttgcaaaaattcataccgctggtccaggtttgaaccaaacagtctgcacctggagtccttgtttgtaaccatggcaccctgtcttcacacatatctcatcgtggagttccatcttgtgttaggcatggcactgagcagcttcttttaagaacataatttgtagccaggcgcagtggcttatgcctgtaatcccagcactttgggaggccgaggcgggcagatcacgaggtcaggagatccagaccatcctggctaacttggtgaaaccccgtctctaataaaaacacaaaaaattagctgggcatgatgattggcgcctatagtcccagctacttgggaggctgaggcaggagactggcatgaacccgggaggtggaacttgcagtgagccgagatggcgcgactgcactccagcctgggcgagagagcaagactccatctaaaaaaaaagaaaaaaacatgatttgtaattatgtaaattactaattctacttcaaagtgccacacagccttcatgtgataaaatgaagcaattggtaagtctaagcattgagaaaaaacattatttttcccagctccattgcaacagttgggacagtgttttctctgtgcctatagaaacctcagctagtgtgccgaggagtctggtccctttggggaatgtggcagtcaggttctggcagggacctcgaagtggctggtaatgtctttcattaccaccaccacgtgacctggtcttacgacctgttagcttccttcatcaggcatgagcaccaggatggcaggggcctcatctgtcctgttcctcctgtggcctgggtcctagcaccatgtctggtacagtgtaggtgctcaagggaagtttactttatagaactgtctacctgggagatgttgctgttagtctaacctgtaccattttgtaaacctgcagccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaa

SEQ ID NO: 797 - DNA, 998 bp, Homo sapiens
tgcggccgcgccccgcccccagctccccgcacgctgcccctcccgctcgtctgtcccgctggcggcccagcgtgctggctgtacgcgtcacttccggctgtgtcggcgcgcgaaaaaaggtcctgggttggaatgtttgtactggtctgtggcggtggttgtcggctgtcctgccaggaaaactcggcactgactatcccactgctgatgctgtaaaagaggtccttctgctatgacgcaactgtggttcctctggttctggggacacttaggcctcgcgtgccgattttcatagttccctgtggctccgagccgagggagccgcggtgtggaacggagggaaccagtgatctcagtgctgaagaaaacagggagtgtgtgtcttcatacttgatttgccttaccgcaggggcataatatgagatatctgggcgtgttaagtcgttcttgatgaaatgtgtcctctgtgaatgtagtctcactgttagactaggaagatgctgttttgctgtgcccagttcctcttaaaagtacagatgctccttgggttgcagccgtataaacccatcctaaatagaaaacgcgttttaatacccttataaacgaaaaggataaataagcctttgggttctgtaatgtgagccagcattctttgagtgcgtatgtgacaggtaaatgttttacgtatattaaactcatttaatgttcataagttctaagtgcatcgctacaattattacaaatgaatcccattttacacaggaaccaaagagaagtgaaggaatgtgtccaagggctcccaagttggcggtggaattagaattgaagcctcagctccaaagcctgtgttctgaactacccggttgcagttcacaaaatacactttggcagtactttcataacgaaaacaaatgattacaaccagtttacaaatgctttgctttactggaggatcgacatgtttgactaattttcaaaaataaatctcagaagcagca

SEQ ID NO: 798 - DNA, 10310 bp, Homo sapiens
aggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccaggtaacttctgatctcataaagaacacactcaaaggctacccacatcaccatttgctgcaaaagaacagaaatcctttacaatgctctgtagccacattatttggtagaccaaagtaacaaggcccagacacatgttattcccatggtttcaaagcctctttggcctttagcggttttccctcagcctgcccacaatcccactccttattagaactttcctactccatttttccccccctttctctttaaaaacagccttgtagcattccataaaggtttcttataaatgataaatactgtaatgttggggacagaaaatgggctcagacctgaattgaatccctaactccactacttgctgtgtgaccttggtcaagttactttacctctgtaagcttcatgatcctctccatgcagggtttgagatgatgtatatattaaagtacctcatacatagtagttgttcaaatgatagtttccttttcctttaccttgaacctagtacttaaatatttgttgaaggaattaactcctgaggaaggagcttgggaaagagccgacagggattattgcacaggtaaggaaaagaaaggaagtatgcaaagacagcgttgggtgggttttcttgatgagcatgacagaaaccaagtcaaacttctatcagttttccagggggaggccctgggaaaagaggtctctatggtcagatgtcagtaagagccaccatttgctgagtgcttcttgggtgtcaggggttgattcatgtaagctgaaccaccaccctacacaacggatagtatacagtagatagcgtcatactccccattttacaggtgaagaaactgaaatacaaagttaggcccttgcccacatcatgccttagtaatgatgtaaaggtagctttgaatcaaatctgattacagctcttctttcctgcaggacttctcagccttgaatgttcaaatgtatactttgactctcaaagaggagtgaaggtgtaacattttcccaatttatttgaccacagaatcctgactttgaggaacacttagtaccttcttaatgaacacagtgttccataaaacatgggaacccaccagaaatagccctcaggcctgcccaactctgagacctttcactgatggccagagaaagtgaggaccttgggaaacaaatcacacagtctgatatctccccacatacccagtggagcccctgacttaccagaaatggcatcaggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttcaaaataaggcctgcagaagacaggaaggaaagccatcagagtaatataatacagtgaccacagtcaactccacaagatgaacaagaggcatcagctaccactggccaggtcgtccttccaatatttagtaaactcttaacaaggccgtgacatgtcagtgatgctcctagctctggagactgacagacaccagatggaacgactgggctcacccagggctatattaacaggaggcccatctcaagacacggggaacccacacacacatatcttggggactctgcaacttagctcatgttcctcctctgtgggaaggctgttcagagcctcacaggttatacccagcagtaagggtggcctggatctgctctcctaatgaagttggctccccagggatgaagagcagctgaggctggagaaggggctgcttaaacctcctcctctactgaagtcaactggggaagagagagaagcaccactcctccctcacagcacagcaaggccaccactaggagggggtctcaggttggtcctcccaaaccttgtccaaagactggagttattagttggctgactcagccacataatgggcccaagaaatgccagcgtcctagcagttcccttggttctgggtcagctgaaagagcttggctcttttttaggaactttggtgcctgaacattaagagtagatcactgctttattcttgagctgttcaccctccatgaagctctcaagtcctgcatcctgaggatccagatggatgacaaggacacaggactgccattggtgggtatgaaaatcctgaaatttggggggagagagaggtgtataagctctctcgtgtgaccaaaaggagcacaaggtgaagagtatgtgtgtgaatgggcatcggagggcacagggaagatgtcccagcaaaaggaacatgagcatccatgcaagggagtgtggctggagaggcagggtgggcatggaggtggcctggaagccactctgtggaatgcacagatgtacattttaacctttgggcagacaggagccacccaagactacgatctatccctgtactcttctcggagtctgaaaaggttggcaaagtacaatcacaagatttattttcttaaacaggttaatggatgagtatgtgatgtgtgtgcagtgtgaattcggggtcttttgagaaaagacccaccatattcacaccaaaggaagcagcatcaaaggctgctcctcggcctccttgggtgttggcatgtggatgatgcctgggcttgcccagagcaggcacaggtcctacaacaaccctcgccacctcctgcctcccctgcagaaaaatgccatatacacgtctactacttagctctcaggagatcagcccctgacacaccaaaaaccaaaccaaaacaaaaatacactagtcaattaagtgcaatagtaaatggttaaatggtgttcctctgcatgtatgtgtacatatgtatgttggaagagtgtgagcagaaactaaagaaaagtcaagcctgggtgaaggtactggggggtagtacagagcctaggaggaccaaactcttccttgcagatcctcttcctcactgaattgtcacctttccctcacttgcatgaggactgggcatctgccaagcttccaactgcccagcccctcctggctggggctgtgaccacacctggagaacaggcattcagtagccctgcacagcctgctctgggtctatctttggctgttaagtctaggtcatcataagtcctcctccttttgctaggaggcctagcaattgggaatgaagcagggggcttgtccccaagagagggtacacagttgtgcctgcccaccattatcaatgttgtataaaaatatacagggctgtagtgagaagagattggagaaaaaaaaaaaaactctactaaagccagtcttacagcattttatcagctcttgatcacaggaaacatgtattgtgaacacaactcatccctattacactgacagataaattgagggatagggccttgacaacactgtcaaccacagatcccagagtacagcgtgaatttaccaaatcccagccaatgggccatttaataatgtgcctttgaaattcctttttctgtgtttcctaacttagtcatatctagagcagcccaccccttagcatcctctgcttctgggggtcatagaatattagggggaaagagagcctgagcaggggggctctggtgaggccccagggtctacatcaaaggactactcagggtggtccttgagtgtgtgacatacaaaaggctgagaagatgcagactaggacagccgcacggccccagggaaggccctgtccagacttacttggacttgttgatggctctcttgagtttcttctccagctgtcgcatgcggcccatggcggcattgtacctggctgccgtctccttatgcaccagctcgctcctggtcttggtctgctccgcctccatgaccttaaaatgacagcagagttcagcccagtccagcccagaacagcccaggcttggaatattacttatattatttttcaaaaaatattctttgcccgggcatggtgacacatgtgtaatcccagcactttgggaggccaaggtgggtggatcacgaggtcaggagatcgggaccatcctagccaacatggtgaaacccgtcactgctaaaaatacaaaaatcagccgggcctggtggtgtgctcctgtagtcccagctactcaggaggctaaggcaggagaatcacttgaacccggaggcagaggttgcagtgagccaagatcgtgccactgcactccagcctgggcgacagagtgagactctgtctcaaaaataaaaatactctttgggccaggcacggtggctcacacctgtaatcacagtcctttgggaggctgaggtgggtggatcgcctaaggtcaggagtttgagaccagcctggccaacatggcaaaaccccgtctctactaaaaatataaacatttgccaggcatggtggcacatgcctgtagtcccagctacttgaaaggctgaggcaggagaatcacctgaacccaggagatgaaggttgcagtaagccgagatcacgccactgcactccatcctgggcagcacagcaagactccatctcaaaatatatatgtatatatagatatctatatctagatatatatttgagcaaattagtggtcagactaagaataaaccaacttcccaacagtggttttcttttcctatttatctattttgaaaaagccttgtgaggaaagattaaatagctaaattggctgtggcaatgactgagaaagaaaatggaaaaacaaaaaccagaaaattttgaactattttctgattcaacagctgtccactttcttctcaggttcctcgatctaagtagccacctagacctcctcccgttcacaccttggggcaggggcctgatgggcaggcaaatggccaaatagcagcagtgggaacctaagagatggggaacctaatggggagaccaccaaaaccaagaactaggcatcgtgccaggcacgatggcagtcaagccagcaaagcagccatgacttccattgtttggtcctttcccaaatattctgaactagttggctgtgcacagaagaactcaggatccagaaagggcaaactttacatttaagcaattaaattaaaacccagtcattcacatcagattttgaggtacacaaacatttgtgagcagaagacaagtcaaagttctggtgggaaattctggtgggaacactttgttaagtctgttgaaaaaaatgagttacaaaaccaatactcaagggccctcaatggccaaaaaacaaaagcagctcacaggcccagtcccagagacatgggcaatgttaattctctccttgcttacctacagaaaagcatcagaacaaggcctgccttgaagaaagaggagggaaacaaaccgcagttcaggccacataagcagcttgcgatttctttccctgtcttctgcctaccactcagtgttataaaataaaccggagagacagtagaggttaggctaaagggttattctctaattctgtattctctggggagcatccgagaggagcccagagggctcatggtcactagtcagctctctcagaccccgtagaacaattttagggaggtaccaccatgtctttagttcacagttaaaaaagaaggccacagaggaaggttgccaatgttctaccatctcctccagtcaacagccacaatcagccctaggatagtttacttattacttacgataaggatttttaaaggtaccatgaaaaattatgaaagacttttatatgggcattaaaaattacagggtgtcctgtctagggcacccttccaggctatctctgactttgtcttgaagctgttttacaaccctgtaagttgtagaaaactgacagtaatacaaatggtttttttttttttccagagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaa

SEQ ID NO: 799 - DNA, 49542 bp, Homo sapiens
ttgccagctttatacctgcacaaaaacgaagagatgacatgatggatccaatccaaccaatttgctctgaggtgccttcaaactcttcttgaaagaccacaaagaaaattgcaaaagtcttggtcatccccatcacaaacacattcacctaaatcaaagcagaccagagtccaactcaggtggtaagtgagccattacagaggcaattacggctactagaagttatgattccctcagcttactactatttaccagtttgccttattggttgagcctcattatacatcttatattttatgggggaagtcattccttttaaagtagctaagcattttaaatggaaacatctcatttaatcctcatttcatggctttggaataggcatgccaatgttgtgtaccaaataatttataccaaataaaccacccagtgggttcatcttgcctgctgcctagatacagttgatttatcaagacaggaattgcaatagagaaagagttattcccacagagcccattgtgcaagagactggagtttattagaccaatcagtttccccgagcttttggggatcagagtttttaaggataatttggtgggtgggaggccagtgagttgggagtgctgattggttgggtcagagatgaaattctatcaaagctgcccttttgcgctgagtcacttctgggtggaagggtggagggggacccacaaccagatgagccagtttattaatctgggtggtgccagctgatccatcaaatgcagggcctgcaaattatctcaagcactgatcttaggtttcacaatagtgatgttatcccccgagcaatttggggagggtcagtcttgtggcctccagctgtatgactcctaaaccataatttctaatcttatggctaatgtgttagtcctacaaaggcaatctagtccccaggcaggaaggaagtgtttttttttttttttggaaagggctgttaaaaggaggtttttttttttttttttttttttttttggaaacggctgttagtttctctttcaaagttaagctatcaactaagtttcccccaaagttagttcagcctacgcatgggaatgaacaaggacagcttggaagttagaagcaggatggatggagttggttaggtcagatctctgtcactgtaataattttctcagttataactgcaacagcagttccaagatcaggaaattgaagtttagagaggtaaaaagttgcttaaaataggggtactggaactgagatttgaacccagattagactgactctagacctggcactcttttactgccctcagtagcatctgttaaagacagctaattccagttacctttgtgggagaaaagtgtttgtccaaagaggaataattattcctgtcagttcttagattagttttgatttaactctgctgctgagctgagtaccttccttcactagatatataaataggttgaccataaaatgtatcatccaaattgagacactcaagagtgaaaaggggtgcttaattttggattaactgggatttgtggccatcttaaggttgggccaggggccccatccttttctttctgccccacctaatcttccttacctgtactccactagaattgctgctttggagatgaggttttctttctgtggagtattaacttttatttctcagaattctagttagccggggggctgttaagtgctattccttctttccgtttttaagtaacagtcatgctttatcccacaggggtctagaggggaacctagccagggtttgcattcactcgtaaagcccaggtgtactctctgtctccaggggtttcgtagcgttggcttttcaaggccacttctgctttcaacctggccatgcattgcttatgaaccacaaaaccagctgggcatggaggctcctgcctataatcctagtactttgggaggccgaggtgggtggatcgcttgagcccaggagttcaagaccagcctgggcaacatggcgaaaccccgtctctacaaaaagtacaaaaaattagctgggcgtagtggtataacacctgtagtcccagctacctgggagggtgaggtgggaggaacacctgaacctgggaggtcgagggtacggtgagttgtgatcacactactgcactccagcctgggcgacagtgagaccttgtctcaaaattaataataataaaagaaccacaaagccttaggttccccttcattaattccactttctcggcccgcctgttacagttctgtactcatctcgcttgatatctgctccctggacaatcatttactctcaaggttttaattaccacctgcatacttatggtggtgtagctgaacagggttctgcaatcagtctgccttaacttgcatccaggctgttcttcctactggggcgtgaccttgggcaaacaacttcgcacgtcacatgggttaagcttccgcttttatgatgggggaggcggcattggggatgaaaatattacctagctcataagactgtgaagattaattgagaaaattctgataaagtacttaatatttggcacttaacactcaaacaattaactgtggtttccattctgctttcccaagagcttcagactcctaattgtctaccatatctttataacttctggtcaacttgtccaaacataaactcacatttcccttatcctatgcctactcttttcagttttttctattggtaccatccacccattcatttgagtgacagatgtgctttctcttagacacctccctccctcagcccctgcttttaaataatggtcaagacctgcccccttcttttcaccccatcactactggcgatgctcagaaattgcaaaagtggtagtggtgaggaagaagtctcttaatatactttttcccattctgatttgataaaaggaacaaaacttatttagaatgaagagtgctataaacgccaggactatatattcaaaagttaaaaagacattttatcaggcccccattgaggcaatttataaccataattttcctctaaggcacttctgtcaggctagaaattaggttagaaaatatacacagatctcaaatgacttagactttcttctctcagttcataataatgtgatgattgtgtcctctcatgagcaaggaataatacagtgcatcattctgtaaagtaaacttccttttgttctatggacgtgggttctgtgctggtgtctagaggatgttgacctctatattcttagctacctaaatttagctagctactggtcccccagttcagagcttttcatctctggtctgtccttggtgtctgcgtgtagcagcagtgaatggttaggacttgtctctaataactgagtccgtgtccactatgtatcaagaagaccaagggcagagcctttgcacctaccatgcttcccgtcccttaacttgaagtcttccaactttgtttcagttttgactcaaagatattaaaaatctctcccaaggtctaggtttttccttagttaatttagcagactacataaatctgcattattctacataatcccatgtcttagaccaagcttggtgggttttagttctgttaccagagtccacgtcatacattgtaaatggctcactccaaaataaagcaaaaaccctagaacttctccagtcccctcattttctttttgtttttaagagcagttaattgggttgaacctggcaggaacaccttaagcaggacttcccccacaccccacctccaataagagcttcctcactagatcattttaattattgtctgggaaaggagttggatcagcctcagtgacttattttcaatacaggcaccaggctttgtcagagttagttttatctaataacaacttcttatcctgcgtccttttctagtatcaccctagctcctcctgaccttcacaggcaaacttctgtaaaaaatggtctattaggtatctccactttctgtcattctgctactccactgaaaactaaagttcactaactttggcccccactgctccactgtactagctcttatcaaggttattagatttctttgttgctaaaccaatagagtcttgttatttctctcctatttgacctctcagtagcatctgctcgtcacatttctctgaaatgcaaatctatcacatccctgcttaatttttctcattagcttctcatagcctcaagagccattctcatctcttcagtttcatcaactatccccttcatccttatttgtttattcataaatgtgtgcagctatcaattcatccatccatctatccatccaccaacagtattttactgagtgcctactatgttccaggctgtatactggcactgggcttacggtaatgagcatatactcatgagcaatgcagacatagaccctgcccccatggaacattcagtctagtaagacagactgaatacagaaaacagtcatacaaatatataaagtgtggtaagttggttagaatgaatctctctctctttttttaagtaggaagctcccaaagaacattgttatttttcacttactaggagctcatctgttatagaaaagaacagttgtaagtcatacagaaacaaaagcacagtcattcaagtatccacattacaactgtgggggattagcccctgaatttattgttaacattttgaggatccagtgcattttttgtgcttagtaagcagtatcacaccctaaaagtgggacagtgtttattaatctggttattagatggtttttcctatcagcaactaaattgatcaaaaaccattctatcctcagaggataatgtagaaaaagtcagggtggttactggggagaaaggcaggagaattagagatcctcaccaacagtgcctattctgcaaagcctatgatttaggggggtggcccagccccaggaagggctctcagacttagggcatcctttagtttccctattagtaacatttctagggggaaaatgagattgtttagtactgaagctaatgtttagcaagtactactattatgtgttaagagttttgtattacataaatcctggctggggacctctgcccctatcttgtctagcacgagggaggaggcctgatgttttcccaccatcctatttgtagaattcttagatatctgcatgtgaactataggattattagaaggcaccaagacctgtgctacctttccccgtgagctgcttactgtagggctgagtaggggggaagtgtcggcaagaaaagggtgtttttttttgagtgcatctcaaagttaatagaactctggaaacacttaagaattgtgcagctggtgccactctctggagagctgtgtggggcatagctggggttcaccaacattctggaatgggcatgctgatgatgcagatcaccactctcacacctcaacccctgggagggtgagggaaagaagttaatttaaaaaatggaatgcctcgtctagttgcttatgggtaaaggagaagaatcaggctcccccttcaaaatccttgtcctccctttccaaacacatcggaaatatagatagcataaactatagttagtggggatggattgggaagtagacagcaggccaaacagaggaaatgtccccaccccttatcggtagaaggggctgtgcccacagtgttctatctatgctgggctgaactggggagatcacccccagagcactttttagcacctcccagtgctacttttgggatggttaaaagtatgattgtccccaaaccctaattgccatgcagccagtacagaactgctgattgtgactgagcattctcaggtttaagagatgataggaagagtagatgactggattcaggaacacttctgtttgtttgttttgagagagtctctcatggttgcctaggctgcagtgcagtggcacgatcttggctcacttcagtctccacctcctgatttcaagcaattctcctgcctcagcctcccaagtagctgggactacaggtgcatgccactgcactcagctaatttttgtatttttgtagtgatcgggtttcaccatgttagctaggctggtctcgaactcctgacttcaagtgatccacacacctaggcctcccaaagtgctgggattataggtgtgagcccccacacccagcccaggaacatttctgcttttgctctaggggcattttcaactttctcctgggttcggcatgggcctctgactttagcagtttttggcagctcctggccttgttcctgcccacccctccactcagatgccaaagatttcctaagtgatcctattcgtaggcagctctgagcctttctccagaaagcctgcttttaggcaataggaaagggggaaaaaagtgaattcttaccaggaaaaaatgaatcacaatcatccatccccatcctccatccagggttttagtgtaaggttggaccttcccctccctcttcagcatgatgcctcttctattttaaatgcagaagatccctgtgataaatccaagacagttgattcagtggaccagaaactaatctaaacttttaaactttttatctgaaagggaacgttcatacattgttggtgggaatgcaaattagttcagccactgtgcaacgcagtttggagatttctgaaagaaccaaaaattgaactaccatttgacccagtaatcccattcctgggtatatacccaaaggaagataaattgttctaccaaaaagccacatgcacttttatgttcactgcagcattattcacaatagcaaagacatggaatcaacctacgtgctcatcaacagtgggttggataaagaaaatgtgatacatagacaccatggaatactacacagccaccataaaaaagaacaaaatcatatcctttccagcaatatggatgcagctggaccattatcttgagcaaattgatgcagaaacaaccaaatactgcatgttctcacttataagtgggagctaaaaattgggtacatatggacataaagaggggaaccacagacactggggactacaagatagggagggaggagggttgaaaaactccctattggatgctgtgctcactatctgggtgaggggttcaattatactccaaatctcagcatcagacaatatgcctttgtaacaaacctacacatgtaccccctgaatctaaaataaaagttgaaatgtaatacaaaacagaaaaaaaacctctttccctatgatataaaaccacttgtaatttttttttaacccctcagttacagatgaagtctgcctgatgcaactaaggacttagttacctggaaagcctgatctcagtgactgtggggtggccactcctagaactgtactcagtgtccctccccccaggtctgcaagccagtttcttggagaagctgtgcgtcaccctgctggtcctccgggtgaactcttaagagaaatagaaagggaaggcgagccttgagtttaggaattctccttagaaaacacttgctaaatgtaaatatttttggagctaaacagacatgacaacgaaatgcgatacccgcttattgaatatatcctagatcagaaaaaaaagttgtaaaagacagtttgtggggacagttggggaaatttgaatatggactgtataatacagaatactgtaccaaggttaacctcttggaacctcttccacaagagaatattcttaggagatacatgctaaagtattcaggagtaacatgacactatgctaccttctcccaatcggttccgtaaaataaacaagtgtatataaagaatgatagcaaaaagaaaatgtaaatgttctgaggaagggggaacagtactcattatttcccctgtcgggtcgaaggctgactgtttctaactggaaaggaaagtcagctggcagggtatgcggaatggccatctggtgagcaggctgggtggggagagatgccagtcgttgttagaaaaccaacccagcacacagtcccattcccatcttacctttgatgtggtgttcagcaaagaaatcctccacagatggggcaattaaggaagaaaaataaattacaccgttttctggaatgttactctttttctaaggcatttcattttgctgcattgtgaaaacaagtgagcattgtaagagccaaggagggctcagacgatttaggccctcctgctagtggactttacttcctgaggggaggaggaaagactgtgatttgatgtcatctcaggccctccctccacccacagtcactcagaaggtagaattttttgccgcaggctcaaaagcaagcatgaagtaaactaagtggaaagtccttttggcgactatgctcagggcagggggatggggctccagagctctcatacacttgtcttcaaatttcctcagggaacttctcacaacatgcttattttacaggagaatataaaactcctggatgggtggtgagagaggcatttcctgggccacaaacagaaatcttcagtaagctcaacccattcgtgtggccttttgtatattgactaaagattctggttactaatttggggtttcagaccccattttaattgcatttttgagatctgattacctcaaccacctcctgcaaaagacgtatgctcgtagtaattttaatgagattttttttattatattttggaaatggttaaggctgagacccctagaaaattactgggataattcaactttctcttcccatttcctccctctaccctccacataaaacaaaacaaaacaaacaagtcaaatgggaaattgtctttcgtctcccacaccaatattccagattttaaaccagagtatattttagacgaaaggatgtgtttttagttttatctggaaaatctgcacatatttatgcatgttcctttttaagaagcaagaggcttctcagattcttaaaatcaaactctataatactttttgattaaagtgcttgcagaaggacagcttagtggtttgggagggtgccctgtaagtgtaagcatggaaggattatgcagttacatgatgctggtggcaaggatcaaataaacattcaacagaaggagaaaacccaaagagagaaggcaaataaatgcttttcagagagctgtttgtaattatgaatacactctagacaacttttttttttttgagacagagtctcactctgtcgcccaggctggagtgcagtggtgcaatttcggttcactgcaacctctgcctcccgtgttcaagtgattctcctgcctcagtctcccaagtacctggtactacaggcgcataccaccacgcccagctaattttttgtattttagtagaaacggggtttcaccgtgttgcccgggctggtctcaaactcctgagctcaggcaatccgcctgccttagcctgccaaagtgctgggattacagacgtaagccaccgtggccagcctgaaaacattttttagtaaacaagactgatttatttatttttttggtggcacgcttgttgctcttttaaagcagggctatctatgatttctttttttcttgagacagggcctgctctattgcccaggctggagtcagtggcataatcatggtttactgcagccttgacctccccagctcaagcaatcctcctacctcagcctcctgagtagctgggactacaggcatgcaccaccatgctcagctaattaattttttttttttttaagagatgggggtttcactctgttgcccaggctgtttgcaatgtcctgggctcaagcgatcctcccatcctgacctcccaaagtattaggattacaggcataaaccactgtaaggagccagctatccataattctaatcacaggatgaaatgatgctaggctatatatatatttttcttacacacacacacacagaggaatatatatatacacacatatacatataggaacatatacaactgggaagttagatttcaggagggttcctaccattccttaaatgataatagtgaatcattgtgcctaacctatgtaaacaatacattatatatgtgtgtatatattcctattcatctttgtcttataataggctttatattgatagagaactctgatgctaatgcctggggtcagatttgaaatgcggcagaacagcaagtcattcatagaggccaagaggacagcaaagtaatcagagatgaacttcaaacatatgtttcatagaggcacatgaacagaaatgcaggcttggtgataatctcaattttgtcagtttttaagcccgtagactctgggcaatttactctctttgagtctgtttctaaaactctaaagcgtagctaatattttgcaaggttgttgtgaggattaacaatatataatgtaagatgactgcacattggacctactattggtacttggttcatgaaaaataatttttgttagtcaaatgaggcctaatagcaagaagaaagaattcttaagccacctttgggatattagttaacattttggcatctgtacccaattgtcttaataaagcttgtagggtctttaacgaaacataaacaattccctcaacttctaaccttttaactcttggccctaaagctattcagcaagaatgcagcatgatttggcaatcaccactattacccccatcccagtgtcaaacatagccagcccaggaataatttttaacacttatggatttagactttaataagctttaccaactagaattaagatactttatttttagttgactctctccttgccctcattcaatccttgttcagaaaagagttaacatcgctggcctgagattcctattctttgaaaggcctgtttacatggttggcctctggctggcaactgggaacttagatttcaggagggttcctaccattccttaaatgataatagtgaatcattgtgcttaaactatgtaaacaatacaatttttatgctgaacatttgcttttttcgggagcttggaattttgatatgtgctaggcagagagggtactttggtgaccagcccccttgggcactgagtctctactaagctttctggattggcaacatttcacacatgttgttacaactcattgctggaggaattaactgcatcctgtgtatcttcactgatagaagaattcttgcaagcttctgcctggtttcttctggactttgccccatcctccttttgcctttgttgagtcagctttgtatcctttcactttaataaaccatgtaagtacaacaactaaatgctcagtcctgtgagtcatcctagtgaattatcaaacctgaggggttgaatgagtctgggttctcgagaaagaatagaatattctccagagcaagaaccagtgatgggggaggagatattaaggttgatttactatgagaattgactcacatgattatggagactgaaaagcctgcactctggtcagcaagcgggacactcaagagagttgatggtgtagttccagtctgagtccagaagcctgaaaaccagaagtgctgatggtgtaagttttagtctgagagggcctgagaaccaggagagccatttgtgtaagttccattctgagtttgagtccaaagtcaggagaagactgatgtcccgactccaagacagtcaggcagtgagaaattctttcttagccttttattctattcaggcctttaatggattgcatgagttccgctcacattggggagggcagtcttcttcagtctactgattcaaatgctgatctcatccagaaacaccttcacggttacaccccaaaataatgtctagccaaatacctgagcatcccatagcccagccaagctgacacataaaattaactattatagaagtgtcctgggactccctcatacaagcatacttcagctttggctctgtacagactagaaaatgagccttttccagcctcaagctctttccagcacatcttatgtttcattgataaattggatacattatatcctacctcaaagggtgctgtgaagaataaatgagaatgtatgttcatttatttcattcaataaaaacaattgcttcctatgtgccagacgctgtgccagagggggatatgtggtagacacagggtggcatgagatgtggcccaaggggttagcagggcttgaattatgcaggggttgggaggtcatggttagaacttatttttttttttggatacagggtctcgctcagtcacagcccaggctggagtgcaatggcacaatctcatctcactgcaacctccgcctcctgggttcaggtgattcttgtgcctcatcctcctgagtagctgggatcatgtgcaccaccacacccagctaatttttttggatttttagtagaaatgggatttcaccatattggccaggctggtctcgaactctggacctcaagtgatctgcccctctcggcctcccagagtgctaggattacaggcatgaaccgctgtgcccagccataactttttaattctaaatgcaatgggaggctgttcgtggtggctcatacctataatcccagtgtgcccggaattggtgggttcttggtctcactcacttcaagaatgaagccgcagaccctggccgtgagtgttacagttcttaaaggtggcgtgtctggagtttgttccttctgatgttcagatgtgttcagagtttcttccttctggtgggttcgtggtctcgctggctcaggagtgaagctgcagaccttcgccgtcagtgttacagctcataaagacaatgtagacccaaagagtgagcagtagccagattcattgcaaagagtgaaagaacaaagcttccacagtctggaaagaaaccacacgagtttgccactcactgctggctcaggcagcctgcttttactctcttatctggccccacccacatcctgctgattggtccattttacagagagccgattggtctgttttacagagaggtgattggtccattttgacagggtgctgattggtgcgtttacaatccctgagctagacacaaaagttctccacatccccactagattagctagatacagggtgtagattggtgtatttacaaaccctgagctagacacagagtgctgattggtgcatttacaaaccctgagctagacacagagtgcccattggtgcattcacaatcccttagctagacataaagattctccaagtccccaccagattagctagatacagagtgctgattggtgcatccacaaaccctgagctagacacagggtgctgattggtgtgttcacaaaccttgagctagacacagagtgctgattggtgcacttacaatcccttagctagacataaaggttctccaagtctccactagactcaggaggccagctggcctcacccagtggatctcgcactggggccgcaggtggagctgcccgccagtccagtgtggtgcgcgcagtcctcagcccttgggcggtggatgggaccgggcgccgtggagcagggggcggtgctcgtcagggaggttcaggccgtgcaggagcccacagccggccgtgggggtagactcagacatggcgggctgcaggttccaagccctgccctgcggggaggcagctaaggcctggcgagaaatcgagcgcagcgccggtgggccagcactgctgggggaccccgcgcaccctccgcagctgctggcctgggtgctaagcccctcactgcccggggccggcagggctggcgggccagcctctccgagtgcggggcccgccaagcccacacccacccggaactctagctggcccgcaagcgccgcgcacagttccgggtcccgcccctgcctctccctccacgcctccccgcaagccgagggagccggctccagccttggccagcccagagaagggctcccacggtgcagcggcgggctgaagggctcctcaagcactgccagaatgggggccgaggccaaggaggcaccgagagcaagcgagggctgcatgggctgccagcacgctgtcacctctcacaggcactttgagaggccaaggtgagtggatcagttgaggccaggagtttgaaaccaacctggccaacatggcgaaaccctgtctctgtgcaaaaattagccaggtgttgtggtgcatgcctgtaatcccagctacttgggacgcttgaggcacgagaagcacttcgacctgggaggaagagggttgcagagagccgagatggtgccactacgccccagcctgggtgacagagtgacactctatttcaaataaatagatagataaataaataatgtaaatgcaatgagaggctccttaggggaggtttagcattgtgcctggtaaacagcaagcactcaatacatgcttgctattaaggattaccaccaagatgccctgtcaacatctaaaatcaaacccagtcatcttttcgctgttattgagttcactgcttttttctaagacacccagttctatcgcctagactagaaaattcaatcatctttaattcttcattctcctttattccctttctgccaaatttttttattttattttatttttttgagatcgcattttgcttttgttgcccaggctggagtgcaatggcgcgatctcactgcaacctccctctcctgggttcaaggaattctcctgcctcagcctcccgagtagctgggattacaggcatgtgccaccatgcccagctaattttgtatttttagtagagatggggtttctccatgttggtcagactggtcttgaattgccgacctcaagtgatccacccgcctcagcctcccaaagtgctgggattacaggcgtgagccaccacgcccggcctaatttgcttttttttgtctcttacatttgatcctgagctaatgatcttgtggagcctatttcttctctaaaatggggataataccttgtaagattgaggatcaaatgaggtaaatgaatgtaaattgcttagcatgtggcaaaaactcactaaagattcactgttattactttgggctaggaactggagatacatagatgaacaaaaggaagctcaccttgaaaaaaatgagctctttctacaaattaattttgtttttctttgagatggagtctcactctgtcacccaggctggagtgcagtggtgcaatcttggctcactacaacctccgcctcccgggctcaagtgattctcctgcctcagcctctcaaagtagctgggattgtaggtgctcgccaccacacccagctaatttttatatttttagtggagatggggtttcaccaggttgaccaggctggtcttgaactcctgacctcagatgatccagctgcctcggcctcccaaagtgctgggattataggcgcgagccacggcgcctggccactacaaattaatcttaaaactccacctttactctcacctgctccaaaatccaatctgctaataagataaagcctagatttcttaaaaagcagatattcagtttccttgagttagctgccctacctttcagctttttcacttcctacctcacagaccaaactaaggcatttgctattacatattccttttggtttatccactcttcacactgccatttcctcttgctggaaaccccatattccttttactgcaagcatccattcattctatctttggaggctcagttcatactacaaaactcttttgtggggccaggcatggttgctcacacctgtaatcccagcaccttgggaggccgaggcgggaggattgcttgaggtcaggagttcaagaccagcctgggcaacacagcaaaaccctgtctctactaaaagtacaaaaattagccagacgtggtggtgtgcgcctgtagccccagctactcgggaggctgaggcacaagaatctcttgcacctgggaaagcagaggttgcagtgagtcaagattgtgtccctgcactccagcctgggcgatagagcaggaccctgtctcaaaaacaaaaaaataaagaaaacctcttgtactagttatatactcatctattcagcaattattcagtgcctactctgttctaggaactgttctaggtgcttaagatatatatgtaaataagactaaggggctgggtgcggtggctcacgcctgaaatcctagcacttgggaagccgaggcaggtggatcgtttgaggccaagagtttgagaccagctggcccaacatggcaaaacactgtctctactaaaaatacaaaaattagctgggcgtggtggcgtgtacctgtagtcccagctactcgggaggctgaggcacaaaaatcacttgaacccgggaggcggaggttgcagtgagccgagattgtgccactgcactccagcctgggtgacagagcgagactgtctcaaaaaaaaaaaaaaaaaaagacaaagcttttgccctcaaagtgtgtacattattggggaaatcagacataaaacaacatgtatgtcaggtattaataagtatggtgaagaccatacatatatatcccatttattaaagtacaagctcaagggctggagctatgtcttactaaaaatctttgctttctcacatagcaccttatatttgtagatgcttaatatttttggataaataatatcctggaggtttttatactgtcaaatgttaaatcgctagagcaacagaactacattcaagttcaacaaatcagtcttttgtgcctgcttgtgcacaattccgttgagaactataaaggttgaagcgaacctttttttttttttgagacagtggcttgctctgtcacccaggctagggtgcagtggcacatcaacgtcaaccttctgggctcaagtgattctcctgcctcagcctcccaagtagctgggactacaggcccatgccaccatgcctggttaattaaaaaaaaaacattttttgtagagatggggtcacactatgttgcccaggctggtcttggcttaagccatcctcctgccttgacctcccaaagtgttgggattacaggcatgagtcactgtgcccagctagaccttttcaaatgtaaaaatttattttctagccaacatgtcctatttggtggtctgggtgttaaagagtacagactcagctgggtgcggtggctcatgcctataatcccagcactttgggaggctgaggcgggtggatcatgaggtcaggagattgaggccatcctggctaacacagtgaaaccccatctctactaaaagacaaaaaattagccgggtgtggtggagggcacctgtagtcccagctactcgggaggctgaggcaggagaatggcgtgaacccaggaggcggagcttgcagtgagctgagatcgtgccactacactccagcctgggcaacagagcgaaactccgtctcaaaaaaaaaaaaaaaaaaaaaaaaaaagtacagactgaattggagtcccgagttcaaatgatgactggtaatttcatagccttagttacacaaacctaagatagatagggtaagtaagagtacctactgtatagggttgttaaggataattaaatgagttcctggcatatagtatacttgatccttgaacaacacgggtccacttacacatgaattttctttcacctctgtcacccctgagacagtgagacaaaccctccttttcagcctactcaatgtgaagatgacaaatatagaccttttataatgatccacttctacttaatgaatattgaatatattttatcttcatagttttaataacattttttctagcttactttactctaagaatatagtatataatacataaaacagccgggtgcggtggctcattgcctataatcccagcactttcggaggctgaggcgggtggatcacgaggtcaggagatcgagacgatcctggccaacatggcgaaaccccatctctactaaaaatacaaaaatcagccaggtgtggtgtcgtgcgcctgtagtcccagctactctggaggctgaggcaggagaatcgcttgaacccaggaggcggagcttgcagtgagctgagatcgcaccactgcactccagcctggcgacagagcaggactctgtctactgaaaaaaacaaaacaaaacaaaacaaaaaacgaaaacgtaaaacatagaaaactcgtgttactgtttaagtcagtaggctactgaggggtcaaaagttacatgtagatttctgactgcacaggggtgggatccatggacatacctgtgagaatgtaggtatttcaggaagcttcttaaacaaaagtaatttagaacaaagaccttttaaaaaaattacagtttgataactgaacaaaaggaacatttggttaagtttaaagaatctagaaaagatccattttcctccaaacagatttattgaatacagcaaaattctatatacaaagtgacctggacctgctgcttcaaaacatgatcctttcttactaatatcttgatagtcggtccatagagcattagaaagcaattgactcttaaataaacagaaaagtgcctaatgcacattaaatgaatggcctaactactggaactttagtagttctataaggtaattaacataggtaggatccagttcctatgacaggctgctgaagaacagatatgagcatcaagaggccattttgtgcactgccaccgtgatgccatcgtgtttctggatcataatgttcctgaaatgcaggaagaaaatattcagtaaaacgtaatcagtgggacttcactgcaagattaaagatgttgtttgctttaggatacaatatttaaaataatgtaattgtttctacgtataaaagcaatatttaaacataacaaaacatttgggaaatacataaacatatagcatgtgaacacgaaatgaatccttaatcctactacacacagacaaccactgttaatatttccctggttctttgtttcggttttttaggcactgtcttgctatgttgcccaagctggcctcaaactcctgggctcaagcaatcctgcttcagccacctcagtagctggaactacaaaaaaaaggctttactggtctttgttttctttgcatgtatatgatacagtcatgtgctgcataacaatgcttcagtcaacagtggaccctacatatgatggtggtcccgtaagattataatggaactgaaaaattcctattgcctagtgaccttttaaccgtcccagcatcacatagcacaacacactactcacatgtttgtggtaatgctggtgtaaacaaattgtgctgccagtcataaaaagtatagcacatacaattatgtacagtacgtaacgcttgataataataaatgactatgctatggtttatgtatttactatactttttttcttttttttgagacggagtcttgctctgttgcccaggctggagggcagtggcgtgatctcagctcactgcaacctctgcctcccgggttcaagcaattctcctgcctcagcctcctgagtagctaggattacaggtgcctgccaccatgcctaatttttgtatttttagtagagacagggtttcaccatgttggttaggctgtctcacactccttacctcaagtgatctgcccgccttggcctcccaaagtgctgggattacaagtgtgagccaccatgccgggcctactttttatcattattttagagtatactactcctacttattaagacaaggttaactataaaacagcctcagacaggtcctttaggaggtattccagaaggtatcatcattacaggagatgacaactccatgcatgttactgccctggatgaccttccagtgggagaagatgtggagatagaagccagtgatattgatgatcctgaccctgtgcaggcctaggctaatgtgtgtttcttctttgcttttaacaaaaaagtctaaaaagtaaaaaagtttaaaaaaagaatttttgtacagctgtacaactgttttaagtgttattataaagtcaaaaagttttattgactcactcagagcaacttccagtgttgtaagctccattatggtaagtgccctattcagatataccttttaaaaaatttccctataccatacttttactgtatcttctctacgtttagatacataaataccactgttataactgcctacattatttaggctacaaatctttgtagtctaagagcaatacagcctaggtgtgtaatagggtgtaccacctaggtttaagtacactctatgatgttcatacaacaaaactgcctgacacatttctcagaacatatccccattgttaagcaatgcatgactgtatgttttttctttttacaaggctgtgatagtagcagttgtatatatatactttttttcacatattattctgaggaccatcacttggaatatctttagtaattttattgctttagaagtaatttttggctgggtgcagtgactcattcctgtaatcccagcactttgggaggctgaggcgggcaaattactggagcccaggagttcgagaccagcctgggaaacatggtgaaacctcatctctacaaaaaaatacaaaaattagctgggtgtggtagtgtacacctgtagtctcagctacaactcgggaggctgagttgggtgaatcgcttgagcccggtggggttgaagtcacagtgacccatgatcacaccactgtactccagcctggtgccagagcaacaccctgcctcaaaaagaaaaaaaaaaaaagtaatttttattctctgattagttttcctttgtgctatttgttactttctttttgttggtaaactgatagcttctgccaattcttattcttcatttaaatagcattgtggcctgagagcacattagctttagggatcaacttgtctgttcctgtgattcaaaagattaagaacttttcccaaagtagtctgaataaggaatcactgatgaacacagggccggcccccgccaattttaccaggaatttttctgaacaaaaaggaaaggatctgctgaaatctactcacccattatctgattctagacacaccacaggaatatcagtggggtcagaggttagcttagctgcttgctgggctagaacagatatcactccagcatgctcatctgacagggtcccgcggcctggaaaatagagatgatatatgtcacctgattgctcatagagtatttctgctaaaataagctagctggctgttttaaaatgtctacagaattgtctttttattaatgtctgtattagtctgtatatattatagtaactaaatctcgggtacaaaagtacctataaattctaggtacgaaaattaattactaagtgtactttacaatatatttctgtatataaaggcaacacaaagttaactgtacctgaaaccaaatcaggtaatagacatgccactatggcagagcatttggatgtactattactatacaaaacattttgaccagatccgatgccgacgtttgagccttgaaggtttcttgaaggaactcatttagttttagatttccatacctgaatttcagtctttccattagtaagcctagcaaatgcttccaaaaatttaccctttttctcccaaatgactgatctgcatgttaaacataactgagttacaccgattacctctttcagttacccttccagcaaaaattcagagctttaaacattcctgcattaggagcaacaagtcttgggtttactagttgtcactaattaactgaatgctttacttatttacctttccaaacttatttcctcatgtgtaattgctaccatttattaagtattatgtctcagttctatgtaagcattttatacatattatataaccttaaaatatcgtgattaggccgggtgtagtggctcattcctgtaatcccgcactttgggaggcggaggtgggtggatcacctgagataaggagttcgagaccagcctggccaacatagtgaaaccctgtatctactaaaaatacaaaaattatctgggcgtggtggcaggcgcctgtaatcccagctactcaggaggctgaggcaggagaattgcctgaacctgggaaatggaggttgcagtgagccaagatcgtgccactgcactctagcctgggcgacagagcaagatttcgtctcaaaaaaaaaaaaaaaaaagtgattaagaggcctcagggccagacaaaaatcctagcttaacgacttactagctgcatgacctcaggcaagttatttaacctctgtgtctcagtttctttttttattttttgagacagagtctcgctcttgtcatccaggctggagtgcaatggtgcaatctcggcttactgcaacctctgcctcccaggttcaagcgattctcctgcctcagcctcccgagtagctgggattactagcacctgctaccatgcctggctaatttttttttgcatttttagtagagatgtggtttcaccatgttggccaggctagtctcgaactcctgacctcaggtgatccacccgcctccgcctcccaaagtgctgggatcacaggtgtgagccaccgcatccggcctctttttttaaattttaaaaacatatatatatgtttattgtaaaaatagagatggggggtctcactgtgttgcacaggctggtcttgaactcctgggctcaagtgatctgcccaccttggtctcccaaagtgctgggattacaggcgtgagacactgcacctggtccctcaatttctttttctacctcactgggttgttatgaggaataaaagagtatatgtaaagcacttacaatggtgcttggcacataacagctcaataaatataattctatgattattaccattatcaaataacaacccagtgaagaaaatgagggcctaaaaggtagttttttggtccacgttcacactactaacaaatgaaagagcaagggattgagaccaggtatgtccaacactgaaatcccattttactgcctattcacttcttgtttagtgtagttgagcttcaaaattgtacaccacccaccttgccgggttgttgtgaaaattaaagataatgtatttagagcctagcagtctcagcatatggcatacattcaataaatggttaacagctgttattatctgaagtcctttctagactcaatttaaaatgattcaaatattatttttagtagagacaactatttattgttataggactgcaaggaacatcttccttcataaataccaactgaaaagtttcaattttctgatactgttatttggagataatctctactctcaaactcagaaagacctggcaaggtaacaggaaataaaagctagaaaataatagcacgctaggctccaagtcaacatcagatgctatgcaattcatcaaatagttggtatgagagatacttacaacccagattaagtccttgtgaatctgtgcacaggactccaacaatggagggattcttcattctaattccaggaacacaagagagttgaagtacataatgggagaaaaaggatttaaataagtacaaacatacaggtgttctatgtaccaggcattaagtgctttaaatcaatatttctcaatcttttttcattgtcacaccctaagaaaaaaattaagttctagggccgggcgcggttgctcacgcctgtaatcccagcactttgggaggcccaggtgggcggatcacctgaggtcgggagttcaagaccagcctgaccaacatggagaaaccccgtctctactaaaaatacaaaattagccaggcgtggtggcgcatgactgtaatcccagctactcgggaggctgaggcaagagaatcgcttgaacctgggaggcggaggttgcagtgagccgagatcacgccattgcactccagcctggaagacgagcgaaattccgtctcaaaaaaagaacacaaaaaatttaagttctagttaattaattgaaataaaccagtttctctctgatgagagaaaaaaatgtgctaagtactgctgagttctggagggccacaaacactgcgtgaaaaacatctaggatgttttcactcttgttaaaaacgcatgttttagtactaactcatttaaaacaactgttgaaaaactcaagttacctcctggagggtaagtggaagctgagggacatcggtgggaggcaggtgtctctctgtaccctttacacttttccagttttgaattttacatagatactgcttgttcgaaaaatttaaagaatgatttttatctacttaagcaccaagtaactgataggttacacacaggagatacgtgtttgtttacactgcagggctcgacactgcacaactggcacaatcttcccaaaagtcaacccgttttctaaaacttccgcagaaccaccctgaccgtaaagacgatttcaacaacgagataggcagttttggcccgtggcctgggcccgggagactcgctcaagagggaatgtgcggtgcccggcaggattttaattccgggtcacccgccccgccctgcggccttgggtagagtttagccccctcatcccgtgtcccgggggtcgcgcgacgtccccgagacgccctggccggtactcgcagctcgcgcctttcgttccgctcaagttcctccgccgcgacctcaggacaggccgaagaggcgcgcactactcacgtgtcttccaagtgctgctccaaggtcgcctccatcccacccaccgaccactccggctcagaacccagcggcacggcacgtccttctccaccacaggcctcagtcacttgacgcgagcggggcgtggaccgtaacggcgcctccaaagggacaaaattgatcacggtgcaacgtccgcgttctttactggaaaacatcactgcgcttccgtcgcacagagcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtgtcagtgttttttaacctttggaccctagttcaaccgactccgagacctaggggacagatcttaagttttacaataacccaggggtcagacagggtctgatctagcctgtggggcaagtacggggaagacacgggacctcttggagggggtcagtaggcttgtagggggaaagacgcacacagagactaaaggacgagatggagcaaggttcaaccccctagctgagtgttggcagtgtcgggattttaacgaagacattggtgcttattatggtgaggggactcaggacagtttaggggaagagagtggcatttgagtcctaactcgtaaggaagactgggtaggactacttgaaaataacttttaaaaattaattataaagctggtaaaaataggaaaacatctatggccccactgtccaaagacgacttttaacttcttggagaatatcctttcagatagttgtctttgtaaatgtatacttttaatgttttttcgtttgcctttttaaaataaattttttgggggacagggtcttgctctgttacccaggctgtagtgcagtagaacgattatagctcattgcaacccggacgtcctgggttcaagctatcctcacctctcagcctctcgactggctaggaccacagcctcgagccatcatgtctggctaatttttacgtttttttgtagagatgggggtctcgctgtgttgtccaggctggtcttaaactccttgcttcaacagatcctcccactccagcctcccaaaatgtgattacaggctgagtcaccacgcctagcatggttttttttgttttgtttgttttgtaagcaaaattgacatacatactggaggtacaattctgtagctggccttctttacagagtttagaataaatgtctttccatgtcaagttttcacttacatcctttgtagtagttgcaaaatattccattttatagctgtatcttaattgtggattaaggttggagtgcagtggcactatcatggcttagtccagcctcagccttctaggttcaagcgatcttcccacctcagcctcccaagaagctgggactacagggacccgccaccccacctagctaattaaaaaaaaaattgtagagatggagtctcagtgtgtagcccagtctcaagtgaccctccctcgttggcttcccaaagcgctgagattgcaggtgagccactgtacttggacttttttttttttttttgcttttgtttgttttttgttttagctattacaatgctggttgaatatcctcatagctaaatatctgtgcagttttaaaatttccttataagttactagaaatggaatgactgggttaaaggacatgatcattttttaagactcttgatacatacttacaaattgcctcccgaaaaagtggtgctaatttactcaaattggtaagcctcaccccctctgtggatcattccttgcactaagtttcttccaactctgtcacctccagctttttactcacagcctaccttccaatctggggcccagctcccagatcggaagataccagactttggtattgaaccaaagtccaatacactgcactggcattcagagtccctttttattccgcagctgtcatagtgaagcttgcagcttccttgaaattccagtttgtttatttctttatttttttgagacagagtcttgctctatcgcccaggctggagtgcagtggcgccgtctcagctcactgcaacctctgcctcctggttcaagcgattcttctgcctcagcctcccgagtagctgggattacaggcatgcaccaccacacgtggctaatttttgtgcttttagtagagatggggtttcaccatgttggccaggctggtctcaaactcctgacctcaagcgatccgcccacctcagcctcccaaagtgctgggattataggcatgagccattgcacccagccaaaattccagtttgaatgttataattcaggggtcttggactcctgctctagagaaattattcatgttaagttaggggtaacacagtacaggccatataagttttagaaaaagcagtttaaaacttagcattagaaaacataagtactgcctggtgaaatggcacgtgcctataatcccagctactcaggaggctgaggcaggaggatcccttgagcccaggagttcaagtccagcctgggcaatatagtctagtggccacattaaaaaaagtaaaacagccgggcgcggtggctcacgcctgtaatcccagcactttgggaggccgaggcgggtggatcacgaggtcaggagattgagaccatcctggctaacacggtgaaaccctgtctccactaaaaatacaaaaaattctccgggtgtggtggtgggcgcctgtggtcccagctactcaggaggctgaggcaggagaatggtgtgagcctgggaggcggagcttgcagtgagccgagatcgcgccactgcactccagcctgggcgacagagcgagactctgtctcaaaaaaaaaaaaaaaaaaaaaaaaaaagtaaaacagggcagggtgcagtggctcacgcctgtaatcctagcactttgggaggccgagatgggtggatcagttgaggtcaggagtttgagaccagcctggccaacatggcgaaaccccatctctactaaaaatacaaaaattagctgggtgtgatggtgcgtgcctgtagtcccagctactcaggaggctgaggcaggaggatcgtttgaactcgggagctggaggttgcagtgagccgagattgagccacagcactccaggctgtgctacagtgtgagactgtctcaaaaaaaagtaaaacagatgaaactaattttaataacattttatttattcaaacaatatattcaaaatattatttcaacttgtgattgataaaatactaatgagatattttatattttttctccagtactgtcttcaaaatccagggtatatttttcagttagcagcacatttcaattcagaccagccgcatttcaagtgctcagcagccacctgtggctagtggccacagtattggccagtgtagcccaaggatatctcaaattatctcaaagctagatcagtgattaaaggattctcaggccaggcatggtagttttcaggcctggtatggtggtttacgcctgtaatccccgcactttgggaggcctaggtgggcggatggcttgagcccaggagtttgagaccagcctagccaacgtggggagaccctgtctctaccaaagcacaaaaattagctgggcatggtgatgcgcacctgtggtctcaagtactttgtgtgaggtgggaggatcacttgagcccgggaggttgaggctgcagtgagctgagattgcacaactgcactccagcctgggtgacagaatgagaccctgtctcaaaaaaaaaaaaggattctccgaaagactggcgattgctttttaagctataaggaaggcctttgaagggaaatcaagtaggaagaggatgatagctggctcacatgtccttgccacatgggaggtgagagagcaggctactccttaccacccccgctttctctgccctgctgctgtcttgcccctgtgcaagtaggcaatgggagaggaatagtatatataaattgggcaagtgctaggggctggagtgatggttggggaaagtatctgacccttgttttctactttctttagcttgtggggtatttaacaattctttgttcttagttttgagtgctggcaaccatttctggggtgacaggaaaagttccatgacatccgtattagagcatttgtttcattatattgtaattttttatgtttacttttgaaaaagttcattcttttctctttttaattcttattcttttttttttcttttctttttgaggcagggttttactctatcacccaggctggagtgcagtggcacaatcttggctcactgcaacctctgcctcctgagctcgtgattcatcctcctgagtagctgggactacaggtgtacactaccatgtgtagctaaattttttgtattttttgtagagatggggttttgccatgttgccaggctggtctcgaactcctgcaatttgctctccttggcctcacgaaatgctgggattacaggcataagctacagcacccagcccttacgtttacttttcattgacaggaagagtgtcttcatctctgcatccctagtgcaacagagcatgacaaaaattcaacaaatatttattgaagagtcttgatgtcttttgggaaaggaactctatggttacctttactctaaggtaaagaaatttaggtcctgaactttaaccaccttctcctcttctttcttccctctttcataaatgagctcttggaaaattaaaatgccaggagggtccagcagagaatacccaagcccacatgtcctgatgggaagtgggggataagtagagagggaaacacagaccctgtaggccatctcactgctgctggcccaggggaccctaactccttttgttgactcatcagaagtagaatcctcctgagggtctgtttaagaagcacagctctggtagaaagggtagctttcctatgggtacggagggctctgctaccccagggctatccacactggcctgtgaatcactctcaaatgcttagggtcacgggctttcagtggaatgagccctcatgtgccaccagggggcaccaaggccacagaaaaccctattcagaaggttctggggtgagggaaaggaatccacgggtttgtggagctggcggagcatgggtgaggacagcattatgctaggttggtggccttgaagtcagatgtaaattgggatcctggcttggccactgactatccatgggaactttgaatctcagggggctcatttgtgatgtgggggtaccattatctgcctcatcaggttgtggggaggattatatgagataccttatgtaagaggggctggtgcattgtggaagtcaacaagtaagttttgttaaatttgagtaagaagacctgtttgtttcctcaagttgcttataatctaggtgaggacacatctgagagaataactaatagttcagtgaaggtaagagccaaatgattggcacagacctcaagtggtctggcatttacgggagagggggattgtgaaacaggaattgaaagaaatttaaaaatgcataagcaaaaactcagtttatgttttaaaaaaaccaattccccctgagaaagagaaagaggtggagtcctttaaaaattatctgcttgtttttctgtctgtggctagtgagccttatctctccctttcccaggcattgtgaagaccctgtttctctagctgtgcagctgcaaggtcactaggcagataaactcaagccataaaacatgtttttccttgaaaagtaagaaataatgtaatgcatgtgtcaaatgaataactatttctcgcttctgtaatatgcttcccttcgcacagatctccccctgccccatgaaatgctttaaaggtaacttaactctttgttcggggctcagtcctttggatgttaatctgactggcttggtgcacctaaataataaataacatatatcctcctcaacccctcagtctctctgattcctaaattatcccgctgtaattgcagggctagatttgccgacctgctttataaagctatgttaaatcagtatattttattctttttattagacttttctatagcataaaaatgataaaatacagcaagaaaaaaagtcacctgaaactctagtcctaaccctaatatgaatgtgaaggagctgggctagaatggaatagggtagaatttgcataaggtggaaatggggacaggcctgtcacaaggatcactagagtcttgctggcaaaagcatcttactgcattcatgctgcagcacaggacccagatgcagaacaggttggggacacagccctgccttctaatagtggacaccatctgagagctgagccatagattcaaagcctaactcctaatagcgattggtagtaatatcatcagcagttcatatacatggagtgacaacagcgtgccaggcaattcaaagggtctctcggtcctcacagcatttttgaagtagctaacatcactatcccccttttacagttaaaaacaacaacaacaacaacaaaaacacaaaaccctgaggctcagaagataaatatttgctgaagatcactgtgcttgtaagtggtggagcctgaccattaacttccccacgacactgcttcaatttctatcacttcatcaaccacacaacccgagaactgtgaggggatttagcaggcccagtccagatctcttattgtacagagaagaaatctgaggctcagagaggggaagggactaatttggacctttaacttcggattcttaactttctttctggtgttctaactatactgtactacaagaggctgtcttagagctttagttcaaccagcttcagagatactcattgttatgggttgaattatgtctccccaaaattcatatgtcaaagttctaacccccagtacctcagaatgtgaccatatttggagataggacctttacagaggtaatcaggtgaaaatgaggttgttagggtgggccttagtccagtatggctggtgtcctcataaaaaggggaaatttggacacagatgtacatagagggaagatggtgtgaagagacataaagaacagatagtcatctatagccaaggcctggaacagatccttccctaacagccctcagaaggaagcaacctcactgacaccttgattttggactgctaccctctggcactgtgagacaataaattcatgttggttaggccacccagtttgttatggcagccctaggaaacctttgtggatatatctgttcgtatacccataaagtctgcaagtcaaaaatatcacagacttttggcagcccttcattcaagcactggctgggagggtcaccctccccgaggcaaaaggatagagcaaatgatctttccagcttgctcccaaccttgatctttggccaagatatttttctttcactggacattggccaacattggtgtcataacttaatttgactgtgaccttcttgagtcttttatgtctctgagcttgacctgtagaagaagctcaataaatgtgggtagaggggatgagtgggaaaatcagctcccagccattccagttcaagcctcttcaagcagaagagtcccacctgaaagacctcattttcacttgattactcgatctccaagcaataggtggggcaggaagcagggtatgtaaggcctgtcagtggatggaagttgaagttggacaccatctcctaaagtttagagctgagcccaaattctggaaaacacaagcaaaatacattttatatgactcaggatgggctaaagaagttccagtacaggaaactgttttcctgctgctttattaattttgctacagaggataaatgagatgcagactttcatatccaagtcttcattagatgcccagttaatgcagccatgacaaatgggaatgaagcccttatgaataaaaaaaagatcaacccagtataaaaaaatcatagaccagagaaatgaaaatttagaggagctgataaaataccctatccttaattagactgtcagcatacacatcaaatcagccttaatgccaagatttattggccttggaattgggtaaatgaaataagtgcttacaaatgaatggaaaagaaattacctgtattaaaacgtatttgtgatgcaggcctgtgcactgagggttttagtcaaactcaggcttgcagcttcttttgctctgcatccatttccaccccatgttccccagtgggtttcagagaccctctttgtggggtaacaatatgtaccattgtcaactacctctgctgttgtcctggaaaaatccttcttggacagtaaaatatttttgtctttatttcaccatctccagattagatgggtgttactgattcttacctcagagaagagaatgtcatggagacaaaatgacctgcttagagttctgcaccccccagcatggagagcagagcgcaaagatttcttccggactcccacattccccttggaatccaagaactggtctactgtcacaacactttagtaccctcttgtaagcctgtggacaaatcctctgatgccttgatacctcggttttcccccactataaatgggaagataaattcactagaaacagtacttaccttgcagtgtcattatgagaatttcatgagacaatgcaatataaagctcctagcacagttccaggcaccattgtaagcactgaacaaatgaaagctgttgtcattaggatctcaagaaatgacagctgaggcaaatgtggattagactgcattcagcattcttagctgcaagcaacagaagctgacgctggtttaaagaataggaaaggaagttaattaaaatgacattgggtagcttgtggaactgggaggactagagagctcagtctaagttctagtgacaaagcttcaaatcatacatgaggaaaatgcccctctgcaggaggaacgtaatcctgcaatcactgcttcccctgaagccagatgcctctactgctgcccttcccagcagtgatggagcctggatcacatacctggctttagttgtaaaggaggctggagagaaaatgctctgctctatgtaactgtcttgaaagtggcccacacatagcaaagccattcaaaagcgggtgagcagcatgaaagcatccagaaggattcttgctttgcatgagggagaactcttgctcccagagtgtgagaccagcaggggcattttcctcatgtgtgattagaagctttgtcactagaagcttagactgagtaggacacctctgagtgtgaatgtcctacctgagttctgcctcatgcaaagcaagaatccctctggagggattgacaccacagcctcttccacaatgtctccaaacaactttactgggcagcattccactccttgacaaacgggagaggtgcattctaccttctctcctgcatgagcctagactaatatggaatttgggagtgttgatcattgtactttgtgctcctagagataagggtcatcataaagcatctcagagtctcactgtagatccacagttccatttctttatggatcccttacccctactttgccaaattctatgcagatagcaataataattcagacagggcttcctcactgaaggagtttgtgctctatatagttaataagctagagataatgaaaaaaaaaaaaactcaacttgaactttgggtaagagaaacttttcagaccaacgatcattaccaataacagcttccacgcatgaccctgcccggagattggggcctgcactactgtttccaggaaacacattcttttgaatttttttattttctttgtagagatggggatctcactctgttgcccaggctggtctcaaactcctggcttcaagcaatcctcctgcttcggcctcccaaacttctgggattacagatatgagccaccacggctggctgacaggcaccaaattctaggagaggacttgaatagagtaggcatctgtctctccccattcctttcagggacagagctctcctggttgggagaaagggagagggagagggaggaggatgaatagtgaagcaccaaacctcagaattaaggcctttttcttttctttctttctttcttttttttttttgagatggagtttcgctcttgttgcccaggctggagtgcaatggcacaatctcggctcaccgcaacctctgcctcccaggttcaagcgattctcctgcctcagcctcccgagtagctgggattacaggcatgcgccaccacacccagttaacttttttgtatttttagagacggggtttctccatgttggtcaagctggtctcgaactcccgacctcaggtgctctgcccgacttagcctcccaaagtgctaggattacaggcgtgagccaccatgcccagccagaatcagggcctttttaaaacttcagtgtcttgtctttacccttcatggtgcctagaaaagcatctggctcataggtgttcagtgaatgattgtttcattagtgaagaaattccctttggaaatctcataggaaacttaccctctccaacccttcacctgtgcattattccagctcccaaggaggcagcagaaactggggtaatcacaacggtcaacagcagcaaaggcagcactttctgatttacttgactgctatggatgccacctctctccacgcctcagtttaatatctgtaagtttggtcagtatctcattcaagaacattgcatttactctggtacttaaagatgaaaaatcaacatttacaaagcagatccattgtcaacctaaataacaaacaaagagagtctctataaaagaaaagaatatttatttgggaatagagcattgcataggaatatgcctgccttagtaatgcatgtattcagggaggtagaggaagacaaaggtttttaacagaaaaaatgtggagaattacataattgttttgaaataattatccttggctataaagatcaataacaagggtgatgcgagtccaaggttggacaggcagttgctgggcagatgtctttgcagaagtcttttttgtgtaaggttgtaatggcttttgtaggaggttgtggcttttgcaatcttttgtgatagcttttgttaccaggcatacaagcatgagaatgctctcttcagggccttccctagctctatttatcaggggtttcttgttagtgattccattttgattctgacaactttcatggacattatctcatttaatctcacagtcattccatgactctatccccattttgtgaatgaagtaactgaggtctggagaggtcaactaactggtcaaggtcatagaacttgaaaattttcattgtcttgggtctctaatactggggctgaccattctcccaggcaatgttgagtgagttggcccaggtgagtcggctcctctgcaattgtgtctcctcaactagtttgaacaacacaggcctgtgagccagtcccataaagtggctaggggttcccttctccccatttcccctcatcaacaggaggacttgtctgtgtgccttcagacaccacacagtaaatcaactgccacattcattctggaccatcagtattttgccccaggagaaagtcagaggcaagcacactaatatctcattgatattttcaattgccaaaggggaagtgagatgaatctaatcccatctgtcaaggtggagaagagctgattcgaaagcagcatagattactttaaggagatgacagtttatcactctctggacaagggaatatgaaatgaggactaacctcctttatgagttggtaaaaacattgatcagcaaagacaatgtctggggaaatgaacagcaagttctctggccctttttccacttttcctttccccgagactttatgttatatatacacactcacacaaacaggacagaatccacctcctgcccctcaagaaatagttaacatttgttgaggattaattattgccaggctctgtactccatgttttatatttactatccagaagccttaattgttaaatgaggtaagtgttattattagaacctttgtacagatgtggaaactgaggtgtatagaggttgacttgcccaaggttacccagctagtgaagaatgaaatcagatgcagtccagccaacgcttggcctgccgtcagtcacacgcagtacacgtagatcagtcagcctggaaagccacctagacagccctgcttcactccatccttggtcagcaccttagagagccctgctgaccccaagaggatgtgccttttacgggttgtagaggctgaaccacagctgaggggctggaatgagtgggggcctcagacagggtgtctggagagctgaggctcaaggaagggtggagggggtgctgaagctgaaggccgtgggtcttgccagcaagtggggctcagtgagccgaggtgcctctcagttacttccatgtgtgaatttccggtggaggacagtgatgggctctgggcccttggaaaccgggacatccagcgtgtccagccacagtgcaggctgccctggctgctgagagtctcagaaaatgccactgtcatgggttaggaaggcctggggaccacaacaatgtgacttcaaaaaacccaagaaggaatgtgcacacctgagatgctcagaatgcatgtgtcagtgttcagttctgactccttgcttcagccagggacagaagaaccttctacagtaaagaaccacaagagagggctttgctgccagcctcagccagggacacttggcggccaaagcaaaggtcactccagggctgcagatttcagcctctgcggccagaaacaagcttcccaattaataatactctggatcggacagagatggctgctctgtctcaggcgtgtttgccgttgatccctgtgattgatgctgataacattaagagtctgtcagggtgatatttcatgaatgtctcatgtgatgggatgatacagtcgggaaatgcaattccctagctcaggcagaatcagagatgacccaaagtgctgatggaaaggctgaggccctttccagcctctggcagggtagggaaagcgggtgaggtgggggcttgggaggggctgggctgacctagagctgtaacaggggtctctcatgaagggctgtgaagagaaacagtatgtgagagaggcaagaaacttttctctgggtttcctcatgtagaatgattccatctgtgtaggccatgaaggagtccagggaagttcaccccaaaatgttgaaaccacctttgcaaagattatgacagtgagagaagcctggcatggctgactctatcttgcttctagcctcacaggctggctgttctgtctcattcctgggcataggccaagctaatcttgggagggatttatggtttaactttgaagccaggatcataattgtccctccctaaaactgacccctttcttgttcagggactgaaactgcctttgtaagactaatgaaaggccacaaaattaggattatggaaggggcctgaattctgataagatgtaggcatagcttgcctttctgtcatcgtttattgcactggcactcacaagatttgtaacttccccaattggtcccatagataacatcactattgtagaacctcagattggtcttttgagatctttttcagactttggtattctggtgactgactccacccagatcccatgactcatgactcagctggtcctgtggttcttacccagtctgacacagcaccagaggaccgttttccacacttctatctatgatttcatccccaaccaatcagcaccacccattccctagccccctgcccaccaaattgatatccataaaaaccctaacctctgagttctcagagaaactgattggagtaataaactcctgtcttctgtgtggctagccttatgttaattaaactctttcttagggcagtactgctgtcagtgaatcagctttatctgtgcagtgggcaagaaggacccactgggtgactacaatatggcactttggtatgttggttattttaagttagaggcctttgatgctggaagaagctttactctgatatctccttatctaccacaagactggatctgccaaagagaacacaattgcgttccattcccttcctgaaatctcattatctatggcagaaaagaagactggggaatgtaatacacagtattacacagtaatgtaacatactacacagtatttacacaaaacatgtaacacagaatgtactacacagtattttcacaaaacaatatctgtctctccaactcattcaaattctaaagagtcatttacacgtcaatttgtgtcttctacgcccattcattctccctaagaatcatttactactcctcaaaagaattaccaacattctccatctcccactcccctatgaggaagggtatataagtttctgtctggatctcattagatgactgtgtgatcgtgcttctatgatccctaccccacatgttaaatgaattttgtatgcctttttcttttatcaatctgccttttgttagggtattttcagtggaccttcagaaggcaaagggggagctttccttctttgaccctacagctattagacttgattgagtaagacacacaataatgaaagtaaataagaagaaaaacattcatcctgctgtctccagagtttgaaatgtctgcctcaaacttcgatttctatctaccaaaaattcatgcattaatcataaggccgatctcaaaagtgaatttttttttttttttgagaaggagtctcactctgttgcctaggctggagtgcagtggcacaatctcagctcactgcaacctctgcctcctgggttcaagcgattctcctgcctcagcctcccaagtagctgggactacaggcacgtgccgccaagcctggctaatttttatatttttagtacagacggggtttcaccatattggccaggctggtctcaaactcctgacctcaagtgatccacccacctctgcctcccaaagtgctgggattacaggcgtgagccaccgcgcctggacgtgaaaagttttttgaattcccccattagaaatgatcttcaccctgactcccataacactttgtacattactgtaaaagcataatattcaaatatttacaatatacctccttcaaatataaaatggacacatgccgaagacttagcaactcatgaaggagggaaccaataatgtagttaagctaattcaaagagcattttgaggaaatgaatacttatggtcatttaaaaggaaatgttaaaatttctaggttaaaaataaaacttgccattgcatatatggtcaaatgatttttgacaagggtgccaagaccattccatggggaaaacacagtcttttcaacaaatcgtgttgggaaaactagatatccatgttcaaaagaatgaacccttaccttaccttccaccatatacaaaaattaactcaaaatggatcaaagacttaagcataagagctaaaattataaaattcttagaagaaaacatagggaaaaaggtccatggtattatatttgacaatgacttttttttttttttttgaggcaagatttcactctgtcaccctggctggagttcaatgcagtggcacaatctcagctcactgcaacctccacctttcaggctcaagcaatccccctacctcagcccctaagtagctgagactacaggcatgcaccaccaagcacagctaatttttgtatttttgtacagagtttcgccatgttgcccaggctggtctcgaactcctgagctcaagctattcacctgcctcagcctcccaaagtgttgggattacaggtgtgagccactgtgcccagccctgacccccacatttttaaacaaagcttctcttccataatcaattgcaaatcagaagatctttgaatctatctgcagcctgcaagccccctattcaagacatcccacccttttaaacttaagccaatgtgtaacctcctggcaatcaattttgcaatttatgattttgcctgtagcttctgctgttctgaaatttattcctgcctctaaaaatccttgccggcaagccactggggaggctaggttttgagcacttagctgtctggtcttccttacttagtgctctgcaataaacaccttcctttctatcaccacaaaatcctgggtgtgggtatctggttttactgtgttgggtgagcagacctcagtttggttctgttacaagtccctgctccatctcacttgctacaacatgaatgaaacttgaggacattatgcaaaatgaaataagccagtcacaaaaagacaaatactgtattattccacttatatgaggtacttatgatagacaaaatcatcaagacagaaggtatgatggttgccaggggttgagggaagacaaaatagggagttattgtttaatggttgagaagtttcagttttgcaagatgaaaagtgttctggagatggatggtggtgatggttgcatgacataaatgtgcttaataccactgaactgttcttaactccgctgaaatatggttaagatggcccgggtgcagtggctcatgcctgtaatcctaacactttggaacgccgaggcgggcagatcacctgagatcaggagttcgagaccagcctgaccaatatggcgaaacccagtctccactaaaaatacaaaaattagcgaggtgtggtggtgcgcacctgtaattcaagccacttgggaggctgaggcaggagaattttctgaatccaggatgcagaggttgcagtgtactgagatcgcaccactgcactccagcctgagcaacagagcaagactccatctcaaaaaaaaaaaaaaggttaagatggtaaactttgtaccaattaaaaaacaaagctggctaacaccctacagggcaattaaaacatcataatctttggtgttatcttttttattagatagaaattatttatacttactggataagatctgtaagttaacacataacttcacagagtctgagcccttaatgaataataaatagccaagtcacagggagatactttccctgaggtaattaagcaatccttgggtaggcttgtgaagaaatgcccagaatgacgttggaaggacatgctgttctctcttggccttatttccaaggtttggactcaaagtattattttttaacatcacagaaattttttatgccctggtctcttgagggtagggactgtgtctttttcatctttgcccctttccacatgctctggtttgtagaacagaattgaagaaggagccatgtgctagatagagcgggttgggagcagcagacctgcctgctcattgtttctgtgaccttgacccatcctgtagtctccccacgccttgctattctcatccatcaacgatgagattgcacctaaatcctgggtgctgtgctgggcctggggatgctgtctaatccctgggtttccttctagtttgctctaatcacccatatgaaaaagaagctactcaaggcaaacatataaatgaaacggataatgaatgaatagtattttttcttgctttctttggaagaggcatcctggattctacttgaagcctgcagccctgactcctgggctgggaggtgggcgaggacttgtattttgtagctctgctagagagggaacagctgtccactggtggcaggactgacgcctcccagaatacaggggctttggatcagcaggcgtcagagggaaaggaaactggcatccgagtctgcctttgagaaaggagtaaattactatcttattataaattcatgatccactcattgctgttttcaattaatttcttgacaaatctggctgttccttttcttattttccttaggacaggaggtgtcctggtgatcagctggagctcgggggagctgttgctgaaattaacttgagtgctttggagagagatttacatggcagagtggagccagggctgctcctttggcaggcactgctgtgccactgtggaggcgcccctgcttttcccatgctttgcagtgtctttaaaggcctttggagccatgcccaggctcagccccatcctggtgtccccctgtgtccgttttgccactgcccggctacttcacttggccatgggccttaccagcttgcagacaaacccgtccatctacgcctcccagcgcagcttggcccacttgcaagcacttacagagggtttcagaaggaacatgtctgccatctgtgtttggagactgtgtcccagacttttgagctcacattagtcatggccacagacgggactggagtcctgcccactggagtcccaaaggtctctggtgtttgttttccactctgcatgcctgggttgggggatggcagggggatacaggttgttggagtacctcccagccgggccgtttccttggttccctggggctgccttgcttcctctctagatcatcagtctcagcagaggaaaccaaaaatctcctcctcgccccgcaaccaccttttgctgactgctaagcatccctgctctgaaaccataaccaccataaaagcaataggcttgtcttctctgttctaagcatgtactattcaggtgatttagggggagtaaacaggcccagagaaattaaataatttgtctaagggtaccggctaatgaggatctgagctcagttgtaaatgactccatcacccatgctcttttttagtcccctttataattattttaaaataacatttaattaattttctgttataaaaggaacacatgctcaaacaaaaaacttagaaaatataaaaatgtatgaagacaaaacaaaataacccccagtattagcaatgccaacttgccaagacaaaaatgttaacatttttatttctttttcttttcagtctttactctctgtgtgcacacacacacacaggcaaagtgaaatcacattgtatattcttttttgcttctagcattttccacttagctatctaatattactatttcctgatatcaataaatgatcttcaatcccatgcttaactcttctgtccaaggcatgttctgcccaattttgttttctcctgtgtctgtttgaatgcctcctttctggcctgcatcttagggggacactgaagtctcctttccaacagaagttctattcagggggaatctgttatcttgtttaaagcccatcctgggctggggagcaagcaggagagagagagagagacaccacccatacgtgactagagtgccatttgtagcaggatgccccagaggcagcgtggcccttcaccaccacagttatctggaacgagcaggaactgtgtagaggaagaggcacatccccttttgaatggctgtgcccttgcagccacctcagtccctgcttcctgaagggaatcagttactgggctctgggagacaattttcaaagtgaacttccacggatgtgaagggaaccatgacctagaaatctgaaggtgctaggtcttattttgctcagagctgaaaagagccactttaagagggcaaacattgaggaaaaaatgaagaatatttcattttttagggaaatcctacgagcctataggagtcatcttagcccatgtgcatggtcacatggcctctgtccaggatggccaggacggggtgacttccttagaagggactggcatcttgggaggcaggccttttcagggctcagccccaggactccttatcaaaatgttgaaaaaaaaagtttattccatggacttctagaaatggggaaagcattgatgggttataactcaattctcaacaccaacaatccataactctcaaagaagatctatgactccaaaagggtgacctgaatcaggaggcttataattgcattgccaaagtgcaatgtgatcagaggcagaaacataactaggacctcccacaaggagttgaaactccctttatcctgggcctgtggttatctcattgatattttccactgtaggtgaattatttcattgtagagtcccctatttagaaaatacatggcatgtgtgccagcattttcctatcctgcacccatggcaggcatcaccaatcaacattggcaccctccccactgagcctagaagcagcttcagactcagtctcaacatacttctccaggcagccattacgaatcagtcagcactgacctggaatgaaatcctttgacattcctgaattagtttataatcacaagcaggaattgtatatcaagttcttattagatagaatacttagaaggcccttaggttggttcatttgcctgtttcctcataagaatgagggcagagctgggcatggtggctcatgcctataatcccagcactttgggaggctgagatgggaggattgcttgaggccaggagtttgagaccagcctgggcaacatggcaagatcccatctctacaaaatatatattaaaaaaataaaatgaagaatgagggcaggaggtggcgggagaagtggaagcagatggaggaagttaggttgaagagagccaaggattcttattctgatcctatgattttctttctttcttcactctgtcacccaggctggagtgcagtgacactatcccagctcactgcaatctctgcctcccgggctcaagtgattctcgtgcctcagcctcccacgtagctgggattacaggtgtgtgccaccatgcctgctaaattttgtatttttagtagagaaagagttgcgccatgttagccaggctggtttcaaactcctggcctcaagcattccatccaccttagcctcccaaagtgctgggtttacaggcatgagctaccatatccagccccattttcttatttaagactgaatatgtttctcctgacattgccacaggtagcctcctttcctgcctgttcctagtccagccctgggactcttctcacctcttgtcagggtcccttgaagcaggggctgggttgcccttctccctgaggcaggcaagaggcagagccgggttcaagcaattctagtgcctcagcctcccaagtagctgagattacaggcatgtgccaccatgcccggctaagttttgtatttttagtagaggtggggtttcaccatgttgtccaggctggtctcaaactccttacttcaggtgagccacccaccttggcctcccaaagtgctgggattacaggaatgagccactgcatctggcctattctttaatgagaagaatagagcaatgaagtccctgaactgggccggggttcccaggggcttcccagaagcatgtggctgacttattgtagtgaaaaattagccagcacagatttatcacccaatatttagctttggccatcagtattctcatagcagcttctgctgattgcctcattcaatcaacacagggtggaggtaatattccattcacgttgcgagatcctggctttgtgtcctgatgggccatgtgggcaggctgctctctgctctaacactccctcaacactatgttcacaccatcctgattttttcccccaagtgtttgcacgactcagcctatgcaagggattatggagctcagtggctctgtggcttcaggttctggcaaatgactatttgctttttcttcttcttcttttttttttttcttttttttttttgagatgaagttttgctcttcttgcccaggctggagtgcaatggtatgatctcagctcaccgcaacctccgcctcctgggttcaagtgattcttctgcctcagcctcccaagtagctgggattacaggcatgtgccaccatgcccagctaattttgtatttttggtagagacggggtttttgcatgttggtcaggctggtctcgaactcccgacctcaggtgatccgcccatcttggcctcccaaagtgctgggattacaggtgtgagccactgcgcccagccgattatttgcttcttcatggcaactcacagaccatgatccccactcaatcttgtgggtttgtaatagcagcacagaaaagctgtgttgaaccgtggcacatctgttagcttttccaggtgctcaggaggagaaggtgaactggctgtgtgtagtatggtaaataaaggggccgggctacctttcagaggtttggcacactgaatgacttatgccctgaccagagacctgggctaggaacttagctccatggcctggatgcctgggaccttggtccgatttgcaaacacaacagctccacaggaagaagctttgtcacaatagttattattatagcaaccatccagaggatgctgcatcctaaatatccctcagcagtagtccaggtaagaagcacacctgactatgtatgctcttctctgcttcagaacccttcagggagctccactgcctataaggaaaagtccacatctgggcacttgggtctccatgagcttctgcctgcttatggctccagtcttacctctcactgcttcctgcattaaacgtttgccctaaacattgaactgggttcattgttgcatgttccccttcacccccaaatcagactttgctcatccccaggatacctttcaacttcccccacctccccacctgcctaacaccaccactcactaacaaggagctgtgctccgaagcttgtggacagctgtgtcatggaggagctgccgtgctctgtccagagggctgtctcttgagcacagagactgagccttccccacctctctagcctctagtcccaagcacagcctgccccctggtagcccctaggaaatttccaccaaatgcatgcaaggtcttgcagctgccccacagcttgacatcccacttcctcctgagcctcctcctccactgtcttctatcctctgctcaaagcccttaaccgatgccccggtttttcaagggcagcttcttcagtgttgtttgttcattcactcaactaacaagggctgaccatgcatcggccttgagggactgaggaacaaaggtgctcacactctgatgggaggcacacggaagcagtggcaataaaatctgtaaagtcttctgtgagaagttaaagagaaaatgctagaggatcccagaggaggaagctactgctgactgtgtggtggctcctccccagcctcgtaccctgactctcactcttcagcctgccccagttcccctctaagctacaccttctccaggaaatcgcagcacacccatggcatccacctttccactgaagactcctgagtattcagccccaacctctctctgaggattagagaagttaggtaacctggccaaggccacacagctaggggcagcagggatggcgctctcctaggaccatgctgcactcctccaaatctgctccttgctcccctcccatccatctccaccttctttgccctgctgtgtgtcctgggaggctgatctgtgaggatgtcttggtggctgccttcggtggatttggctagtaaccctcagaggagtggaggaaaggaggaacatgaaaccggggaattaactcctctgtcatgctcccagcaagaccacctaggttggctgtcccttggcagaaggggatcctctcaagggagcttctctacaagaccctctccttctggtccaggtagctgttctcctcctggtcttctggctgggtgatgggagaagctccttcactccactgctactggctctaggttactgcattagtcctgcctttatccgacaccacgctcacacctttgtgaaaacaccctctgtgcattatcctagtttgagtggctccctctttcctgcgggcccggggctgatgcatgctccttctgcatgtcctggattggcgaatagcatcaatatctgtacagctctccaggccccaaccttaaccgtctcctattcttctttctctctcatcctactctaggacctgaaagcctctgaagttcactccttcggccccactcccttcctgctgcctttgggctctcctcatgtgactctgcctgttgaaactgtctgctagctggcccagcatctccaggcatggcctcactcatccacctctcccttgctgaaggtctcctcatgtaacacacgattcctttagatggtccttcatcaccagcaagatgaaacctaaattcattggcatggtagacaaaactctagccttgcctcccagaggccagtctctgtctccgccactccccaggtggactgcattgtgtttctgctgccataaacataatttattctgactggaacatcttctgtgcatgtctgcagagtgcacttcactccccctgcagttcaagcatccttcctccacaaagccttttcttttgatcactgcaggacctgtaaaagctatcctgggatagcctgtatttactggactgaaatgatctgtttgcctatcaatttccccaaatgatatatggcaaggagtagttgaatctaagagcagatctcaaagcctatgtcctttccattgccttgtaccctgctcccctcaagaatacctattttttggggttggtgggaggatcatgtgagataatgcatgggcagtgcctggcacacagtaagtgctcaataaatactgttataaatgggcgaccag

SEQ ID NO: 800 - DNA, 3205 bp, Homo sapiens
cccaagaagcaatgtaaagtttgaaacgagccgagcgcggtggctcacgcctgtaatcccagcactttgggaggccgaggctggcgaatcatttgaggtcaggagttcgagaccaacctgggcaacatggggaaacgccgtctatactaaaaatacaaaaattagctgggcgtggtggcgcacgcctttaaccccagctacttggtgaggctgaggcaggagaatcgcttgatccggggagacggaggttgcagtgagccgagattgtgtcactgcactccagcctgggtgacagagtgacactccatctcaaaaaaaaaaattttgaaacggccgcaccctcgccggccctgcgtcgtccccgaaaaccagacgccctggggcgcggggccaagtgcggcgacctcctgccctccctctgcggctccctggaaaccggcctggacaacggcacctgggcatccatgcaacgggaccaccgcccgcttaaattcctgttgtggaacaaggctggacggtgatgggaatgctcaggatatgttaggttttcttttttttttgagacggagtctcgctctgtcgcccaggctggagtgcagtggtgcgatctcggctcactgcaagctccgcctcccgggttcacgccattctcctgtctcagcctcccgagtagctgggactacaggcgcccgccactgcgcccgtcttatttttttgtatttttagtagagacggggtttcaccgtgttagccgggatccatctcctgacttcgtgatccgcccgcttcggcctcccaaagtgctgagattacagacgtgagccaccgcgccctgcctatattaggtttttaaatagcaggaggcaaagcttttcggtgtgatcctgacttcacttggggaaaaagggcaggtatctgagcctgggaaaatgatcaagctatcagccaaaatggtataacgccgactatatatgtaccttttttttttctttttttcttttttagacacagggtctcactgtgttggccaggctggagtgcggcagtctggaactcctgggcccaagtgatcctccaatcagcctcacaaagcactggaattacaggtatgagccaccacccctggcctatctttaggtagtggcactcttggtgatttttattgtctttatctgtttttgcagtttccatactgcctacaatgaacacaggatactttttttttttcagatggagttttgctcttgttgcccaggctggagtacaatggcgcaatctcggctcactgcaacctccgcctccgggttcaagtgattctcctgcctcagcctcctgagtagctgggattacaggagcctactaccacggccagctaatttttttgtatttttagtagagacggggctttaccatgttggccaggctggtttcaaactcctgacctcaggtgatccacccgcctcggcctcccaaactgctgggattataggcatgagccaccgtgcccggcccatagattacttttataatcaagtttttctttactttttaaagagtaaattctctcacctcaggtagctcagagagctgcgctggaggagaaaagccagtaagtgaacaactggaataaactctgcaggggtggcagtgggggcagaaggagagcaaggatggggagcaaagagggaccccaggggaggccctcagcttggagggcggcagggcgaggaggctgcgaggaacagacgccagagctaggccttggggcccttggggatggacagcctgccctccattggaaatgagatcaaggagggagtgagggcttggcgtttgaaaggcacagaggcgggagggagaaaggctgagaagggatggggacaggccctcggggaggctggcatcaagtggtgggtcagcgagagaggcaggcggtctgtgagccctgcatctgagcccctctccactcttgtccctgcaggtcctggcaggagctctggtacctgggaagctggatggagagcctgggccagaatcccggacccctcacctctgcggcctagctttgtgaccttggcaaatccattctatgcacctccatttcctgtacagtggggatccttatttctctggcacagattggtatttgttctgtaaagcccagtaccactttattttattttagttattgatttttttgagacagggcctcactctgttgccaaggctggaatgcagtggcgagatcatagctcactgcagcctcaaactcctgggctcaggccatcctcctgcctcggcctcctgagtagctgggacgacaggcgtgcaccactgcgcctagctccagtaccatgtttaaacggtgctcagaaaacgtgctaaacttggtggatgggaattgaaaagagatttaatgttttaaaaatcaaagtcactcagctgcagtgccacatgggaaggaggcctggatgtgaatgttcctgggagctgagagctcctgtgactgtcgccagtttcctgtggtctcccacagactcaggacatctccctctgctccaggacacctcaggaccaccagagggcactcatcgcaccttcacccctggaagggagctggtcctggggccaaaacccactgtgcctgggaagcccttcctggcttctgctctcctcaatgtatgacagccctgatttacccccagggactgttgccactcggggttgtagagtaatatgtaaccagactggagaaccacagcaatgctctctcctctgcccatcacctccccttggcccctccctcttcatcagccccattttggagaagggagaaagaagggagaggcagcagtctcctcccaggtggggccggactccagggaaggagaattttcagaagttgctggagttgccgaatctgtcagggcccagggttcacagagcagtgatggaggagaaaggagaggaagcagatctaagcacacatgggcatcaaaccagaggaacaaagtcacatgcagagggctgcacatagacacagggaaacacacacacggagatgcacagaaacacgcagaccccatgcagggacctgctttcccgccacagaggaaagcaatctgatcaaacagacccactgtgcacccagccctccatgcttggggacaacacacctacaaaaatataagaaaaaaaaggaaaa

SEQ ID NO: 801 - DNA, 83967 bp, Homo sapiens
ccgcccctcccgggtccctgccggcgcccccagccgtgccccggccgcagagccgccgctgccacccgatgaatggagtcgccttctgcctggtcgggatcccgccccgcccggagccccggcccccacaggtgagggtgctgggccagggaagtgggcggggccggtagctgctggggagcgggctgccaagccagggtcgctgcgaccccgctcgccctgcacagcctggggcgcacggtgggcgcgggcaccgcgggcaccgctgcggggagattcagctggtggcaggcccgggagggggcccgagcaagagctgtccggggtagaggggtgggaaggacggaagcaggcaaggggtcgggacgggcacggggctgtcaggacagggggcacagacccaggtggcggtgccaggcccccagcggctgggcagcgggggcgggaggcccgcggcttttgttcgggtttttcaggcggggcgcctgccgccgtttcctctgcccgagttttcgttttccgttggcgaggccccggcacagctggagggagagggggtgggggagggggttccggagcgggacgtcctccactaaggcgtccggacaccccctccccgcgccacactcgccccctgccgggtcggactgcgggacgggttgccaggcgcggttccgccgccctcctggatcctggggaagttctagacacaggcccaggaccccgggctctgccggcgaggctgccctcccctctgccctctccgaccggctgtgggtgggtcagagcgcggggtgccaggggcattactcagcgctgggctgctctgcctgggttctttcatctgccagctgctgaggctggggaggggccagcaggggcctcccagccccatccccccatcagggccattcccttacctctgagcctggctgcccgccctgcaggagccccccagcaggcctccctgctcctaagttgaagggttgaacactgtcaggccaacagtttccctgagctcggaaaagaaattccccggggtccaggttgaggtcaaggccagggctgaggcctgttcctctttagacagggctgaaagacttggggaccctcctccccagctttcccggcagtgttgaaggtgggatctggtgcttgcaactcttttggagactggtgtgttccttggttgctggatgtgtgttcagttctccctcaatctgcatctctccccgactcccttcagccaaagtgtgtttcctaattatgaacttgaaattcaggatggacggggggtgggggtggaggtcatgaatccaagcatgagtcccttggattcaatcccccaccagcaacacatacttcatctctatcccctgcacccctctctgtctccaccccaaccctgcggcctagctgggggtgagtggcttttgatcccatgtggttctcccctctgccagggcaacagaccccattccccaaagtgacagctctcactgccatgtgctccttggcatgcgatttgaatctcgattatataaccagtcatttcgcctccaaaggcagcccaaaggcccccggccccagcggcttcttccacttgcccacagtgtggttgggtccaccccaaggtggctgggaattccaagatcctgcatctgaggacctgacctcttcttgggaaccatgggagcagtaaatcctctacattcagtgctggattcaaaggcctcaataataataaacaggaagaatgggagtgggcagggtaggtgttggtgtcccatttcacagagagggtctgagcctatgtagtgacagtgcccaggcaagaacccaggacacttgagggtagtcagggcacaagatgaagcttggggaggaaagctgttaggaaggtgtctgactacgggaataggtcaggcttgtgtggatcccagcccaagcagagaaggactgggtggggggaagaggccctgtgcttgtgcccctctcctcgggctgaccctggctcacggggaagaagtgcagcattcttggcatggatgggagtgggggtgagggagggtgctggttctgagcagagcagtgcaggagtgggtagtggattgcttcatcctacattgcagggatactcagaaggacttcttgatgtgtaaggttaaaagagagactacaaagcagcagcgtggaagaagttacagtgtgagggactgcagttagatactcaggagaacttctagggaggggcttgtgacccacagcatcccaggctagccatgcagggaagtttcctccagtatagtgggtcaagtggattcttgtgaagttggattccaatgtagaaacctggagatggtcattggagatatcaaatattccagcaaatatattcaaatgagcactggtgcctggaaacaaaaaatgtgtttttaaggaaggggagttgctttcacagtatagctcatagttaatacacagacagcaaaaactcctggccagtatttataaaaactacctcatttgatcctcacaataccactaagaggtagataccattattatccccattttacagttgaggacactgaggcatagccaatattgcagcccaaatcacacccccagtgcactgtggagccagggtaggaatgtggcagtctggctctagagtctggctctcaccctcactatctggcttctcaggacctgctatgtcccgctgtcactcccaccccaaatccgtgtccattttctacacagcccaagatcaaggtcagcttctggctggattgcagcttagttgcttgtcttttgttctatttctttactcctccaatctttcccaccctgccccatgctagcccatagcactgggccagggctcggttcactggtgttttccttccaaaggggcatgaagccctgctctgttggctgcaggggttcaaaggtaagatattggcttggtcagggatttggacaaagcctggttttaatgatcctgctctcaccatctcgggagagagacatgaatagggcctgtgggagctggtgctgcctttcccctagcaccctccacccgcttcaaacaacccgccttcagatccaggcccccctgtttcttgtgaaattgtgccagtttgtcagcagggcagtaccaatctgtgccaggtgggtgtctcctcccccattgcctcagtgggacatcaggctgagatggccttggggctggactttggggagattttaaagcccttttgggttggggtgtatttaccacctgtcagagtgggtgaggaccaaaggggtgatcgtgtccaactctgttacgctacagtggggaaacagactggggagtgcccaaggtccctcagcctcggcagacaaggacccatcttctgactcccagctcccaggccatgcctttccctctgtggttggttctgtccttcgtggcccccctcagtgcagggttcatggactgggctccaagagggagaggggagggcagggagctgcagggatgagtggacaatgtatcctgttcatctctgtgtccccagtggccagcacagagcctggcacagagcagttctccataaatgtttgtgaagtacaaaccagggaacagccccgcctgtggccccccagggcgccccatgcccagctctacccctgacactgtgatgttccatctcatatccgtctaccctaccaggtaggagttatttgaggccgagaaaaatgataatagcaacttcttccatagtgcttaccactatgttggtatattaccatcaccccacttgacagattaagaaactgacacaggccgggtacagtggctcacacctgtaatcccagcactttgggaggccaaggtaggaggatcacttggactcaggagtttgagaccagcctgggtgacacaaggagacccaatacctacagaaaaattttaaaaattagctggggccaggagcagtggctgacacctgtaatcccagcactttgggaggccaaggcgggtggatcacctgaggtcaggagtttgagaccagcctggccaacatggtgaaacactgtccctactaaaattacaaaattagctgggtgaagtgacacacacctgtagtcccagctacttgggagcctgaggcaggagaatcgcttgaacctgggagagggagattgcaatgagccaagatcacgccattgcattctagtctgagtgacaagagcaaaatgtagtcttaaaaaaaaaaaaaattagctgggcatgtagtcccagctactcgggtggtggaagtgggaaaatcacttgagctggggggttcgagtctgcagtgagctgtgattgcaccactgcactccagcctgggcaacataatgagaccctgtctcaaaaaaccaaaccaaacgaaacaaaaaagctctgcctgccttcagcctgctgaggtccaaattttagatgtactccttgttcactgtgtgcccttggacaagttacttcattgttttagcctcggctttcttttattcttttgaggcagggtcttgttctgttgctcaggctgaagtgcagtggtgtgagcttggtacactgcagccttgaactcctgggatcaagtgagcctccctcctcagcctcctgagtagttgagactacaggtgcatgccaccatgcccagctaatttttccattttgtattttttatagagacagggttttgccatgttgcccaggctggtctcaaaattcctggactcaagtgatcctcccactttggcctcccaaagtgcggggattacaggtgtgagccaccacacctggctggttttcttatccctgaaataatccctcaaaattacagagagggctaaatgaggtagtattggtaaagtggctgagatttagtaatctcaattattggtagcaactattattaaaaaaaatcaatggatagaaatgagaacaatgcacttttgcctcagtaaaaagtactgacctttatggtcagagcaatctaaagagaaagtgacctgcctctggaggtaatgaggcccccatcactggaggtgcagtgaggtctgggcaagcacaggctggagaatgatgtgcactagagagaattcagcaaaggcttggcacaggaaactttaagggccctgccttgggatcagcactatatgataggaaattagaggagcaggtgaatcctacttcctactgtggggcattgaggagagcaggcagagatgtccccagcctctgggaacatcaggggttggctgctatggtttggactgtgaggctccccagaggataggtagtcctgagaggctgcctggaggaggcctgcaagggtgggtatggttctgataggtgggaaaatgtgggattgtattctaggcccaggaagggcttggtggccgagggacagagaggagcctgggccactggtcctgaggttggccccggggttgcgtcatcatcctcgtgcctcagtctcctgggctgctgggattacaggtgtgccactacacctggctaattttttttatttttttagagacaaggtttcggcatgttggctggcatgttggccaggctggtctcgaactcctgacctcaggtgatccacttgccttggcctcccgaagtgctgggattacaagcgtgagccaccgcgcctggctggattttgtcatcatcctgggtgcccaaggggtttgggtgtatggtggtggcagtggggaaactagtaattccctgtcccgccaaccccccagcttctcctggaggaggagccagggctactcccggtggcaaggagcccgggcccgtaaggagcggaactggggaaagaaagacttcttatgcccagtgcatttgggggcgtccgggggtcggggaacagtggggcctttgtccccaaccgctgggaatctggccgaggagctggccctgggtctggctaggccctcggaaggcaggtcctctttgaagtgaccctttcaaagctcggcctgaatccctgggaggagagacagcatggggcggggcgtggggatgactgagacccaagggccgaggcctgagggatagaaacagacccggccttggcctcttggggtgtggaggttggtcggaggtgtgtgggccggaggaatgtggtgggctgggagaccgcgtgggagccatgtgggaggacaaccacgcaaggggccttagccccaagtgggggtgcacctaggcaggggccgagttcattctggcccgagagtgtttctgtctcctatctgacttctgtctggctctgtgctcctgtatcaacagctgcttcttcctttttaatttccccaaaagtgtgagagcttggaaagaatcgggtgtggacgccagactcagagctcttgggaggagggagaggtggggacctgggcaatccagagcttttcctgcttctgagagcccccgaaggctggaaggagaggctggaggggacacccccacctcccgcatagagtctcccttatgctcaaggtggaggaactctgtattgttcctgaaaagggacagaaggaggaggaaagctacccagagaggggacatcttcctttgcttcagctggaggaatatcagaggccaccctccttccctgtctctccatttgcctcatggggaaactgaggcctagagaagggacaggccaaggggatagagcagagaggaagggaccagcaagagtggaaggaagccagccctgtgtggttggaactgtagggactatggtggctcacacctgtagtctcagctactcgggaggctgagacaggaggattgcttgagaggatggatgccaagtgggaggaggaaggggcctcaggttgttgagttgtcataagagggttgtagagaagtgcccagagtcccttcagctctgacctgcggtgattccatgaaaagagggagaggaaggagtggttcctgctggtgagttcccaaggtccaagtagaaaggggcaccccaggcttttggactgagcaatgcacaggggagcctttggcagcccaagggagaaccttgcccccgaatctgatgctgtttgtacttcttgccctggaacccgatctctccttggcctcacggcagtctctgtactggggaaaattttttgttgttgttgttttcgagacagagtctcgctttgtcacccaggctggggtgcaatggcgcgatctcggctcactgcaacctctcccgggttcaagagattctcctgcctctgcctcccgagtagttgggattacaggcgccctctaccatgcccggctaatttttttgtatttttagtagagatgggcgttcaccatgttggtcaggctggtctcaaactcctgacctcaggtgatccgcccgcctcagccttccaaagtgttgggattacaggcgtgagccaccgtgcctggcctgggaagattcttataaatctccctttcctcttctggaggtgtggccctgggctcctccccaagagaggtggaggagggggcggaggccccaggctgcaatggaggctgtctgcgcactgttatcttgcactggcatcacagagctgagcttcattagctctaatgaagccttggcactgtgcccctcccacacagcacctagacgtttcaaggaaggcgagggggacagctgaggttgggtccagagcccaggagatggtcggggggatgtttgcaagaggagagggtaggaggcagaaaatggggaccacacaaccaggctggggttgccaacatgagggagaaacagcccctcttccttccccactgggagctttttcttctccagtggcccagaggcctaggtacccccagtgctagggaaagccttatctgagagacgggatgtggtctggggatgctgaggatattcccctcagctacccctacccccccaaaaaaaacgctgaggagagtgcccctcctgccctctccgtaatttcagccgggggcaggagaaggccctgatcccagcatgggaggcccagggcttgggaaagtccgccagtgggctggagccgaatcgaacccactgtcagtggtgatcactggttgctcatgctctgcgttccaggctctctcttgggacctggatgaatgagaaacaaccctgctctcaagggcctccttgtctgcttttcctaccgcccaaaagccagacaaaaagtctccacaaagactgtagaaccatgagttctaagatttgcatccagcccatcgatcagtccagaacacccctcaggggccccctgccaaaaatattaatgtaaaaacggcccagtctgactggggtgatggacctgcagcctacacaagccaatgtcttcaccatggtaatcgttggaaagtgagtgtggtcacaaaggcgataacgggagtttaaaactggaagccggaagctgggtagaattgccacagggattggttaaaaaccagttggtgatatgattaatctcctttctctcatctgtttccaaatctatcattaacctgaggattctatagtgaaatcctttttgatcgattttcaagtgccgtcataaagggggtgtataattacagatgcaacgactgagacctggagtgggcaaataacttcactcaaggtcaccaagcatcaaatttcaagctgggccaggcatggtggctcacatctgtaatcccagagacttgggaagcttcgacaggaggattgcttgacgccaggatttttttttttttttgagagagggttttgctctgtcacccaggctggagtgcagtggcacaatcaggcacacaccaccatgcttggctaatttttttgtagcgatgggggtctccctatattgcctaggctggtcttgaactcctgagctcaagtgatcctcctgccttggtctcccaaagtattgggattacaggcatgaaccaaagatcaatttgagaccaacatgggcaacatagcaagaccctgtctctaaaaaattagccaggtgtggtggtgcacacctgtagtcccagctactcgggaggctgagctgggaatattgcttggactcaggagtttgaggctacagtgagctatgattgcactgctgcactccagcctggacaacagagcaagaccctacccacccctaccccccccaaaaaatattaaagctgggtctttcagaatcctaggtctgtcattgtggtgactgctgtattctctgacaacaaggagcctgggaggacacccctcacccagggaagttagaccctcttttccacagctgagccctgaaatccaagcaaaggttggcataacgaaggggggggagggcagatgtaatgggtggtgggtgcagagagatgtagattaagttctgcttctctgtgtcttctgtgattcagtgtggagtctggatttgctcgtgagtggcgtgggggaccccagggttctgtcaataaacatggctgagcccctgcctcctccaaagatggtccagctctcaggggaagaaggcttcactgtggggagatgaggcttgccaaagcttgaaagatgtttgctagggccaggcacggtggctcacgcctgtcatcccagcacttttgggggccaaggtgggcaaatcacgagggcaagagatcgagaccgtcctggccaacatggtgaaaccccatctctactaaaaatacaaaaattagctgggcgtggtggcatgcgcctttagtcccagctacttggggggctgaggcaggagaatcacttgaacctgggaggtggaagttgcagcgagccaagatcatgccactgcacactccagcctggtgacagagtgagactccgtctcaaaaaaaaaaaaaaaaaaaaaagatgtttgttggggcaagaaagggatggaggagaagggagagaagggtgtgccaggcagagggaccaagcattagcacaggcaaggaggcatgaaccagcttggcctcttaagggattgatgaatacaaggcccagaatagagggaggaggtcaggttggcaaggccaatgagaccagatcccgccccttccctcccccatcaggtcgtatccctcatgccatactgaggaacttgctcccatagctactttggagccacacaagggtctcgggcagtggaggcagcagaccaggtgaaaggagatgggagctgaaactggaggtacagttggaagggtaggataagagtggagtatgttggctgggcgtggtggctcacacctgtaatcccagcactttgggaggctgaggtgggcggatcatctgaggtcgggagtttgagaccagcctgaccaacatggagaaaccccgtctctactaaaaatacaaaattagctgggagtggtggcacatacctgtaatcccagctactcaggaaggctgaggcaggagaatcgcttgaacctgggaggcagaggttgtggtgagcctagattgcacctttgcactccagcctgggcaaatagagcgaaactccatctcaaaataaataaatagatacatacatacataaaaatacaaaaattagctgggtgtagtggcgggcacctgtaaatcccagctacttgggaggctgaggcaggagaatcacttgaacccgggaggtggaggttgcagtgagccgagatcgcaccatagcactccagcctgggtgacaagagtgagactctgtctaaaaaaaaaaaaaagagtgggagtatgtcaccctcttcccctttccagaaacttgctgtaccgtctctttcccttgtctagaagggccttctctgccttttccatttctccaactcctattcctctttcaatgcccagttcaaatatcttccgtaaagcctccctccaccactcaaatatatggcgacttcctcctctgtgcgctagaccttgtgccccgtgagggtagggactttgtcttgttcactgctctatatccagcttctaggccaggccctgttgagtgaacgctgctgactgatgaattgagtgttcccatagcacttgacactgcattgcccaccaataataataacaatgggagtattggttatagcaaacttgtattgcgggcctcagggccagacactgctgtgctgagcactttacacacaccgtctctttaatctgcacaacaatcccatgggcgatggattatctctatttaataactgtggaaacagaagcttagggaggttagtaatttgtccagtgacatacagctaggaagtgggcctgagtcaggattcaatccagcttcctctgaatcctgcttaggaactttttttttttttttgagaccaagtcttgctctgtcacccaggctggagtgcggtggcgcgatcttggctcacttcaacctccaactcacaggttcaagcgattctcctgcccggctaatttttgtatttttagtagagatggggtctcatcgtgttgaccaggctggtctaactcctgaccttaggtgatcggcctgcctcggcctcctagagtgctgggattacaggcttgagctaccgagcccagtcggaacttttttttttagacagtcttgctctgtcacccaggctggagtgcaatggcgtgatctctgctcactgcaacctcctcctgggttcaagcgattctcctgcctcagcctcccgagtagctggaactataggcacgcaccactgcatctggctaatttttgtatttttggtagagacaaggtttcaccatgttggccaagctggtgtctaactcctggcttcaagtgatcctccgaactcggcctcccaaagtgctgggattacaggcatgaggcactatgcccaggctctgcttaggaacttttaaacactatgccctacagcacctttatttgttgcatgtctatgtctttggttttataaaaccagggactgcttttgttagtttttgaaaatcctcagactacgggactgatttgttgagcaacttctacatgccaggcactcaatgctgagtcctctccaggacccagtttacagctgaggagactgaggcttggagagggaaaggacttgaccaaggtcatgcagttgggacctgaaacctggcctctgactcgtcttcccttgtgtcactggcccccctagcccggtgccaggcccttggtggcacccagtgaacagtcctagaatgaaagaaagaggaaccggctctgaaggtgactgctttctttgggggcacacaagtggccggacaggggccgtggactgggcctccagcctctaagcccagtgtgtgtcccaccgggatcactgatgaggagagggatctagaggccgggactggggatgtcgtaatttccaggtgcccagctgtctgtcagacctgtgagctccaaggagaggctgacctggtgctggggtggtcagagatggtgtccagggcaggcagagccttaccacgacctttagaggcctccagaggctgcacagcgtcagtgggattttggccacgggtgaccagaaggaacctccaagcctgggaaatgcagctgcagtggccacagcgcaggtgggcagaggccctgggttgtgctgcaggttgggcactgccttttgctgagtgaccattcggcctatgctcccagccccacagggatccaccaatcagacctgcctgctgctgtgtatttgcatctcacttgcatgacaacaccccttgctctgtccccaagtgtgcttccccagcccatgccccattccccatttcaggccccctgtgcagagctcccgtgggaggggcagaaaggcccacctgggctgccagcctggcgcactattcatagctcagggctggcgtacttcacatacttggcgtttctcatgtctggctggcccaaggcagccacccctctgttgtcctcccctccctcctctcttctctctttcccccttcccctcctcccttaacctcttcccccaccttcttcctctcaaccaatcttcctgaaatctacagatgtccaagtccctcatcatggaagagcccacataaggaaactgaggccccagagagggcggggactggagggagaaaccagtagtgatgaggcgtataatgaggtggccgagagtctgggctctgcccacagcttcaatcctgagctgacattagctgtggcaccatggcagattccttagcttgctaagttaaacaagcgtttcagaaagtcaagctgagacctggagggtaagggttgagtcaagggaagaaggggacggggagggggcaggcaggcactgtattatagtccagggagaggggaacttggatgtggggagcaggctctgagtctcaggacaagggcttggcacgttgcagaacccacgaggagggctcgtggctggagtgtggccagctggggtgagggcacagagatgcaaagaggattgaagcagctcccccctttttccccacccctttctcccccactccttttttttgagcctggatctggctctgtcgcccaggctggagtacagtggcacaaccatggctcactgcagccttgaactcttggctcaagcaatcctcccacctcagcctcccaagtagctgggactacaggcgtgccccacggcacctggctaatttttactattatttttgtggagatggggtcttactatgttgaccaggctggtctcaaactcctgggctcaagggatcctcctgcctctgtctccccaagttctgtgattacaggcatgagccaccacgcccggcccccctttcttccttattccagcacccccgacttctggatctggttccctctgaggaaggggtggggatataaaaagcccctgcctctgccagacccctcctggggacagggttctggttacctctaactctctgaggaaaggctcattcattctccaacatttagaaacagtgtgcagagcacccaccctgggccaggaaccagggatttgaccaccagcaaagcagacatggtccttgccttccaggacctacagccctgtggggagatgttggtcaaaataagctcataaataagtagacactgacaagagggtgcacaggtaactgacctggtctggggccagaggaggtgtgcctggggaagtgacatttttgttaagagcaacagggtgggtaggagtgaatcagggcatgggttgcattccagaaacagcatgtgcaaaggacccgaggctggaagggtgcctggtcctcacaggaggtggaaggaggccagggtggccagagcacagaggaagagggtgtggtgagtgtgggggccaaggcgcgtcccacagggcctggtggtcataatattaaaataatcaatctggactgtcagatgccagagaggtgactgccgcttggagcagggcaatggtgtaatgaagtgagcagactccagagacatctaggaagcagagtctactccgatggggggatggagcgctggggccataatacctgattcttggttctcagcaactttttcaggctgctatctctgtctttattttatagctgaagaaataaggaaacttgagtgaccttgagtgatgatcttgaggtcacacagccagaaaagggccagggccagtaccaatggcaagtgtggccttttctctgtgttagccttcttgatgccaggacagtggtcactttctcaccatcctccctgtccccaagcctcggtgcccctgcaggtcacccagcattccctgcctagcacccaacccggtggagagccaggagttgcaggtggtgggtgctgggtgctaccttcatttccagaggttggttaaatgagttagcgcatctaacagcagctgcctggggcatagtaagcactcagcaagtattcttgactgtgtggctgttatcctgtccccaaatgtggggccaggcaaactggcagggggaggcgggaggaggatctggagtgaggatgatgccatctgtcttcttctgaccagagagcccagcccagggggctccctcatggtagtgacccaggggaggctgtttgtccctgcagagccactgtccctgccacctgtccagctgcctctgggcatcacagactggattagggagtggttcagttcataggcagggccacatgtgtgaaggggaaggcaggggtaaccgggagggatgggcagggctggggtgagggggtgggtggtttcaggggtggggctgacagcctctccctgaagggagccccatgtgcccccgggagactttcggaatctgctgagacctgccctgggaggggacatggtcttagcttgactgggacccagctcttgcctgaaggaaaccagtgtgtgcacctgttacctctgcccaggctgtcagacaacaggaagcactcctggggggcggggggcaggcggagtcacacctagagctttcccctagtctcctctgaaatgcactgtccagcgtgagaccaggggatggatctgctgaccttagagaagagtcattgcaggcattcccctgcctctaggaatgactgctccagtctagtctgaaaaggggctctggcctctctccttgaccaaagggagaccccgagattccacagttgctctgtccttctgcaggagattcttctcctttgtaggagatggggaggggaagatcccagggcaggttggagctgaggggcctggggagcgaggttgagggaatgaggacccttctgctcgctctgggttgtcaaggagacgaggcatgccagcgctgggccagcagggggctctgctggccacgggacctgcctgccaggcagccgagatgtgcacccttcattgtgcgggctcatttccaggagtgcctgagaggacgcggcggtgtctctgtgggcacacccttgtgtgtatgttacaggtgggtgtgagcgtgtggcgcgttggaatgggcatgtgtgtgcttggtgggtttgagggcccccacactgagccaggtttctgccaagaaaactcttccaagttcctgccggcagccttggaagagtttgtgcatgactggggatggcagcctctgtggatggcaggcccccatcaacgccaaggacctgatgcgtgccaggttcaggctgggcgatccccctgtgcggggacctctagggctccaaagatgacagtagagactctgaggaggtgcagtggagaagggacggcagggaaaggtcttccaggcaggaggtgcccagctcctgggcaacctctgtgggcagagacttctcctgggcaccaaggagagacctgttcatttgtttcatctttcaacattttttttttttttgagacagagttttgctcttgccgtccaggctggagtgcaatggcgtgatctcggctcactgcaacctccacctcctgggttcaagcaattctcctacctcagcctccagagtagctgggattacaggcacctgacatcacgcccagctaatttttgtatttttagtagagatggggtttcaccatgttggcaaggctggtctcaaactcctgacctcaggtgatccaactgcctcggccttccaaagtgctgggattacaggcctgagccaccgtgcctggccttttattttgtgtgtgtgtttgatttctgacttggcctttttaaaaaaatcacaaaatatataatacggccgggtgctgtggctcacgcctgtaatcccagcactttgggaagccgaggtgggcagatcacgagatcaggagatcgagaccatcctggctaacacagtgaaaccctgtctctacttaaaaaaaaaaaaaaaaaaaaaaagatagctgggcatggtggctcgcatctgtagtcccagctactcaggaggctgaggcaggagaatcgcttgaaccggggaggcagaggttgcagtgagctgagagcacgccattgcactccacactccagcctgagcaacaagagcgaaactccatctgaaaaaatatatatatataaaacaaaatttataattttaaccatttttaactgtaaagtggcattaagtacatccatattattgtgttatcaccataagtggtgatattccactatcaccgtaagtggaataatataatatttattcattcattcctttttttttttttgagacagggtcttgctttgtcacccaggctggagtgcagtggtgtgatcacggctcactgcagccttgacgccctgggctcaagggatcctcccatctcagcttcctgaggagctgggattataggtgcatgctaccacgctctgctatttttttattttttgtagagacagggtttcaccgtgtcgtccaggctggccctggactcctgacctcaagtgattctcccacctcagcctcccaaagtgctgggaatacaggtgctgggattacagatgtgagccaccaagcccagccaatattaatcctttcacttagcataatgtcttcaaggttcatccacattgtagcatgtgtcaaatatctttctttttttttttttttgagacaaggtctggctcccctaggctgaggtgtagtggcgcgatttcagctcattgtaacctccatctcctgtgctcaagccatcctcccaccttagcctcccaagcagctgggactacatgtatgtgccaccacacctggctaatttttttttttttttttttttttgggagagatgttgtttcaccatgttgcccgggctggtctagaactcctgggttcaagtaatcctcccacctcagcctcccaaagtgctgggattacaggtgtaagccaccccgcctggccttcacttattttaaaaggctaaataatacaattattattattcatatcatggatggattatatgtaatacaataatacagacaatttcattgtatagatatacctcattttatttgtccattcatccgtagatggacacttgggttgcttccatttcttggctgttgtgaataacactgctacaaacatgggtgtacaaacatttcttctaatccctgctttcagttgttgtggatatatacccagaagtggaattactggatcatatggtaattctgtgtttaatttttttttttttttttttgagacggagtttcacttttgttgcccaggctggagtgcaacggcgcgctcttggctcactgcaacctccgcctccctggttcaagcgattctcctgccttagcctcctgtccatgtttaattttttgagaaactgccatactgatttccatagcaactccaccattttatttatttattttttattgcttttttagagagggagtcttcctctgtggcccaggctgaagagcagtagtgtgatcatagcatcatagctcactgcagcctccaactcctgggttcaagggatcctcccacctcagcctcccaagtagctgggactacaagtgtgtgccatcacgtttggccaattttgcattttttataaagatggggtctctatatgtttcccaggctggtcttgcactcctggcctcccaaacactgggattacaggtatgagccactgtgcctggccacagacacaccattttacattcccacagcaatccaatttctccacatcctcaccattaagaaataatttttgagctgggcatggtggctcatgcctgtaatcccagcacttcgggaggccgaggcgggtggatcatttgaggtcaggagttcgagattagcctggccaacatggtgaaaccccatctccactgaaaatacaaaatttagccgggcgtggtggcacgtgcctgtaatcccagctactcgggaggctgaggcaggagaatcacttgaacacaggaggtggaggttgcagtgagccgagatctcgccacttcactccagcctgggcaacagagactccgtctgaaaaaaaaaaaaaaaaaaaaaaaaaaaagaaataatttttgagagcccgctatgcacaaagctctctaggagggcaaatccattctgaaaacccagcagccattgtccttagggagctctcagtctaagggggagactcaggccaggcccttgggcatcctccaatctgaggggaaagacacaggccatgccttttgggagaccctagactgatgtggggcaaaaatcccttgttttcaaggagcacacagtctgatggaggaggcatagcttcttccctttgaggagtctgcagacaggcctagagaccagaatggagaccccagagacagccaagggctgctgagtgggtaaatcaggggtacggaggggttgtggtaagccctgtcccaatgccagcctgctgttgcctgggcaatggccctggtgtttactttgtggctggctagacgcacccttttctgtaagtgctcatttcccaccaagaggaaagaggctcctctttagtttccccttcctctgttgtccctgagggaggaactggccctcctctggcactggagaccctgccagcctggcacctttgccatgctccttgcctgctgggagaggccccatcctggggtctcatgttgcccaccccttccctactcccagagggcccataaggtagtgctctgggcttgccaaagttcagccaaggaagtgggagatcctactgaatcctccctgcttgggaggaactggggcacgtcaagagcctgtaggaacctgaggctggcagtgggaggtgggggtgatgccgggaaggatgagcttgcctgggtctatgagcgtccacatgtgtcaccgtgtctttgtgtatccatggctgagtgtctgcatgtctgaatgtcagtgtgactgtgatgactatccaaaaagccgtcgaaacagcctgcatttattaaatccctactatgtgctctgagcctgtgctaagactttctttaatttacttaatcctcccaacaacctttgaggtggaaatacatgtcattaccattttattgatgaggaaccaaggcttaaagaggttaagtaactcacccaaagtctcatatctagaaagtggtagagatagggctctgactcagcctccagaggactccagatcccgtgtgtcagcccctgagctgtgctgccactgaaagaacttggggagttttttttttttttttttttttgagacagggtcttggtccgtcacccaggctggagtgcagtggcgcgaacacagctcactgcacccttgacttcctgggctcaagtgatcttcccaccttagcctcctgaatagctgggaccagaggtgcacgccaccatccccgattaatttttaaattttttgtagagatggggtcttgccaagttgcccagcctttttttttttttttttgagaccgggtctcacactgcagccttgacctccctgggttcaggtgatcctccccacctcagcctcctgagtagttgagaccacaggcatgcactaccacacctggctaatttttatattttttgtagagacggggtttcgctgtgttgcccaggctggtcttgaacttctgggctcaagcgatcctcctgccttggcctcccagagtgctgggattataggcatgaatcatcatgcccagacagattttgaggattttgtgcatttggcattatctcagcccacctccctgatggtggtgggatgtctggagtgacaagtgcttcctcatctcccttcccaggcttccgtggctctggcctagtttgagggagagggagcacagtccatcctaaccctgggcaagagtggccctacaggggaagagcactgggtctggggagaccctgggaaccatcccctacccgtgggccagacatagtgccagtgcggggtgcccaggttcccggtgatgggggttatgtgtacatggagggcgctgcggagacacaggcttgcttggccggctcatcaacttggcctgctggggcttgtcaggcgggagtctctacccaagcaatgctgggaaccaggcatctgaatggggcaaaagggtggaagaggcctgagggggccgccgcccttgactgaggagactggagcagggttcagaggcccaggcgtgggcggggcgggcatgtgtcagtatcgcattgcctgcatgcctgggatgcacggatctgtggtgggatttgccctgtctgtgtgcgaggttgtggagtggtcatgggtctgcgtttggtggtgtgcaactggtgtacaggaccagatggagcttcaaacatgctggatgactctcttggggtgggggcattgtttgtcacctggcagtttggggcccacattctgggaagagtgctgagcaagctggaggaaggaaaagcaggcagaatcgaccctgagcccctctctcacttccttaaccacacgccctgcaacacgtcagtttccttcttgctcctatctctgacccttgggactcaggacgctctcctccccttccccagtgcctacttgcttctactcctccagtccagaccatcctctcctgtgagggatagcctgggaggtgtctggccccaccctcaaaaaactgtcacctcccagagagaagaggccctgtgcacctgagagcagggctcccttggtttgtgggggtctcccttggtgggggtgaaggcagccggctttggccagagtctagaacttggggatccctaaaggtttcaggagctgggacaatattcctgaaagactctccaaagtatctcagctcctggcccacagcaggtactcaagatgtggttaaacaagagggtaatggaaaaggatctggtaagcggttagaaccctgggatctggtcccagcttagtgaaaatgagtccttgaactagtcacttgttctctttgagcctcagtttcttttttaaattttattcttatttatttatttattttgggacagggtctcactctgtctccctggctggagagcaatctctgctcattgcaacctctacctcccaggctcaggtgatcctcccacctaagcctcctgagtagctgaaactacagacacgtgccaccacacttggctaatttctgtattttttgtagagatggggtttcgccatgttcctcgggctggtctcaaactcctgggctcaagcgatctgcccaccttggcctcccagtgctgagattgcaggtgtgagccaccacgcctggccaagcctcagtttctgtaactgaaaaacgggtatcaaaaaaatctctggttatctgattcttagggtgtcaaatgagaacaagtgaaagtgctttcaaatggtaaaagacaatgatctcttggaaggagggaagactggatgccctccctttggggatgcagccttcaagcccctccccagggaccctcaggaagatgaggttgaatggattttgcaagctggtcaaactagagggggatggaaggggcagctcagcagggtaatttctgatgcagggggaggaagctgggcagggcgtggggggaggactcatgctaggcaggaaggcttggaatagaatctcagctacgcctggtatttcccagccctgggccccctccgccaccaccctctggggcccaccccacattcctttcccagaggaaatgggggagggagcggagaggctccccaggcctggaggatcatttattcaagctacataacctttgaggccccactgtgtgcactctccccctgaagtccccacagaggcagctgggtgtggaggtggtgggggtggggaaggaaggtgtggtttgtgttggaggaatctgttacctccttggctgggccttgctcccctgccaggttagagggcaggaaatggacattgtatatggttgatcctttccaaggtctctgcagtctgaacacagaaaacccatgttgcgtctccacctctctcctccctgctgtcccagaaccctcagcggttttgaattccgcagaggtggattcttgatctgggcacacagcagcacctgttggccatcagaggctccatgggggatgagaggggagagtcattccatttccttagaaccagggactggactagcagcaagaggaatgcaagttaggcacctgaaaggacttactggctgcttgctgggaggagaggccagacttggagctgaagacatctggttgccctccgcctggggccccagagtctgacatggctggggacatcttgatggtggttccagctggtctaggagggtctggcctttggagagtatgacggagtcacagggcaggtcagggcaggagtggtcccaacaccgaatccttagttttctagcgatggaagtggggcgggagagggtgccaatggagatggcgcgtcctgctctccccggctgcagtcctttcccgctctccccctaagctctcctgactcagctcgtggcagcctcactcttcccatctggcttccgccagggtgggggtggggggtccagctcttgcacggagggggagcccagcaaacaggaaacaggagaacaaaaccagctccctggctgacacaggcagccgcccccacacgcctcaccctcacccttcctctctcttcctcctccctcccttgatcccgacctccctcgtggtccgctctgctcccttccccctcccctcccacctccgtcccctaggctcccttcccgtccctttgcttctccaccttctgacactttgttgtctgctgccttcccctccctctgcccccaggcccctccccatctctgtccctccatctcccccccaacccccttgctggatttcctacctccccattgggccaccctcccgcaggttcttgctggggacagtggatggtggaatgggagggaaggggagctgcatctgcttggtgctcccttctggtagctgcctcaaaaaggcccaacccttatgacgcttcctcctggactcctcctagattcaggagtggggttgggctggagctgccccgctttcctggctgctggctaggattttggtgtaggatagaagttgggatgagaggccctggggttggagtcccggtgctgccataacaagctgggtcctcttggacctcagtttccttctctacaaatgaggccatagaaatggccccgggccacagtaagtggctgtggtgatattgttggtgaacagtcaagtgggctagaaatggtgatggtgattacacatccactagccaaggcctctgctagccccatccggatggggcctgggaagagcaagagccaggaaggcgagcagggcaggggctagcacaacatggcgcttcccatctggctcacatgccagggggtgggagagggggcagctttgaatgattgtcagcttgtagtgaccctctaggtagagctaatgggtagggagtcctgggaaggagggtggttcccacaggggtgttggggactccatctgcgcttaagagtgtgtggctgtcactctgtgcagggcagtgtgtgtagcactcgaggggctgtggcatccatgcctggagtgcctgagctgtgcagtgtgtgcgtggcatctgccatgttgtgggggtccctgtggggtatgtgtggagtgcgtgggtgggtaaatgtgggtctggtgtgcttgcacatgcatctctctgagtatgtggaccgtatacacttgggcggatgtctgaggtgtgtgtatacgatgtggaagagtgtcctgtgtgtgtgggggggatagtgtgtttctggggtatgtccacatagggtgagtgtgtgtgggcaggtggatgtgtgtggtgcgggtctgtacagagtgggtagggtgtgcagcagagtgagggacacctggagcatgtgtggctgtttctctgggtggatggggctgatgcgcgcgcgtatgcgtgcgtgtgtgtgtgtgtgtgtgtgtgtgtgtgtgtgtgtgtgcgcgcgcgcgctggaagggtgcaaggtgtgcgggccgggggagagtgcgtgtctgggtccagggctgccgtctgcgtgtgagggtgcgagggtgtggtcgtgcgggggactgtgtagtgccctggcgtgtggggtgtgagtgtgagatctgggcggccgcggacaggggccgccccggagggggaggcgtcagccctgcgagactcgcgggcgtgtcggggctcgggcgccttcagccgggaggcgcaggaggcgcggagccaatccagccgtcctgccgccgtccgcgcgggccgtccgtcccttcggggcccccgggccccgggcccgcggctccggggggcgggcggggacccccggggcccgccggccgcccggggggtcgaggacgccgtctgccgggcgcctagcagcggccccgggcccccgcgcggcgcgcgcgtctccggaagcccggcctggggcgtactggggccggggcagtggccgggcccgggagcccccgccggccgcggagctggtgggcagcgccgtgtggcgcgtggagcgcgcgggggccgggggctggcgctgggagcgcgccgtcggcgtggactgcagcgccccggaaccgcgctgcctctggctgccctgcctcagccacagcgaccgccgcgcgcccgggccgcgccgggccagggtgagagccgcggggccggggccggggccggggcaggccttgtcggggtctgagtgggactgggtcaccaactccctgcggcctttgagctgtgtgcgccctgcattccaggactgatgcccctggaacggggagtgagtgaggcacttgagagatggggctgagggtggcaggatttgtggcttggagctctgccagggcttctgggatgacaacccccagtctgggtcgaggcctccacggggctcagccctctcggtttccaggcagtggaaggatggaagggaccagagcgtttgaagagacgctggggcttctaggaatcccagagggtatgggtgggcagggaccccgagttccgaggcaggcagaggcaccactgaatggagcagggcccacgacccaccccacccctggtaggggacctggacacggcacacgagggtttcctagtgggcagaggaggctgagtggcagacgggccactgcaggtagtgagtgctctcagggctgacagggctgggctgggggactgccgtgtttctgatgtccgggatggaccaggctggtagggtgtgagtcacagtgggcgccatgcccggcctgaacactgtgctccctgcaatgacctctttatgctcccggggggaggagcagggctcctgggttctagtttctggtgctgccaacccaccacgtgtccacctctgcctaatttgtggcctaaggccgtctgccctgctgtcaccatcagctggtatttttggacgtctctttctttcctgacatgagggtgggagtgtttggaaatagatccaggccaggagaatttaatcagcaatgtccctgtgtcccctgagcaactccctctcagtccccttgtctctgtgcctaagtcagagaggcagagctgtgtgtgtgagctgtgcacctttctagttgttatcaatggctccttctgtggtttttgcacctatcacttcccccacctcaagatgagaacaagactcagttctgtcccaggtcacaggggaggagaggaaacatgcatgtattatagcatgaaggattgaggttaaacaaggaagaacttcccacaggggagatgccagctctggcttttgatgggtgtcctggtgtctcctcttcaagcaggtgtgtggtagctgtggctgtgtggtagctgacattctcaagagcctagttggaagaggtgggaggaaggggactggaaggaaggaacagaggaaagggagaggtagagataagggagggaatgctggtagtgcttggtgaggaggggacccggagaggaaggcatgcctcctaccctggattccatgcaggccctcccagggagcagcccccccaggcagctggcagctccaggcaggatgtgtgctgggggaggggcggggggcgtgcggggacctgtcccagccacttctcgtcactggggcagctggtggcttgaaccttaatccaggacagcagcaaaacaatgggccctgcaaacagcctcagctctgagcctgggtgggggacaggcagggggcagcccacactggggaggagcaggggcttctggtaggagagggcagttggtgaggggacccccagacccttttcgctccctgatcagttccttgccaggtcagcagagatgggaaatccgggggatttcagacctcagcagaattcccagagaattttctcctctgggctccccaggcccccatgggggtgcagggcaccgtgggagagactgggctaaagctacaggtggaagatgctggactacccctgatgtcaaaacccctgctgagacctcctggactgggggtcttccagcttttacgtggcccctgtctggtagggggcactcatagcctcatctgggtagttttccagaccgtataggagtagaacagtctagaacggtctgtctcccttgcctggagctccactcagcctcttgtatattccacctggctctgtcccctggggctgtatgaagcaagcctatagcctattgtctctgtcacatttttctttaatcttctgagatgggaggatctagcctcttccccagacctgctcgacagcagccaggctctcccccatgcggaaatccttagcagagggcagctgtctccctccactgggtgtgtggacaggagggtggatggtccatgaatgaacttattggcatcaggacatttgagctttctccagctacgagaaggggacaaaaggggatgttgctagtgaagcgggagctcctcactccagaactgatgagcttcttcctccacacccagcccctcagcctttctcctgtcagctgatgcttcctgcctggtgccgaggaggagttgaggggagtaaggagtgttggtggtgagggctttttgccctctgaggggcttggactaggggcaacatagaggttaggccacatgatgttatggatttaagagtcctctaggggtcctcttggcttttcaaagccaggcagcttctccgtggctcccatcttccccagttgggctccgtgagcaccctctatctgacaccctcctgtcacccaccttccctctctgtgtcccaaagggagccctgtctcaggcactgtttttcttcttgccccagaaacagacctgtgtgccccctccaaactcttgtcttcagataccctctgccacatcatcttggagaatcctgagaattttgggaggtctgacaggaggctttagtgtctctgaaacctccagccttttttttttttgagacgaagtctcgctctgtcactaggctggagtgcaatggtgcgctctcagttcactgcaacttctccctcctgggttcaagcgattctcctgcctcagcctcttgagtagctgggattacaggcgccagccaccatgcccggctaatttttgtatttttggtagagacagggtttcaccatgttggccaggctggtctcgaactcgccttggtctcccaaagtgctgggattacaggtagagacaggattttaccatgttggcaaaggctggtctccacccgccttggcctcccaaagtgctgggattacaggtgtgagccaccgcgcccagccaccccaagcctttctggtgaaccagccaggcctctgggctgggctctggagcctcaggaagtcccttcaggtgtctgatgtccagtccgctccctcttgtttcttggttccccctgtgttcctgctgctgttcttgaaggatgcgtgtgtgccggtctgctgtgcatgtgtgtatctgcatgtctgtgatgcatgcgcatgcgtctgtatgtgcattgtgtgtgcaggactttgattctgtgcaactctgtgcatatctatgtgtctacaaaagtgtgcacatgtgtactcatttgtgtgtgtgtatctgtgtgtctgcatatttgcacatgcttgtctgtatgtttgtggtatgttccgtctacatgagtgtatgtggctggggctgtgtctgcataagtatgtgtctatctgggagtgcatatatgtgtgcatgtgtgtgtgtgagattgtgcatgagctaagacaacgacaggcacttcctgggcaggaaggctgtatccagggtcctgcacatagtaggtgctcagtgaacatttgctgaactcagctgaactgaactgaatgaacttgcttcagtgagttattttcccaagggcaaagacattatgaggggactgaggggaaaggaaagaaggaaaaagctattgggctgatgaaggtgggagagtaaggaaggggtgaggaggaggtcatgggcagggaggatgcctggcaaccctagggcgaaagaccccttctggtgcccctccggtcctgtgggctgcaggaggtggtgcaaacagccagaagtgtcagccacacgggcgctcagcctggcctctctgtctcccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggtatgcccggctcgccgctgccctggtctggggaagctttcatgagggagggagactcttttgtgccagtccccttcatggtcctttcaccctctcagagaggcagtccttcctggggtccggcctgactcccttctgctgtggcctggggaggaggactgcagggaggcagtgccagccttggctgggttatttgtactgtgtgaccgtggacaaacacttgaatcactgtggcctggggcttctcaggagacagggaggggtggctggtgcagggcaaggaccttgcaggtgggcagccaggatgctcacctcacacccccagacgcttgtctctggcaggtgaacagttgtctgggagttcctgggacccctgatctaccggctgcttctgagctggggttgctcctcccctctccagcgtgagctctcaggggcctagcccacctgtgggagccctcccagcacgcccctggcccctgctggccacagctcagtgcgctggaaacagacccaggctgggacacaggagcccagagttccggtcctgggacaactcctcactcattgtgaatttggggctgcctccccatctctgggctccatttctcctgctggaacctgaggacatttatcaacttgacccctcagagtccctcctgccctaatgtaaacgttgtgttctctgagtccaggaaccaggggtcctgaccccaatccaaggctgtgagctagggggaggggtccctgacagcgaagcagaagtgtgggaagaagacagaaggggccccagggagcaaccaaagcccccgactagggctctgctcccatcaccacttcttttccagcagggaggagacactgattttgcagtgaatgaacccctctatccactttccctaggaccgggatctgcctgtacagctattgggggactcccccttggtcccacctatcagagaaccaaacaggggacttcactgtctgtgttcgtgtgctcacatgtctctctgtgtgcatcgcgtgctggccatggacatgcatgtgtgtatctctctgtgtgcatatagtgtctgcaaatacatgtcatgtgtacatgtaactgtgcagctctcacatgcatgccggaagctctggggctcctgcataactgttctcattggctacagctgtgctgaagaacataagtgggggctgatggagtgtggagggggcacagacccctacttcatgcccaaggacaccagccccttagttctccggaacccccagtacttccttcactctttccccagaatgcccctcctgctgcccccagcatcttctctcaggagaccctgctgaagcgtgacagcatagagtctagggctggaagacctagggccaggcaagccagggacaggctgcctctcctttccagaacctgcccagggctgggaggggcctttggcctggaggcaggaggaggctgtgttctcccgtccttcatgctgccacctggcagcctgcagggagctcagccgtccaaatgcatctgtctgcctctgccactctctcgcagtgctgtcagcttgcatcagccggagtgcaccccacacaggaggacgggggcagagtgcttgctccccagaagggcccagcagctttcctgtgacccaccctgtcctcattggggtgccacagaggcctgggttccagccctggctctgccactgagtctctgagtggccttgaacacaccataccctgcgagctatacaatgggtacatgtgtggagagggttagaagagatgacgctgaaggtctgatccagctctaaaatgccacatccagctgacttagcctgttcctctgacctccatgccctccttcctcattcccccacaaagtctagtgccatcacctaccaggtgatcccagaggcctcccagtgggtccccttgacaccctgcacccaggtgccagaatcctctcccctaactctcattttcacctccactctctctcacagaagaacttccattggctccctctttctgtcctgtaagcctgagtgctttagcctgagtattgtcacttgctgttgttgactttctcctttaactcagcgattcagcccctggtgtgctgtgagcgcttatccctgccagccagcgtctgcacaccccgcctcccttgtccacagtgccttctacccgccaccctcagatgtcttttgagtcccctccccaggaggactctaatcagtcctccccttggtattccctggagctgatagctgtagtttgcgcttgtcacgtgcctatctgtgactgcccgcgtcttctgtgtgtgtgagcctgtgtgatgcctcccttgttgggctgggagctcccccagggaaggggtcttgggtcacttgttggattgcgggttccctgatggttagggtgttgaggcgatgggagcacatgtcactggggaacttggcctcggacttggtgcccctcggacacccctcccgcaccctcccctgctgggctacttgggaggagataaggggtggcgggaacctgaaggggccctgcccactggagctgggccacccctggctgctgagggctggactgacgcccacacccactcctctgttccctgcaggaggaagagaatggaggccgtggaggaggtaagggaggactggcgggcgctggacctgcacaggactcctcttccagctcctgtctctccctgtcctcccctaagactgcctgtccttttctgtgcccccctcccttgactcctgttcctgcctttgctcctgtctgtgcccctggtctggccccctctgggcacctcctcctcactctctctgtcctccccctttcttttcgcacatttgtctcccttgggcatttcctccacagaagtttgctgagctcggcacactgtgggcggcactctggggcgcagatgggtgtctgccacctggcccctgccctcaagctgctcccagcctagaacaaggcagggcagggctgcagggcctgggggctggtggtgggagcgctgagcaaaggctgtccttggaggcggagacagtggagtcctggtggaagtcagggatcccccaaggtctttctctcatatgatgtgagcctgactccccttgctgtggctcttgctccccagaggcccctggtggacacccaggcccccaggttattcaaggcagagtgccttctctggcagccttcctgctctgccactggggctttcgctgggcagccataggacactcctgcatccccatccagaggccgtgatgagggaggagcccgctgacctagagcggcccatttctctgttagcttagagttagcagcacttaggagcagagaaactttgttggggtgcaatgcgatttgtgcccaccctaggggcctcggacctctgcttggagtccctgagcctggggaagggaggaggtgggggatgtgagtattaggtgtcttgctgggtctgcgggagtgggcatccctgtgaggagggcgtctgactctgccacatgtcttcagaactgttatggcctcttgtatggcgccctttcctctgtctcgtgacttgtgtgtgctgcacatgtgtgtgtgagaatctgcctcccccactggacagggagctctggaaggacaagggctgtgcttgttcatcctttttttttcttttgagatggagtcttgctctgtcacccaggctggagtgcagtggtgctatccgggctcactgcaacctccacctcccgggttcaagcaattcttctgcctcagcctcctgagtagctgggattacaggtgcccgccaccgcgcccggctaatttttttattttttagtagagacagggtttcaccatgttggccaggctggtcttgaactcctgacctcatgatctgtctcggcctcccaaagtgctgggattacaggcgtgaaccaccgcacccggccttttttttttttttttttttttgagacagtgtcttactttgtcacccaggctggagtgcagtggcacaatcccggcttaccacaacctctgcctcccaggttcaagtgtttctcctgcctcagcctcctgagtagctgggattacaggcatgcgtgccaccacacacagctaatttttgtatttttagtagagacagagattcaccatattggccaggctggtctcgaactcctgacctcaagtgatccacccgccttggcctcccaaagtactgggattacaggcgtgagctaccgtgcctggcctgttcatcctttttagtgtagtttttagcacatgaagaggacacaggaggtgtttacggagtgactctttgtatgtccccataggttttctttctcccaggtctgtgtcctcctgttgggttctgtgcctccatggacctgtccagtgtcctcgtggatgtttgagcctgtgcatgtttgtgaccggacgagtgcaatcattctctgagtgtgtgtcccctgtgtgtgtagctgtgcatgggtgtgaccttccccagccacccccagctaacctggctgatgcccactaggaccctccccccggtaccgcctggagcccatggacaccatctttgtcaagaatgtgaaggaagacggccctgcccatagggcggggcttcgcacaggtgagctggcccagttacctgggctctactttctaccttctggctaggattttattctcagatccaggtgttggggaggctcctgtccccacagtgttagccatgcctggtacaggggttctcagatggggcctttgatgccctttggtcaccactcatgcgctccttgtccccaggagaccggctggtaaaggtgaatggggaaagcgtcattgggaagacctactctcaggtcatagctctgatccagaataggtgagtgtccctgacccctcgtcccatattatctcccctcccctttgccctggggatgccctggagaccaggatcccttcctcctggaccctgttccttgacccagcctgacgttctgcctgtctctgtagtgatgacactctggagctgtctatcatgcccaaggacgaggacatcctccagctggtgagtccagcccctgtggcctgagaggagacccctgagccctggggcagcaccggctcccctgggaggcagagaaggaagtgtttggagggcacaggccgacattgcccagttggggatgccaggcccctccctgggctggggctggttgttgcttcattcggagctgctctgtgctgggggagcgggagacctggccttggcaggcaggattcctgccagggtatctggaaggagggtggcccagcaggctctgccagcctggcacgttcttgtcagctcctaggagagatgcctcttccctgcaccccctccctgtctggccctgagtgagggtgtctctggtgggtgtgtccacacaggcaccgagcacacatcgaacactgctcagcacactgcaccccacccaccgtcatgtgcaccacacagtacccgagcagtacacagccacacagcacagccccacagtcccaccctctgtatagcacgaagcacaccacaacacacatgcagcaccaggcacgtgccgcaatacagacaaccacacaagcacccactgccacagttcaccctcatacagcgaagtgcaccacaacacacacccacaaacattaaaacacgacacactcaccagccccttggctccctgcagtacaaacagcatagtaccttgcacactcggacctccacaactacacacccacgccgcactatcacaacatgtatgctcgcaaacaccgcggcatcctcctgcccatctcagcacgtgcgcccacccgtgtcacaggactccaaatttatacattcgacacctcagcatacctagaagacagcatccagcctgccacacagagagcgtggcccagacactgcacgaagcaggccctgcactcccaagcatacccttccacacacacacacacacactcacactcacacactgcctctttgtgcctggagccccggcggtccgctttgcccagtgcccacctccctggtctcatgggtcccagccagatggcggcttacttgcccctgaggtcactgtccctggggaggccctgggagccgctgtgctggcttctgccttggacgcactctcctaatcactgtaatcacagtgccatgcctggcatgatgcccttctggaaacctccacccctgacctcgattgtccccttgctcttcctggggagagggaggaaggagggggggatctgaggtggactgcttaccccaagtctcaaggccctgcctgtacagctcccccaggctgaggcgaggccagctatgggggagtgacagggtgggaccctagggtgtcccccactctctccagttggcaggggcaaggagtgggaagggcagtagcctcaagttctgctgcccaggctggggtgggctggcagcgccagatgacagcatctgggggcctccactggcccccgcatctctgccagccggagggtggggcccaggcattcctgtggttggaagccaaggctggaggccaatcgggcctcggcagctgctgacgccaccaccgacgcggcgaggcccctccacacccatcctctcctccctcctcctcccgccagccagccgagagagagtcgggtgggggtgagggggagccgcagggagggcagacggagggggaccggaggccctggccagggcaacacagtggtcagtgggggggttagccggagctgggggtgggcggaggcgggctgggatgctgccgccgccgtgatgatgccgggagcctggggagacggcgggatggcaggagggagaggtatgtgtgtgccggccctgtgccagctggagggggctgagtgtgcgggggtgtggtttagcttgtcctcatcacatgatgtttgtgcctgggactggaggtgtagttatttgtgtgtgtttcattgtgttttactgtgtgtgtgtgtgtctctgggtgtgtatcttccagtgtctcctcgtagtgtggtgtgtgtgtgtgtttggtttcaccctcccaccctttggttctttgccttgagttaggctcctgggcagctcagcaggggccaggctgggcccaggccacaaggccgctgtccctgggagctgactccttttttggctgggcctgggcgctggccctgtcactccttagcaatgcagcgtcagcctcagctcccagtgccaaattccaggcccaggggtggcagaaggtggctcaagtcccctccttcaagcctggcaggaggtgggcaaactccttctcacccctgtggctcaggagccagctccccattcccggggatggagggacagctgggctctgccagcctctgccccacccagacacacccctagccggctttcttctctcatctgccaccttgactggtctcggtggggttttccggctccacccgaggagctttgggcattggtggacataagggggcaggcaggcggtggaggccaggactgggggaggaccccaggaaacagatgctggaatgtttgtggctagggcagtccttgtcacagtcttagcgaaatcccacttttgctggagtttgcctgcgtctcaaaggcttcttgcttcttctttgttctctccctggacctgcccttccacccccacccacttatgcctctccctcgttccccccaccgcttggtcctctcccttcatttccctcctgggctccttgacctcctcgggctgccgttcccctaccctgtgggacttgtctggccctgcttacctgtctctgtgtctctggccaggcctactcccaggatgcctacctgaaagggaacgagccgtattctggagaggcccgcagcatcccagagccaccgccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattggtgagtgatggtacatgtggctgtcctggaggacttagctgtcggctgtctgtgtcctgctgtaccccatctgcctgtctgccatgggcagaattcggctgggtgctggtgggatcatcttgtttctctgtcaattcattcatctgttcatccatccatccatctgttcttccatctttctttctgttctctgtcatcctttcttccatcctacctctcattcatttatcctttcagcatctttccatgcactctttcttttttccctctccccatccatccatccatccatcatctgttcttccttccttctttccttcctctctccctcctttgttcattcatttgttccatccattcatccatctatccatccatctattcttccttctttccttcctctctccctccttcttttgttcattcatttgttccatcctttcttccacccattcatccatctttctttcctttgactcttccttccattctcccattcttccttccatcttccctttgtatctttccctctttgtcctttccatccaccctccatccctccatcgactcaacagatatttgtgtcaggccctgtgcatggctccatgctctcctggactggatggcccagcagagggtgttggacatgcagggacaatccattgggatgggcgtgtcgtgggacagggagcttgaggagaagggctcagagaagggctatggtgagaatcttggagaaagaacatttgggctaagacttgaaggatgagaaggagtttatcaggggaagaatattcaaggagagggaatagaatatgcaaagaccctgaagggagagaggcaggacccccttccaggttgtgaggaccctttcaggcccaagggtctcattagtcactggggttggcttttgagagcagagggaaccctctaaggcttgccttgccttcgactggatgcaggagagggagaggcaagagagtagagtggctgggtgatgcccaggtttctggccgggcttgggggtggtgcctcacccccgtgttgggagtgagagggggacaaagttcaggactgttgaatatgaggtgtccaagagggagcaggatagacggggctggggagaaagagcaagatgcagggtaatggagagggatggtggtagatgggagatgagctcaccctaccagacagtgagagggaggaggcctggggcagggggaagacacagccctggctcccccagccagccttcggtggagcagagacacagccccttctgctagtaaggaaggctctaggctgtggccgggagaggcagtctcttcttccacagcgcagtctgtttgagggggagatgtcatctctgcccttgaggagccccagctgatgggggagcttttgcccttaggaagctctcagtctgatggggaagacactgcccctgccctcaggaggctcttggtctgagaggggagacataattcattctctctgagtgccctcagtctgatgagggagacaccgtccctgccctcagcaggctcccagtctgatgggggaatattggctctgtcctctggagcccggtctaaggagggtggctcagccccactcctgagggtaaggattccatggccacagtctggacagtgggccagtcatgcttgacagtgggcatgttgccagcaggaccctttgggatgtgtctgagcctggaggcgagtggcacgggggctggcaaggctagggtggaggcaggcaggctccgctgtctgctgccttcacacctttctccttccacatgcatagatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagtgagcactccccacacccccagccccaccctctccctcgctgcccagtcccaggggtctctgttgggcctgctgcttgatgtctggcctcttcctctggtttccgcttctcctgcggccccttgggagagtcacctcctgcccctgcccagaagggagggctctgggaagcccctgacctgctgccccgctgaccctgaggcccgatgtgggcggctttgcaggcagcatcaaggctggccgccgctcctcctacctgctggccatcaccacggagcgctccaagtcctgcgatgatggactcaacaccttccgcgacgagggccgggttctgcggtgaggccctgtccggacacggggtggggtggccacagccaccgtggccagctgctctggggcagggctcttggccctgggggtcctctatgcatgggacagtgtgcctcccccgctggaaggcttctgggcttggggtttggtgggtgacgagatagtgaggtcccagctttgctgcccacatccctcaccctcgaccctcgctttccaggcgcctgccaaaccgcatacccagcctgcggatgctccggagcttcttcaccgacggggtgagagctgcaagtgtgtgtgcgtgcgcaggagcgagggtgtggggagagagggtgtcagggaggtggggccacagcctcggcatgggggttcctgctccagctcctgccttcctcctcctccctgcacccctcaccctcgtgtccaccgcgggacccgccctctgctgtgggccccgacatccctgaatgacaccatgcagccccgcccatgggccctcgtctggactgcctctttccagacccatcccccatagccacatgactcacttctcccctgtcttcgcggctttttaggtcttccctgaaattccagcctccgctcctgacatttcacgcctcccttcgctactctatgttttcctcctcagcacgcctcatgcacaattggtgtttcccttcctccctgcctggctccccagctagaatagaagctccctgaacttatatttggggcttcatttgtttccttcactaccctcagtcagtatttgcatcgcgtcttgtcttcatgggatggggtcggggtggacactggaaaggtgtggccgggacacagggttgagactggtggacaggtagagttcccagcctcaggacctggggaggcaggatcaggcctgtgatagccctggctgtttgtttgttttgagacagagtctcactccattgcccagtctggagtgcagtggcatgatcttggctcactgcaacctccaccttctgggttcaagctattctcctgcctcagcctcccgagcagctgggattacaggcgtgtgccaccacgcctgggtaatttttgtatttttaatagagactgggtttcaccatgttggccagactggtctcgaactcctgacgtcaggtgatccacccacctcggcctcccaaagtgttgggattacaggcgtgagccaccgcacctggcctcaaatgattttcttgcttcggtctcccaaaatgctgggattacaggcataagccatcacacctggacatatttttgtttttaaaatcatatatatatttttcatgcatgatttttctttctttttttttttttgagatggagtctcactctattgcccaggctggagtgcagtggcacgatctcagctcactgcaacctccacctcctgggttcaaccgattctcgtgcctcagcctcctgagtagctgggattacaggcatgcgccaccacacctggctaatttttgtgtttttagtagagatggggtttcaccatgttggccaggctgatcttgaactcctgacctcaagtgatccacctgtctcagcttcccaaagtgctgggattacaggcatgagccagcgtgcccgccccacctttccctggctgtttttgattatagatggactggaaaagccatcttgatgtcaagcgctctgtctcattggttggttgaacaccctggtgatattggcacctagcttatttcttatcactttttctgcttacttaactctcccttgacttgcgccctctggctggagtcctgttgagactgtcacttcctctgtttaactcctcgtggacatgactacctgctccactcactcagcctttgttgatgttcccacttcccctgtttatttaactcctcgttgacacgatcacttcctccatttccttgattcttctaagtctataaagttatgggaggctccgaattggctcctgtagtgtggtgaggcgtgtggtctgctgacaggtcgtagcctttcctcctttctggcttctcctttatgtacgtctcatgacctcaacacaagtggtccagagaggacaagcaatgcccatgaggtcgcacagcacatcggggtgtagcacagacatatatcaggcctgtgcggccacaagtggtccatggggttcctgagatgctggcattgtgggagccaccctaaattgtcctctgttgtctccctgcagtccttggatagctggggcacctctgaagatgctgacgctccttctaagcgacactcaacctctgacctctcagatgcgaccttcagcgatatcaggagagaaggctggttgtattataagcagattctcaccaagaaggggaaggtaagatgggtggaggaatgaggtggaagctggctccagcagaaccctccagcctctcctaggcctaccctgacagcctctggagccagagagaaccagtgtaggttgttgcatgaaggatggaggttagatgctaggaagaacttcctggcagggggatttaaagaacttatgtaaaagaagttaacaagagaggtggattttgctgtgggatggatctgatcgagtcatgcttggaatattctggcaaaaccatcccacacgggccctggcttgacaggccatcctgaagatggccgctggggctcatggaaaacaaggagcaaggccggggtgatttccgtaggagagctaaggcccaagaagacgcaggcaagccagcaaagggcttagtgttcatcctaagggcaaccaaaagctctcgggggctcttgccaagggagttacagctttaaaatattcatttggctccctgggagtgagttagggaggggccatgctggaggcaagaagaccaattaggagccaccgtggagatccagatgagaggcgaagggggcttcggggagtagttggggagggcctgggagggaaccagcaggactctgagaggagaagggcagggcccctggatccatggggtgcaaatcctggccccaggctgcgctgtgggctggagaagtgggaggagagaccactgccttccctcctggcgattaggatgaacccgggtttgactcttgactgcatcacccattgctctgagagcctgggtgactcacctggccatgactcagtgtcctctcctgtaaatggagctaacagtaatccctagctcataagcctattgctaaggattaaatgagatgatctaagtaaagggtttacccagtgcccggcacttgaagctgctgtacttctgcttactgctatttgttttctttttttgagacggagtctcgctctgttgcccaggctggagtgcagtggcgtgatctcggctcactacaacctccacctcctgggttcaagcaattctccagcctcagcctcctgggtagctgggactacaggcactcaccaccaaacccggctaattttttttttttttttttttgtatttttttagtagagacggagtttcaccatgttggtcaggctggtctcgaactcctgacctcaaattatgtgtctgcctcggcctcccaaagtgctgggattacaggcgtgagccaccgtgcccagcccgcttactgctatttgaattttctaccctgccttctggggtcttgggggtccctggaaagaacataagctttgaagcagacagactttgagttcctatccggccacatatcaagcacgtggctttgggcaccccacttaccttccctgagcctcactttctgatctgtacgatgggaacaatgttatcctaccccaagggctgctgtggattaagtgagggtgaagtcgaggcgggactggcgctcctctgtggagaatgactaaggccgccctgctcgggagcctccgtggaggttctggggagttagtggtaagggagccagggcagccctgccctcctggggctcctgtcgctcctgttgagcagagagaacgcatgtggcgtcatggttccaagtgcacagactgccgtgatgccggggtgcgggggcgggtgggcgtgggtagggaggtatccagaggctgagacacgaaagggtgagaagccacaaaactgggagacagtggaggggcctgacagggaagatgtctccttagagggtcctggggagaggggtgctgggagccagggcgagaggtggaagatgagctggggaattgggtgcctgcccagagtgtggggccttgatacccaggaagagcctgtccagggttttattattttattttattttatctatttttgagacggagtttcactctgttgcccaggctggagtacagtggtacgatctcagctcactgcaacctccgccccccaggttcaagcaattctcgagcctcagcctcctgagtagctaggactacaggcgcctgctaccacacccagctaatttttgtagttttagtagagactgggtttcactatgttggccaggctggtcttgaactcctgacctcaagtgatctgcctgccttggcctcccaaagtgcttggattacaggcgtgagccaccgtgcccagctctgtccagggttttaaatgtgggctggggatggcaggagactggggttatgtctgtgacaggaggagccaatcccattgcccttgtccaggtgagtgaggctgggggccctgacccaaggcagtggtgtgaggccgggtggagcagacactttagagagagattccaggggaaggagggccagggcttgccggctgctgggaggtatggaaggaggaggaggcgataaggttcctggattcctggcttgggctgagggagggtggtgggtggtgggaccctccctgggccatggcatactggaggaacaggtttggggagaggaagccaagtggctccactggggctatgtgagtctgagggccctgggacagaccccagtggaggtgtcctggggacagaggctctgagggcgtggcactagagggaggcccacctggggatggcctttgtctgtcagcaccgacgagttacctgtgcctctgtgcaggggcttgaaggaagaaggcaagagacccggctgagccttgagagaagtgggggggccggggaggctgacagagaccaaaaagagccagcaagttggcagtgacccatggggtgggagccatgaggcaaggagggaccagccatgtgcactgtgcgaggagagccacgtgtgggccagcccttccagtctaacgtgtgagccacatgaagggtccttgtgagggtggctggctccccctgccggggagcctgaccctcagctcctgggggccctgagcccagttcagggacaggagctgtccccttcctgctcactggccagttctggaggaccaggcctccactcccttgctggccaaaacccgatatcacttgttctcttggtgccgtggcctggacgttagaggagagtcttcaagtcagcctcaggcccttggtccacccaggccgtgggcaccctctctgtgctccctcccagccccagcctctttcagagacacggactgtcaggcagaggagggaaagggacagtgacttgtccccgcagcctcagccccagcatgggagctgcatgcagccttggtgaccaactctctcactcatttaccagccggagacactgaggcctgggagtgcggttgacttgtcctaggttatgcctctggtttagcctcagagaggtgcccttgtcaccacctcactgtcacattaaaattctccctggagggctctgctgtctcctgctctgaatgtccctgtccccatccagcagttctgtgatgagcagggctcacagctcaggatccacacgatgggaggccagatgtgggctgtgcccatctgccagccacggggtctctttgtctggtttgttcggagagctgaggcctgtgctggatgtggagccaccagccagcagagaggagctcttggtctgatgggagatggagctcctgccctcagggtgctccaaggatcattaattcatttattcaacaaatattgatgagcccttgcatgctgctgctgtaggccctgggatatggaaatgagaggacggacaagctccctgtccccaggacagcctgaggctgcagtaagttcttggaaaggatcaagctgatcagaagcgggagctgcattgagggaaaaatatggccagagaaggcctcactgaggaggtgacgttggtgatgctggagctcagatctgaaggggaagaaggaagcagccacatatagaagtgagggagggggcttaggcaaaaggaacagcaagcggagaggccctgagaaaggaaaggcttggctcgctcacctgcaagggccccctggcttgacatagtgagaaaggtgtgaagatgaatttggagaaaggcagggacagaccacaggagaccttagatttgattctgagggcgatgggatcccttgagaggatgctgagcaggggagagatgtgatctccttttcattctaacatgatcgctgcagctgctgctggagaatggttgcaggagcgagagtagagactgggaaggtctgtgcatcctctaagcaagaggcgttgatggcgtggaccgggtggtggcaggaaagacagagacgggatgttttggaggcagaatagttgtgacttcctgatggatgggatgtcaagggcgaggaaaagggaggagtcaagggcagctcccaggtttctgggcaactggatggattgactgggctggaaaagatgggggtggagagtggagaaggggtttgatggtaagaaatcacatggcctggcaagtattgtgcaaagtgcccatgggacctgcaaatgaagccactgagcagggtgggggtgccgggctgtggctgggagagacgctgggcttgggaatggccatcagcagatggacctagtttaaaggcacggcagaggtgacatccttgagggaggtgtgcagggagaggagaggagaggagagtcaggacaaagttctggagctccgcctcctttagggcggggtctcttaccctcagctctgctgacattttgggccagataattccttgttgggggaggctgtcctgtgcattgtgcaatgtttagccgcatccctcagatgccatagcacaccctccagctccctccacacaaatgtcccgtggggactagtctcctggctgtttaactacaggtgtagagggtgggggagggcaagtagagaagactaggaaggagccagtggcattaggaagaaagctgggaacgtggggtctcaggtgccgagatagggtctggagagggaaggaggggctggctgtgtcagatgccgctgaggggttaaggcaagttggggagaagcagccactggctttggccacatggcggttctgggtgtccctgagaaggagcttctgggcaagtggagtcttgggtgggcggcaggaaagtggggagaacaaccctctaagagtgcggacggcttctgagcaggtttgctgggatgaggggcagcctggggaggggcgtgggctgggaatggcatccccaggatttcatgtatggagggccatgctgggtgtctgagcattgccaccgctcggtgagtgttgatgctggtgtttagagggggagagggttggggtctgctggggggctttaggatgatgggtaggggtgtctaggcaggcaaggggctgagaaggcattggtgggctgtgggcaggaggctgcccaggtctagccgggtggagcagggggctcctggtaggcagcgtggggtccatcccctggctgtcctctgtctgctactctgagagcagtgggcaaaactggcctctcaccattcctgtctcccccaaccccgtgtctccctgcagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggtgagggcccggccagcccggcagccacagagggcgggcggggtggcctctcaccggctgtggacctgggatgcccgctctgagcctcacttccctctgctagaaaggggggctgacaggagtgcacctcgtgattgtgtcccccaaggtttcggggtgaggagggtgcacaggcagggctcacgggggacctggcgtcctcaggtgcggggaccggcagtcaccatcctgaccctaatgatgacagggatgattgtgactgtgttaggatcgccttgagcaggctccggtgtggagtggtcagctccaggccagtctcagcttttctcagcaggcgaggaaggcaggggcctcctatggagtgtgttagggcatgagtgtccccgcaccagaactgcactgggctggcctgtctgcagaaggatgagcacattgaccttgtgaggaggccgagaggcttggcctttggccacaggtgggcaggggtggagccaagggcctcggcagggattttgggataatttttttttttttttgaggcagagtctcgctctgttgcccaggctggagtgcagtggcgcgatctcagctcactgcaacctccgcctcccaggttcaagtgattctcctgccttagcctcccgagtagctgggactataggcgcatgccaccatgcccggctaatttttttttagtagagatggggtttcactgtgttagccaggatggtcttgatctcctgacctcgtgatcctcccgcctcagcctcccaaagtgctgggattacaggtgtgagctactgtgcccagccgaagaattttttttaatggtgcccattgtggtcagccatagctacactccaggggcctaggtagggattcctccctgtttacttctttggccaggaacctacacagaagtgccttgagacacccacacaaagtcatgtgggcgtcccaggcctggggtctctgccaagagggcagtgggcctgggcctgctgtggccgtgggagggggtgctagtgcatggcctcttgctgaggtcacatcctcttactgaccaggctctgctctcccgggaacagctttccccactgcagggaggaaggcacctggaatttgggcctcctcctctgggggcctctcttggctgtccccaacaaggcttagtcaggggatcccaagtcaccatcactatggcagtagcagtccctcctggggcacctcctccatgcctgctcagtgtctgccaggacggtggcgagtgctgcatgattctgcacccggccctgagccttccctgttagccccccatgtttattaccgaggagactgaggctcagagaggctaagaggcttccccaaggcctcagctggtgagagggtgctggggagtccaggcctggtctttctcactccagggtctgggctgtccacctggcaggtggacaagaggggaagcagggctagggatgagccctggggtgggctggctgtgggcactgacatgatccgctctctcctctcctgcttcaggaccccggctgtgccaaccaagctctgatcagcaagaagcttaacgattatcgcaaagtgaggtgaggcccagccctcgtggagcagtctcctctgtgggggtggtagggggctgaaggcaaaggatgtcttcctggcccacctccagggctgccctctgctgggggaaggggtatccagggtctccaggctgcagttaggcatggaggcattgcctcagggtggaggggaggtcccgaggggcgggaggccagggtgggtggcctgcttggccaccccaaatgaagacctctcctctccccctttttcctacacagccatagctctgggcccaaagctgattcctcccccaaaggctctcgcggcctggggggcctcaagtctgagttcctcaagcagagtgcggcacgtggcctcaggactcaggacctgcccgcagggagcaagggtaggaaggtggccactgagacagggtggtgtgtgggggcagggggcatggggaggggagggcacgcgtgtgtgtgttgggctgtgtctgctcatgtgtgcctgactgtgtgccagggctaccggtatgtctgtctgcgtgtgcatgcctgtgagggtctaggggctctcagggtctcggggtggaagggcctggagcctgattcccgtccctgacatccctgctgggtggtcctctaatctttgctggtgtctctgcagggatgagaggcccaccctttccaagagcaacctttcccatttcactcacctttggctgttagaaagttcttacctggctgggcaaggtggctcacacgtgtaatcccagcactttgggaggccaaggcagggcagatcacctgaggtcaggagttcaagaccagcctgaccaacatggtgaaaccccaactctactaaaaatacaaaaggccgggcgcgatggctcacgcctgtaatcccagcactttgggaggccgaggtgggcggatcacgaggtcaggagatcgagaccatcctggctaacacggtgaaaccccgtctctactaaaaaatacaaaaaattagccgggtgtggtggcaggcacctgtagtcccagctactcaggaggctgaggcaggagaatggcatgaacctgggaggcggagcttgcattgagccaagatcgcgccactgcactctagcctgggtgacagagcgagactccatctcaaaaaaaaaaatacaataaaagtacccgggcgtggtggtgtgcgcctgtaatcccaactacttgggaggctgagacacgagaatcacttgagcctgggaggtggaggttgcagtgagccgagatcacaccactgcactccagcctgggtgacagagtgagaccctgtctcaaaaaaaaaaaaaaaaaaaaagaaagaaagttgttcccttgggccagcagacatggtggctgacacctataatcccagcatcattttgggaggctgaggctggaggattgcttgaggccaggagtttgagaccagcctgggtaacatagaaaggtcctatccctacaaaatattttttttatatattatttatttatttagagacagagtctcattctgtcactcaggctggagtgatctcagctcattgcaacctccacctcttaggttcaagcgattcttgtgcctcagccccgctagtaactgggattacaggcatgtgccaccacgcccggctaattttttttttttatttttttttgagacggagtctcgctctgttgcccaggctggagtgcagtggtgtgatgtcggctcactgcaagctccgcctcctgggttcacgccattctcctgcctcagcctcccgagtagctgggactacaggcgcccaccaccacgcctggctaatttttttgtatttttagcagagacagggtttcaccgtgttagccaggatggtctcgatctcctgacctcgtgatccgcccgcctcggcctcccatagtgctgggattacaggcgtaagccaccgcgcccggcccacgcccggctaatttttgtatgtttagtagagacagggttttgccatgttggccagctggtctcgaactcctggcctcatgtggtcctgccggcctcagcttcccaaagtgctgggattacaagcataagccactgtgcttggcaaaaaaaattttttttaattagccaggtgtggtggtatgagcttatagtcccagccactcgggaggctggggagggaagattgcttgagcccaggaatttgaggctgcattgagctatgatcataccactgcactacagcctgagcgacagagactctatctctaaagaaacaaagttctatggcttccgccttgtagttttggcccacgagccacacggaagtccttgcattgctctgggcctctcctttggggtaagcatcctccccttcaggccttctctcttgccatacaatgtcccatcagccctgggcatctggtttcttctctgatggaatccccatacgtccaaatgtgtgaatgtggcagtgaatgtgtgtgaccctcctggataccccagctcactctggctctgtctcccccacttcagatgacagtgctgcagcccccaaaaccccctggggcatcaacatcatcaagaaaaataagaaggccgctccgagggcgtttggggtcaggctggaggagtgccagccagccacggagaaccaggtgagtctctgccacacgccagagcaggcccagcagggggagaccgaggcacagagggtcagagcagcaagggacatggaaccagctctccacctcattgtacaaacacagctgggaaaacagcccagagaggggaaggcccccgcctgccccgggcctcccagggagggagcagcagggctgaggctgagcccggctccttctcagaccatggcgaggctttggtgtcatttttagctcccagactggaggcagcaagggccttttgttccccccaagggttcctggcagcagctctgggccttgcattgtccccttcttggcctccccagctcctctggcccctgtcccccctaacacccctcccatgtgtccccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgaggtgggtgaagctggggggtctgtggaagaggggctgagatggtgtgtgggtggtgctccgcttggagagttctgtggtctattgtgttgcatgcattgtgccctatgacatgcccggcattggtccagaacaccaagatgggcaagatgggacctgcccccgctggccagcccggggatgggcatcaccccaggctgaagctgaccaagtaaatgcagtcatggcctggggagctctgaggcagaggctcacagatggcagttttgtccgagtgtttaggatgagtagagttcaccaaaggccggtgaaagccaggtgagggcattccaggcagcagaatggcctgctcaatggtgtagacgcggaaagtgtgccaggagtcaaccagctttctctgtagaaggcagagggtaaatattttctgctgtagtttgctctgttgcgttccccccttctcttcctcctccttctcttcctaatcctttaacaacgtaaaaaccatacttagctcaagggccatccaaaagcaggctgtggctagatattgcctacagaccatggtttacaaaccgccggcttagaaaaaggggaatatatgatgttttctagaatggccagcaatttgggtggctgcaacatggaaagagaagtggctgatcaggcgagatgagaccagcctgtgaagggatctgcaatcacacttaagtgtttccagcaaggccggcgattctcaaagggtgttccccagagtcctagggttccccagaggggccttgggaggccaggggcaggtcaggaccccctgtccttgctagagcaaccctgctttgccctgtctgttgtactgggttttcatgtacaattttatttgcccaaaggggctctgataaaaaagatattttggaaaaccgtgaacgtgggcagtgatgtcccacgaatcacacacgtgaaggctcatggaatacacaagtcttcctgtccttggagaatgaggagctgagacaagtgtgtgtgaaattgtggacaagagaaaaagatgatctctcatcagggaccacactgtgatgaggaaggagagggtgctcaggctggagcaggtggtggctggagggtttgagtattggaggaatgaataggagggggcaggtggacgggaagcctttcggggtgtgagacgatggcattttccaaaaccccagcaagggccggggagggcttgagggttaggacagagagtggatctacctcctgggcttggaggtggggagggtgaggccccagggggacagagaaggcatttgatggcttcactgaagacttcgaccttgatctgatggacagtagggagcttctgatggttcttaagctggggaggcatcgtgagaacaaagttcaagaaacagtaatgctcctgctcatgtccattggatacgaatgcggagggcaggggtctggggagaagtcactgatctatggaagcgctaagtgtcgggaggacttggtggtctcaggggaagggggaggatgggagcaaccctaagagttgtctgcatgagagggaggaaggaggggcgaggaagagccgcatgtttgagctggggctggtggtatcttcccttggcagaaaccagggagtggggcagcgtgaggagaggcggaagggaggggccgtctcagggagtggctccattggatttggggtgtggaaagtcccttgcatggggtgagggcataaacaggcgctatattgagcctggactagagagtggcatgggtcctgctgcagctgaggcatgggatgaccaagggtgggccgcagaacagcaggggccacgctctgagtgggacagaaggagagggccgccagtgaggctggggtgagggcagacacttcactctggaggaaccaggaagcactggccagggcattgggtttggcagctgggagatgagaggagctcacacctgagggccaggaggtaacggagtcgggtgggcaggagccgcactgggtgtgtgtgagatgagggggccatgctggcaggcagctggtccaagccagggccagctgggggcatacgaggtatattgggtgtgttgttttgtcttggatatcattgtgtcatttgttgtgggtcgtgctgggagtaagtgtagtgggggatgaatctaacccctggtgagcctgtggggagtgtattgtttatgggattgtctggcattaagctgtggatccattgtaatgagtgtgtgtactgctgtactgtgtctctttgttgggggtattaggtcgctttctgggcctgagttattctgagccattcccagcgaggcggctgtgcccaacttggttgcaatgtggggtgatggtgccccctggaggacagaagggacaacgacccggccgttagttcttgtactcgacaaccatttattttagagtagggtttctcaatctcagtggacattttgggaagaacaattatttgttgtgtggggttgtcctgtgcactggagggaatttgacatcatccctggcctcgatccactagatgcaagtggcacctcccagttgggaaaatcaaaatggctccagacattgtcaaatgtcctctgtgggtggagtgggagtttgggggacaaaattgcctccttctgttagaactactgatttagggccatgtaagtaccaggttaactgtccttgctaggtgataggagcacagtgggaaatgagacagacgggatcctgtctcctcctggagcttacagtcctgcagggagacaggcatgaacacggaaacaaaagcagaaaataatgacaaattgggttaagcgccaggaaggaaacaaagtcagggctggggtgcaggtgacagggcagtggtgaaggtggctgctttagctatgagggtcagagaaggcctctttgaagagcgacttttaggcggggatgaggagccagttgtgtggaggcggggaggaaagttctggttgaggaaaccagcacatgcagaggacctgagacaggaaggagccggcacgaatgactgctgtgtcacggatgcttaaactgtgcccagtggaggcagcagctgccactcactgtctccccacagtgcctgggactttctgtgcatggggaggtgttggagcccacgcactggcaggagcagggaggggctggggccaagtgtgagtgtgggcacaggacctctctggggactcagttctgctgccaccatcctgatgagtagagagcttggtctaagtaggtcccagggagggcctggtgggcttgattgggctctggggtgaatgatcgtggaggcatgggcatcgggctgggcctgcctgtgcctgacatctgacccctcccccagcgctggcaagacctcaatgtgatcagcagcctgctcaagtccttcttccgaaagctgcccgagcctcttttcactgatggtgagtaggaggtggaagtggggcggggaggggacaccagtccgtgcctcaccctgaccactacttttgcatttggtttgttggttttactctttttttttttttttgagacagtcttgctctgttgcccaggctggagtgcagtggcgcaatcacggctcattgcagcctcaagctactgggctcaagcgatcctcccacctcagcctcctgagtagctgagacagcaggtgaacaccaccacacccagctaatttaaaagttttttttcagagatggggggagtttctcactatgttgctcagactggtgttgcactcctgggctcaatcaatcctcctgcctgccccagcctcacaaaatgctgggattacaggcatgagccaccacgctggcttttttttttttttttttttaacacaaaagcttatttaaaaaacatagattgtacagatgtgaatgaagaaaacagcacaggaccctgtgaatgtcctgctccctttcacgggaggttgtggctaacactttctgagcattagagtgtgccaagcacaactccctacagcaactccatgaggaaggtgctattgtcttccctctacagattaggaaaccaaggctcagagaagtttaatgccttgcccaaggtcgcacaggttgtaaatggcagagccaggattccaccccaggcgtcgggcaccgacgggctttggccgtttgctgaactgcttattcacaatctgttgtgtttctctcctggccctcttatatgcatggcagagatacacacgtgcctgcgtggggtttggatttgggtgggttcaggggtgtgctggcagatgtttaacatctgtctctgggggaaaaaagccctaatgcctagcgttttccagcttccatggcgtaaatactcctaccatggtttatttcaagccaccaacatgatgtcaccaacatggaattgggaagagaggcacacagtcgctctcaggagctggtgtgagcgggctccagcacaccgctggttgagttgtttttaacaaaagcagagttgtaattctgagattcattcgtgtcagtgcagagagctctacctcattcttcttttaaatcagccacatagaatttcatggtttgaatagactacaatttctttaagtactcctctattgatggatatttaggttgtcttcaaatgtttgctattacacaacctgttgcaatggctttccttgaataagtccttgcacgcctggatctgtgctctctaaggagattcttagatgtagaattgctgggtcaaagtcccggtgaacctttctgagaccagtgtcaattgcactctgagaaagaggccctggtttagactcccactaaaatgtaggagtctgtctctccacatccccaacagcattggatattataactattattgttacttgaaggccaggcatggtggcttatgcctgtgatcccagcactttggaaggctgaggcgggtggatcacctgaggtcaggagttcaagaccagcctgactgtggtgaaaccccgtctctactaaaaatacaaaaattagctggatgtggtggcgggtgcctgtagtcccagctgctagggaggccgagacaggagaattgcttgatcccaggaggcagaggttgcagtgagccaagatcgcaccactgcacttcagcctgggtgacagagcaagactccatctcaaaataaataaataaataaataatacaataaaataaaaataaaaatactattatttgacacagaatcttgctctgttgcccagactggaatgcagtggcgcaatcatggctcactgcagcctcaacctcctgggctcaagtgatcctcccatctcagcctcctgagtagttgggactacaggtttgtgccaccacacccagctaattaaaaaaaaattttttttggtagaggcagggtctcactacattgctcagactggtcttcaactcctggtctaaagtgatcatcgcgcctcggcctttcaaagtgctgggattttaggcttgagccacctcacccagacagcattaaatattattaacattttaaacttttgctaatcagataagggaaatggtatctcattattgtttttattttcattgccctcattactagggagattaaatcttttttcattagcatattggctgtttctattttctctgtaattgctcgatcagaccatgtgcccatttttctgttgcgttgtttatctttttcttatgttgatttgcgggagaaaagctctttgtgttttacagctattaaccctttgttagtttttgcaaatatttgctttggcctgccatttgcctttcactttgcagtatagaaactgaaaacaaattttttgttgttgttgttttgttttgttttttgagacagagtttcactcttgtcgcccaagctggagtgcaatggtgtgatcttggctcactgcaacctctgcctcctgggttcaagcgattctcctgcctcagtctcccgaacagctgggattacaggtgcccaccatcatgcccagctaatttttgtatttttggtagagacggggtttcaccacgttggccaggctggtcttgaactcctgacctcaggtgattcaccctccttggcctcccaaagtgctgggattacaggcgtgagccaccgcgccctgcctaacaatttttaattttatttttatttaattttatttattttcttgagactgagtctcaccctgtcatccaggctggagtgcagtgttacgatctcggctcactgcaacctccgcctcccgggttcaagccattctcctgtctcagcctcccaagtagctgggattacaggcgcctaccaccatgcccagttaatttttatatttttagtaaagatgaggttttgccacattggccaggctggtcttgaactcctgatctcaagtgatcagctgatgcgcctcagccttccaaagtgctgggattacagatgtgagccactgtgcctggccgaaaacaattgtttaaaatgtgaccaaagctgttcatcttttcttcatggattctgcatctcatgtttaggatggccttaggattataaaaatattttcttactttttccccagtgcttttataattttcacagttggctctgccgtgtgattgcatttgtgtattgtgagctagaaatgatccccccgcccccgatggtagccatttgtcccggggacatctgttgaggcccccatccttccccccgattggaagtgctgcctttatcatataataaatatccatatggcccgcttcccccctttctagccttaacattgctctgccttttctgccgtgccagccggcttcagttgtgccatccattcgggatgtttcagtccctggtagggcagatcctcccgcgttactctttctttaaaaactattcctggctgtctttgtgcgttagctcatccagatgaatttcagaataggcttatcatgttccattttttaaaggtccccatggacttgttctgaagggagttggggtaatccttggtggaggctgtctgaagcccctcctcctctccaggtgcccttctcttctgacctgctgaaccttggtgtccatgtcctggagacgggggcagggaccccttttctgggatcagcatgcagctcagatggtattgcctcccaaatgaacacagctgggctaccccaggtcaggtgcacacccgagtgtagctgtggtgagtgcagctgtggtgagtgcagctgtggtgggtgtgttcacatacacaagaggctgtcgcccacgctggagcccccgaactggaggagttcaaaacacagccctcccagcagggcccttggccgggagaacaggggaaggcgctgcccccacctctctaaagagtctccgctgtgttctagacaaatacaacgacttcatcgaggccaaccgcattgaggacgcacgggagcgaatgaggacgctgcggaagctggtaaggagagagaggtgctgtcagacacgaggtggggcagctgcctgagcacctctgtcccaggaggcagggagtccggtgctgcccacgacccctgtggccttggagaagccccgctccactcagggcctcagtttccccgtccatacaagagaacggggggttagaggataggttccagactccctgaggcatggtagtgggagatctttggggcatggtgatgacgggggacaggggcaggcccttacagcctgtccccatgcccctcctctctcctgctcagatccgggatctcccaggacactactatgaaacgctcaaattccttgtgggccatctcaagaccatcgctgaccactctgagaaaaacaaggtgggtaggagtcccgcatggagtctgggggaggcaagcacggacttactgtgtgagggccctcagcacgcactgagctccagcaggtccagtaactcaggcccctctaggcacgccctcctcctatgactgctccgtccccaccccgctcctacatgctggtcagtgctttcccccagagagccatctcctgagtttctgagggctttccagaggcagggaaccccggccccccgtatccgatgcattgccatcctccgacttagctcaagtccctcgcattgcattttcctcatcaaaccccttatgccttctggttctgcagtggggaaaatgaggggagtgataggattttttgtgttttgtttgtttgtttgtttgttttgagacgaagtctcactctgccgctcaggctgcagtgccttggcacgatctcggcttactgcaaccttcgcctcccgggttcaagcgatgctcctgcctcagcctcccgagtagctgggattacaggcacctggaagtgatcggattatttcccaggcctaaaataacccctgggacctccaacatgtttcctactgcagggtctcccactgctggcactgaccactcagggctgccttgtataggtgtgcaggttgggcactgctcatggctgctgggcctggggatgaaaggggctgaaatctggtctgtgctctactcatcaagcatctccatgcccatacaagggggtgtccaccctctaagctggggactggtgaggatgtagttggggacagaggcctcaggtgccagagtgagggaggactgaggtcaggatgttgacagtgacctgctttccctgctgcccagatggaaccccggaacctggccctggtctttgggccgacactggtgaggacgtctgaggacaacatgacagacatggtgacccacatgcctgaccgctacaagatcgtggagacactgatccagcacgtaagcccctgttccggggggcgcccggcagcccctggggcccaggccatgttcctctgagcccctcgctcttgctccgcctggcggagtgtgccccaggaagggctcggcagctttagagcatgctgctagggtggtatatactcctccaaagccatgggctgcatttcaaggcaaggcaggaatggatcctggaatccctgctgccctgggatgttgtgtccccagcaggagagtcaagaggcccccgagcttccgagatgcctgggaaaggtagaagaggaggaagggcagggaaggtgctactggtggagggcggaaggggcagcttcagaagttggcccctggagaggtgtcctggcagacacgagcagacgggggccaaggtctggcctgatatcaggaggccccggctctagtgactttccctgctggccccactgaggttttggggagatagtggtgatgttcctggtaacaaggggtggatggggcagggcacagggccttggcctgaggcaggatcctgcaccagtgcttggcatgtactgggctggccacctcccttctcatggcttcctggatgccaacagccctggtcctgtaggttcttgttactgtgcatgggcggaggagaacccagagtggccagcagagggcgcagaaggccttggttttcgagagcccaaccctaaggcagcactgccgccttctggtgtgcacacggatatcattatgaatcgtagattttccatttccaattcttgttacagcccacaaaggatgagaacagagcccctcctgccaggggaaataagactggcagctggtcagaggaagggaagcctcagtcccaagccccctagacactttagggaaggaaagctgggccctatcacccccattttacagaggaggaaacaggctcagagaggcaaagcaacttgctcatggtcacacagctaataagtggcagcccaagatttcaagccagatctgactaaccaaagcctgtgctttcctcctgctatcaacccaaaggccagactcctgggtccctccttgagctggcttgggacggagggagggggccagggtaaggaggcgaggtggtgagcagctgagccatgttaacagccttgcttgcccatctccctccttcactgcatgctcagggctccgagccacaggagggaagatcacagcctgctgcatccggacactgggaacaccactccagagctgtctgggaggccagggctgccctgcagcgtcggggatcctgatgaggccttgggaaagcttagctctccagggcaccagggagccccggaacctcccgtgagggtgtgttttgggggcagcagcagggaagaatgggtgtctggccctgtgctcctggagaagtccctggaagcccaaggtctgaggtcagctgaggtgtcaggaactgcagccttcagggaggaaggaggccaaagccccaagggggagtccctgctctgggcagggtggagaaggtggagtttgtctcatttagcactgacactactggcacacagtggctactcagtgtttgtggagtataaatgactgagtaaattgctaattgaggttacgtcaggctgggcttttctttctctttctctctctctcttttcgctttttttttgtttttttgttttttttttgatagagtctcagtctgtcgcccacactggagtgcagtgggcagatacggcccacttccaggctcaggcgatcctgccatctcagcctcctgagtagctgggactagagatgccaccaccacaccacctggctaatttttgtattcttttgtagagatgaggtcttactatgttgccagggctagtcttgaactcctggactcaagcgatcctcccatctcggcctcccaaagtgctgggattacaggtgtgagccatcacgcccagccaggctgggcttttctactcagagattcattcccgagagctaactgagctagtgtccttcccttctctgcctccttggcatctgaacgtaaccagccctggatgattgtcgagggaatgagccacccactctgcaagccctgaaagcctgcccacccaagcgtgccagctctgtctagcctggaggctccatagccagggcagtgctgctgtcacttggggtacccagaccagtcttcaggtcggaaagagcgtggcaactgaggggtaaagaggaacagcgacttgcccagggccacgcagcaagataatggcagagcagagaggagagcaaacctgggtgtctgatcttgcagcgggcaagttgccaggagcccctacctatgtttacgaagtcaaatggaacccaaacaaagatcacccagggcatttgctcagggactcactcagcaaaggcagcgatacctaatgtttctcagcctcagcactagtgagcgctggggtccagataagtctttcttgtgggaggctgttctgtgtgttacaggacatttagcagcatcgctggcttctacctgctggatgctgggaatatcactctagttgtcacaatcgaaaatgtctccagacattgccaagtgcccactggggtggggggattgacggcagtggctctggggccagcctgctcctatgtgctgtgtggccttggacaagttccttacctgctgtgcctcagtctccacacctgtaaagcagagatgacaatactgtttacctcacatcgttgtgaatgtctgctaaagcactcgcggcggtgcctggcaggtcctaagtgtcgtgtgagaacggactgtcatcctcttcgtcgtggtcattattccacgccagagacagatccccgtgctgggaacacggaggtgaatgggagcctgctcagaaggaatattgccagcgggtgtggtggtgcgtgtctgtggtctcaactacttggggggctgaggtgggaggctgcagtgagccgagattgcgaaactgcactccagcctgggtgacagagtgagaccctgacacacacacacacacacaaaaatccattaaaaaaatgatgcttctcattcatttattcttttaataatgtttatcaaagtaagagctgcgtctctttgtgctctgggctatgcccaaggaagccccacagaaggacccaccccggccctgggtgcagggctggggtcgtagtcatggagttcttgaactgccttagaggaccatgatgagaacttagccaggcagagcagggagaaagggcatcccaggcggaaagaacagcacgtgcagaaacagggtggcaggaactagtgtggattcctcttgagagccgtggccacccgggcgcttcctgtagacgctgtggcttgcagagtacttctgggcaccttccaacctgcattaacggctggcttctttgggccgatcctcaggcttcccctggtcagcctgtctctggaagccacacttttgaatagcagtagctgacatctattatacattaacaatgtgctgcactcgacgttttccatacagtatttcatctcaatcctcctcaggcctagaaggaggtactcacatcatgcccattttagagataagtaaatagacttacagagggaaagtaacttggctaaggtgaacttgaaccaagatgactgactccagagcttccatttttctttttctttttttttttttttttttttgagacagagtctcactctgtcgcccaggctggagtgcaacggcgcggtctccactcactgcagcctccagctcctgggctcaagtgatcctcccacctcagcacccccaagtagctgggattatgggtgcatgccaccatgccgggctaatttttgtatttttagtagagctggggtttcaccctgttggccaggctggtcttgaactcctgacctcagctgatgcacctgcctcagcctcccaaagtgctgggactataggtgtgagccactgtgcccggccagagcttgcatttttcttatcttcctttgctgtcttctcttctatctctttcttctttcccttctggccttcctgtgctgtttgagttaatcacatgtcagatcatgagcgataataactgaggctcatggcgtatgctcaggcaagtccccttgtttcccctcttcattcccctaggtgcccactcttaataggctaatatgtgtccttccaggacaccttccacttattgtaaatgcatggctacccttaaatatatataatattctttgtgtgttttaagtctacataatgagattataaattgcctgttcctcttctttcataggtgttgaggggggtaaagggtaattgccttaatttttattcatttattttttttgagatggagtttcactcttgttgtccaggctggagtacagtggtgcgacctcagctcactgcaacctctgcctcccgggttcaagcaattcccccacctcaccctcctgagtagctgggattacaggtgcgcacaaccatgcccagctaatttttatatttttagtagagatggggtttcaccatattggccaggttggtctcaaactcctgacctcaggtgatccgcccgcctcagcctcccaaagtgctgggattacagatgtgagtcactgcaccgggcctgtcactatcaatttctaatgcttatcagtttctgtgtcttccttccaccacatctaaaagccaaaagtggtagggtgcagtggctcatgcttgtaatcccaaaatctacaatttttttttttttaattagctgtgcaaggtggcacatgcctgtagtcccagctattcaggaggctgaggtgggagaatctcttgagcccaggagttcaagggtacagtgagctaggatcaggccacagcattccaacctggataacagcgagagaccctatctcaaaaataaatacataaatacaataaaagccaaaagtgccttagttatttcttggagcttgccgaaggtcatctctttacttgctcaagtattcagttaagagagtctttgtgtagtaaattttctgatgtctcaggatagctttatttcaaggccaggtgtggtggctccagagagcaggaggttcacttaaggggtgattaaaacaatctgtggtatgcctgtaatcccagcactttgggaggtggaggtgggcggatcacttgaggtcaggagttgagaccagtctggccaacatgacgaaaccccatctctactaaaaatacaaaaattatccaggcgtgatggcgtgcacctgtaatcccagctacttgggaggctgaagccagagaatcacttgaacacaggaggcagaggttgcagtgagccaagattgcaccactgcactccagcctgggtgacagagtgagattctgttggaaaaaaaaaaaaaagaatagctttattttacactcagatttaaatgagagtttagcagggtataaaattctaggttccttcaacacgtcaaaacttactttcttgtcttcttgtgttttgctgctgaaagttccaagtacctgtgatacgtgttcatttataagcaatctggattttttttttcagaaaacttagaattttatcttcaagattctcaaattttacaaaatatattaaactgtgggggtctttattttctctcttgtttggcctttatgagaaagctctcgcctcctgcccctcaggaaacctccaacgcctttctcctgtcatttccttttctgggctgagtacgtgacacccctgttgtcagtgtggcacccatgggtggcaggtggcgtggggcacactcggctgtcacagccatggacctggccaacactaatggcactggtgcctccctgccccccggctcgctgtggggagtataccacaggggtgtgcccaggacagtgtttagagaaaagcaagtaaaagcgaagctctccctaagcctatctcctgtctgaggtgaatgctcccactccctgccgtgtctcctcccacactggggtcccaccttttctctcccccagggtttttcatagtctgtggagtcaggttttagggtccgtcaagctccctctgagccctcttttgcagccccgccagcctggggtttgttgagagagaggcgccccttgccacctgagcgggtcctctggaatgagcaggtggaagagactcttctttcccatgctgatttcatcccttccttttgtcttctctgcagtcagactggttcttcagtgacgaagaggacaagggagagagagtaagtgatgccgcgggctgggctggcatgggggctggtctggggtgagccccagtccttgggggtggggcaggcagcgggacttaagccggggaaggtgtctgtccttgaggcttccctcaagtctggtggaggaaacacagaccctctcctcaggagcccctagtctgatagagaagcacaaagcttgccttcaggaatccccagtcgaaatgggggagatataggccttgctcagagggaacccagttcaggagtaaaggcagctcctgccctccaggctactgagaaggacttaggttggaggagttccagtctggtgcgggagacacagctcctgcccctagctgaaggggccgctctggccttcgcggttcccaggtgttgaggaaggcacaaaactgtctaataggggacatgtaggaatcatcctcaagagcgcccggctgatgagggagacggtccctgccccagtgagcccggtctgatggaggagacatgggctctgtcatcagggcacccccctctggggggttggcagcccagcatctgagggcatgccagctgacccctcctcctgttcgcagacccctgtgggcgacaaggagcctcaggcagtgcccaacattgagtacctcctgcccaacattggcaggacagtgccccctggcgacccggggtcaggtgagcgcaggggcctgggagtggggaggcgggaggttggacactgcattcctgagggtcccaggtgcctggccagatgcccagcttccctgtgccaccccagcggggccctcccctgccggccaccatggagatggggctgttgggggccttctccctccctagggaagtccagcttgccccgtgcccacctcctgtctgcgcagctgccccgccccgggcagggtcggagctttgttcgccctctctcactggtttctttcctcagcctttaatttctcatgggctggctgtgtccttctgggcatgttcctctttttaatttttcttccttttctccttgcacccccgcctctccctcctcttctccccgtgctctcctcccacccccttctcttctcctccccctcccctcctccagcggacctgttggagatttaaagggtacagtgcggtgtcgcggcctcggtcactaacagtggcgggtgattataagaaggctgggtgggcacagcggcaggcagaatgtcccggactgtgaggaccccacgctgacatgccagttacccctgcctgttatccacttaccccagcagtccatgcccctcccattctaaagccccttctcaggaggaaggaggcactcactgggcccagggccctccccgttgcctggacacctgggcatcgaattgctgccctcctgcagtgccacagaccctgcggcctctctttgccgagtctcaccactgctagtcatccaggctggggaccgacactctctggagaccagcgatgccacgcccagaagcttctctttatctctaactcctgcctcagtcaccccaatgggccgcctcttcctgcttaagaaaccggggccctaagtcctgtttgcagggcctgtggccctctcatggcagaggacagatgatttacatgctcagagacagatgagggccactccctttgtggctgcagccactgactcctccccccgccatggttgtccctccctttagttttagcatttctgttcgtctctgacagaggcacacaggagctccctagtcaccagaggcaggctcaggaggggccagaagacatgggggtgggacggcagagagggaccccatgtctcttctaatcacccgccgccccccgcgccctgtgtgtcgtgtgtggtcgcccatcttgcttttctcaccttgtgcagggggaggggtccggagaggggggcgtctaacttgcctgccagagagtgtggattaaccgcacctgcccactaccctgtgggaccccaggaggcccttggaccaacctgctccttctttagccttggaggggacccaccaggacgtgtttctggttccttctccaccccagtgatattaagggagtgggacccaagtcccatagaaatcatgcttttggtctccttcataactgggtgataactggggaccctgcccatgaggcagggtgaccccaggtccggaggtggaacctatcaaggctctaatcaccagcccactccacctcctgcgtcccacccacttcatttttgcccttttatccattattcatgtggtccctcttctctgttgtgtgctcgggggtggatgtagggcacccacctctctgtgcactgtgtggtctccatttctccagagcatctgtgatttgctgtgtttcactgtggtggtttccatggactgcacctgatatttggcattttctctccagtgcttcagagtaacagggacgggcggggaaggggagaggaaccaggctcaaagacaatgcccccttgcccttagccatcggtaaatgaggggccagtggctggcagcctgatgtcacttcctgcctctagaggaagtggcagttaacatcattttctcctccatccctctcccatagatggacatcagatgtccatcatactcctagggcctggggagatctcatgtttcagaattccctggtttctgaagcctttgaggagagggaattgtgtgcataagactcagctttcttttttcctgatgcaactttcatttttttttctgtctttcaccaacagattctaccacctgtagttcagccaagtccaaggtacgtatgaaggcaattctgaaggcttgatccctgtacaaggcagcccactttggtttttgttcaagggaattgagggaatggcagttggaccatggggaaagttgatggtccctgggagggaaggcaggaggtaccgagtgcccaaggtaagctgagaaattgcttaccttggcagtgtttggtgaggcatctgctgtagtagaaggacctggcctgggagttatgtggctaggaggcaatgtcactcagtagttagaagcacagactctgcagtcagacagtcctgggtttgagttctggctccaccatttagtagtttgggacattgggcaagttacttaaccactttctgatccttagcttcctcatctataaaatgggaatatcagtaaatctgtggggtgctataataaataaaacagatatcctttaaggtctttggagagcctaaagcaagcagaaggaaataaagagaggagcagaaatccatgaaatagaaaacagttgaaaaaaagcaatgaaaccaaaagctggttctttgaaaaaaaatcagtgaaattgataaacctctagccagactaacagaataaaaagaaagatggcacagattatcagtatcagggatgaaagagggacatcactacagacccctaagttattttttattttttatttatttattttttttgagacggagtcttgctctgtcacccaggctggagtgcagtggcaccatctcggctcactgcaagctccgcctcccaggttcacaccattctcctgcctcagcctcccgagtagctgggactacaggcgcccaccatcacgtccagctaattttttgtatttttagtggagacggggtttcaccaggttagccaggatggtcttgatctcctgaccgcgtgatccgtcccccttggcctccgaaagtgctgggattacaggcgtgagtcactgcgcctggctatagacccctaagtaattgaatttatgggcataaagttgcccataaattcaataacttaggtgaaatagaccaattctttgaaagattcagactgccaaaactcacttaagaaaaaatagataacctgaatagtcctatacctcctaaggaaattgaatatgtaatttaaaatcccccaacaatgaaaacttcaggaccagatggtttcactgttaaattctaccaaatatttaaggaattttttaaatttttaaacaatttactttaataattttaaaatattctaaatagaaaatagtataattttaaatattgatatatttaaatagttatttaaatatttgaattatttaaatgttatttaaatagttatttaagaaataataccaattctccactatctcttttggaagataaaagagggtggctgggcaccatggctcacgcctgtaatcctagcactttgggaggctgaggtcggatcttgagatcaagagttaaagaccagcctggccaacatggtgaaaccccatctctactaaaaatacaaaaaaattagctgggtgtggtggcatgcgcctgtaatcccagctactcaggaggctgaggcaggataattgcttgaacctgggaagaggaggttgcagtgagccgaggtcgtgccactgcactccagtctgggcgacagagcgagactccgtctcaaaaaaaagaaaggaaaatagaagaggaggaaacactttccaactcatttatgaggccagcattaccctgataccaaaacctaacaatgcttttgaaaaagatagggctaattcatttgataataccacaaatacttgttgaacgtctactttatatcagtactgtgctgggtactgaaaatataaataatgagccaaacagataggttcctgccctcacaaagcttatcttctaatgagagacagacactaagcttatgaagaaatagactatctgtctggcaggtttggaggcacagtggaggcagaaaccagatggaatgagctaataaagtgagggagggaaaagcgcatacgtagaccactcttgtgagaagtccgattgtgaagagatatttacagaacaaaaatggaaaaatatgtggcttgagggaaactttcattaaaagatgaaagcagccaggcatggtggctcacgcctataatcccaacacatttggaggccgaggcaggaggatcccttgagcccaggagtccgagaccagcctggacaacatagtgagacctcaactctacaaaaaatgcaaaaattaaccaggcatggtggggcatgcctgtagtcccagctacttgggaggctgaggcaggaagatcatttgagcttgggaggttgaggctgcagtgatgagccgtgatcatgccactgcactccagcctgggcaacagagcaagatcctatctcaaaaacaaacaaacaaacaaacaaaaaaagacgaaagcacatatttacttgccaatgggaatgatccaggtgagagacagagagagagaggaagagctgggcccagagcccgtgaagcagcagtagcctgtgctcctagcagatgcatccccaggtgtagtaggaagagagggaggtggcaggggcacactggcaggcagtgttggcagcaggtcattggggtcactcccagctgatggctctttcctcagcgaagtggaaggtgaggacctctgctgggcgtgaaggtggcagggaaagtctgagcagagtgaaggaagtctgaaatgggtcccatgaagcaaggcagatttcctgaaggggccgagaagcatcatgggcaggccgaggcctctgaaggctgcggccccttctcgagagccagcactttgcccagcagccgtgccccgcccctttgggcctggcttctccacactccccggagagccccttctgagtcccttctggccagaagatgtcctcatttgcttcctgtgaccccaccgtgtctccagtggactcaacactgacctccccagagctcacaggccactgcctcccggaagcctcctggcttgaaattccttcctcctgagacgctagcagttaccgcttcccagtctgggcctgcctgactcctgcattaacctgggaactcctgcaggaggccttctcaatcacagggccttgaacaatagaacgtgcttttcagagagtacgtctttactgtaaactgactcagagacttcactgtgacccagtgagttcatcacaatcactagcatgagatgaaagaggagggaatgcacatttactgagcacctactaggtgccagccagtatgcagataacttttcacgaacatcggtttcatttcatttttacggaagacccttgaattttgtaccatccccattttacagatgtggggaaccaaggctcagagaacttaagtaactagaagtttgggcatattcttgggcctcaggcaggggagctggttaggtggcctccttccttggttggtgctctggtatctgagttctgatcctctgttctcaggctctgagtgtttcttgattttctggcacagggactggctctgtcctgagcctgagctgaaaccaaccggccaagcctctaagaaacggaggcacagacgaggctgccggtctattaagtacagcgataggaataactgttgcagggacagggacgttgagttgtgtgtgccgcagtggtctcagtctcatctactggggagaccaggaatcggagtcagggaagcaggaggcaccaggcatctgagagcctgcggcctcctgtcccggctgtaaggaaggggctgcctcgggcaccagggcctggcctcccgccaggctgtgagctctgagggtgggcacaaatcctgcaagtgccggacattcacgactgccagcctctgtctctcttgcctgactctaaaacccaggtctgtgatggtcaaactgtgttccctggagccaccatggggttgtgaccaccaacaggtgtatgacaggaccaagcgtgcagggatccaagctcccacggcctccatctgagccactcttggttctgtctcacattgctgggtctctagggaggattcgatttggacagagtgctcccaagctcatcagaaaccattgttctagatgtgacagtcctgtctgtagacgttctccaggctgtgtccaggacacccaggcggcgtcggtgccccaagttacagccacattctgatcttgcctccctgtgtggatggtttaggctgtcccgggtaggagtgtggccaggcacacatggcagtctctcagctccgtggtgggtggagtggagctgttcattactcagaagcctcccttatcatctttttttttttttttttttttttttttttttttttttttttttttttttgagacaggtcttgctctgtcacccaggctggagtgcagtggcctgaacacagctcactgcagcctctaactgctgtgctcaagtgatcctcctgcttcaacctcctgagttagctggactacaggcacacaccaccactcctgcctaatgtttttgtattattttgtagaaatggggtcttgcttctttgcgtaggctgttcttgaattcctggcttcaatggatcctgctgcctcggcctcccaaagtgctgagattacaggcatgagccacggcaccccactctccttatcatcttaattccaagttcttgaggaaggggaccacttttgtcttctctggtggtccctcacctactgcttagctttctttacagcctgcaataatccccgagcacccccactggtacagggagaagtctagctcctgaccaggctctgatttccccggccctgccctattcaagttcctcaaattccttgaccccaacccttgccccataagaaacctccccatgaccctgaccctgacagagaactggctgtgaaaatttttgcattgacaacagatattggaatgcagggattccctatctacttcaggcaccttcaagaatcagaggaggccaagcatggtggctcatgcctgtaatcccagcactttgggaggccagggtggggagatcacttgaggccaggaatttgagaccagcctggccaatatggcaaaaccccgtctctactaaaaatacaaaattagctgggggtggtggtgcacgcctgtaatcccagctactcaggcggctgaggcaggagaatcgcttgaactggggaggtggaggttgcagtgagccaagattgcaccattgcattcccagccttggcaatagagtgagactccgtctccaaaaaaagaaaaaaggaaagttatgcactcttgctccagaacgacacctatctacacaaatcctgtggcaagttcaaggagtttatggacccccaaagccaacccagggactccagttaacagcaccttctccagagtattccggctggtaattagcttgtttggcagaaggtgtcagtccagctgtcaataatgcctttggtcatcgctgattcctaagtttaaagtattcaacaatatgaatagttacaatttattgagcatttgctgtgttactgtgcttagaattactaatcctcacaaatgccctgtgagttagagataaaattgtccttattttgcagttgaagaaacagaggccagaagagcttctgtaacttgccccaggtctcacaaccagcaagtcgcctgctccagagcctcccctgtgagacagaacccgttaggagatgaggcctgccctgggtgaccctgcccggctgtgagattagagcttgagggcagggtgtgtataaagtcatctcaggctgctgtaataaaatgccatagctaggtgcctcagacaacagaaattgattttctcacagttctacaggttagaagtccaagatcaaggtgccagtgtggctcatttctggtgagggttccctgcctgtcttgtagatggtagatggccaccttctcacactgtgtccttacaaggcaaggcagaaagaaaagagagcgcaagagagcccaagccctctggtgtcccttctaataaccgcactaatcccatcaaaaggtcccaccttcacctaaacctaattatctctcaaaggctccacctccaaactgggggttagggcttccacatgtgagtttgggaggtacacgatttagtccatagcagtgagtgaaaccagctgatgactggctggtggaactgggctcatttctgtctgggtctctgagcactgcactggccaggtttgtaagcccactccacagccatgtgcttgacacctggcaggtgctccgtgtgtgtcggatgaatacactggacaaaagaaaaaaaggctgtgggcgcagtggctgatgcctgtaataatcccagcactttggaaggccaaggtgggaggatcacttgaggccaggagttcaagaccagcctagccaacatggtgaaaccccgtctctactaaaaatacaaaaattagccaggtgtggtggtgtatgcctgtaatcccagctactcgggaggctgagtcatgagaattgcttgaacccgggaagcagaggttacagtgaaccgagattgcgccacctacactccagcctgggtgacagagggagactccgtctcaaaataataataataataataataataataatgctctagcctggtgcaagggtcccctgtaagctctgcatggagcccctgcctgcacctggacacctctggtgacagagacctccatcataagattgctgtgacagggagaaagttcattatagtgacctacatccaggtccttgtcacttccgtccattgctcctgctggccccctgctttcctgcagtatatcctggattaactccctgatctctctgtgaatctgctgacctctgcattccttggaagagaaatcagtctgacctcgttgcttctggaaccagctgggatgagagggtagtttgatcaggtgatcctagcggcctcttaagtctctcagagagcactggccaggaaagaaagcagtactggccaccatatgctccaggctgatcctagcagtgcaaccacattgcacaactccagggggtgccttctggtgttgtgcattgtgggcaaccatggcccaggagccacatgcctgtgactcctgagtccctgacatgctctggttttctcagaactaattaatgtgagagcaaggacagtggctgcagtggccacaagaggcatctgggtctccattcattattacaccatggctgaaacaagaggtggtctgtgaggaggggttgaaagggcagcgtgaccttgtcaggtcattccagcccaagacaggaaccagtcccagcgtctgcttctacaaggcttcctgtgttaaggggacttcattcaccaattgtttgttcatttcatgtttattgagcacctgttatgtgccatgcagaaacaaccaagtcacagcctttgctcttaaggagctcagagtttgatgaggctgatgtgagaagagctaggagcatagtgagatgacaggaacatagagaagtgatctcccatctcaggcaaagggagggctgggaagtggctgtacagaggaagccatgttcgagctgggccttgtagggtgagtaggagctcatccagcaaatagggcagggggacattaagggctggcagcaatgtaacagtgtaggtcacatcaaaggaagggttggtagggctgtatttccacagtgagggctgtgttggggttggggtcagggcagagcagggcagtaggctgggaaagttggggctgggttatgaagagccccatgtgctgaactggggaacttgtgctttatcctggtgggtgctggggcatgcaagcttctgagcaaagctgggtgaggatcagattcctgcttcagaatggtggctctggaggagagacccgggctggggcaagggtggaggcaggaaaccctattaggaggggcaggagggcccagagagggcagaatgagggcctgccggaggaggaggaggagttggctttgggagccatttcaaaagaatccaggacttggctgtgggtggaggagagagggaggagtcacaagaccgccctaaggtgagcagtgtgaatggaggcagtttggggcaggggtaggtaggatgctgtggttccggataggtgagttttaagagcctacagacacccaggtagaaatggattctcaatgggaagaagagtcccggagctcaagtgagtgtggtgttggacagggaggcctggatagcagcgctgcttgggaatggtattttctagggaacacgaacagagaaggcaaaggggccaaaaacagtcctgggaacactgagtctcagtggggaaggcaggggcggggcggggggcgggcaagaagaacctcccaagaggcagaggagaggccagaagggcggatgaaaaccagcttccagaaggccatgggcggcagcatgggccctcctgggaaagtgtgaaaggccaaggccccaaaacaccacagggtgtagcagtgagggctggttcaggtgagaacagcggcatgaagttgcccaacttggggttggaaatcacagtttgggagcggctccaatccaaaccatgacaccatacgggatctttcagccacttgcaggggcggagctggcggcgggattgacctgggattggggattggcggggtggggagctggtggggtccggcggaaaggggaggacgtgaacttgggcgggttgccctggagaggcctgtagatgctgggcaggtgggaaggcaggtttccaggtggcagcgggtggagaggaggtgggggacttgtggtcagagagcgcccctggcggggatttggggatcagcatgcaggaagctctggtgatgacaccccaggggcgtgtgtgaaacggattcaggctgccaagcgttattcactgtggagagattgtcatcaccagagccgtgtctaaaggatttagccagggctggatacggaaaacagaatggaagggggctttgggagaccagcccacctcacaagaaagagctgagagcctagatttgggccagcgggggtagtctctggacggagggcggcacggggctggaggaggagcgttttatgatgcggccgtgggtgctggccttggctggggcttgtggcgactgggtgccgtgacgtgggggtggaccgggtagagcggggtcggcagggggccgagtccgggcgccccccgcatcctgacctgtctcccacacagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggctactccaccctgtccaccatggaccgcagcgtgtgctcgggcgctagcggtcggcgggcaggggcgggggatgaggcggacgacgagcgtagcgagctgagccacgtggagacggacactgagggcgcggcgggcgcggggcctggggggcgcctgacacgccggccgtccttcagctcgcaccacctcatgccctgcgacactctggcgcgccgccgcctggcccggggccgcccagacggcgagggcgcgggccggggcggtccccgcgccccggagccgcccggctcggcgtcgtccagcagccaggagtcgctgcggcccccggcggcggcgctggcctcccggccctcgcgcatggaggcgctgcgtctaaggctccgcggcacggcggacgacatgctcgccgtgcgcctgcggcggccgctgtcgcccgagacccggcggcgccggagcagctggcgccgccacaccgtggtggtgcagagcccgctgactgacctcaacttcaacgagtggaaggagctgggcggagggggccccccggagcctgcgggcgcgcgggcgcacagtgacaacaaggactccggactcagcagcctggagtccaccaaggcgcgggccccgtcgtccgctgcctcgcagccgcccgcgcccggggacacggggtccctgcagagccagcccccgcgccgctcggccgcctcccgcctgcatcagtgtctgtgatccccacctcccgcgccgctcgggcgccacccctccctagagcccctttggaaccaggaggcttcaccagcctgcacctcctcttctgtggcccctgggtgcatggtgtgggtggagggcgcagcaggcagtgtctctagttggtgtgctggaactggcagggcagaggagaaggctggggccggactaattgaatggaagggggttccagaggtgatgagcagaagaggagggggcgtgggctgctggggtctgtgtccctgcacacatgcgcccgataggtccttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatga

SEQ ID NO: 802 - DNA, 17540 bp, Homo sapiens
ggcacttgcaactttattgcgccagcaagaacatgcatacagcccagtctaacgtacaggatcaaaaaggtaatgacagtgtgactttgagtcagtttgagtcagccccagtttattcatctataaaacaagattaaaactaatgcttggccaggtgcagtggctcacacctacaatcccagcactttgggaggctgaggtgggaggatggcttgagctcaggagtttgagaccaccctgggcatcacagggaaccccgtctctacaaaaaataaaaaaactagccaggcatggtagtacaagcctgtagtcatcacagctactcaggaggctgaggcaggaggatctcttgagcaggaggttcttcaaaaggtgactgtgagggcagggtacagtggctcatacctgtaatcccagcactttgggaggccaaggcgggtggattgcttgagctgcagagtttgagaccagcctgggcaacatggcgaaaccccatctctaccaaaaatacaaaaattggctgggcatggtggcacgcatctgtggtcccagctacttgggaggctaaggaaggaggatcactcgagcccaggaagtggaggagccaagatcgctccactgcactccagcctgggtgaaagagtgagactctgtctcagaaaaaaggtgaccgtgaggatccaatgagatttctgtaaagatgctttgcaaactgtgtttattcaaatataagatattgactttaaaggaaataaaggcagccatttcaaagtacaaatcaccaaccttatggtgttgcacatctctcatggaatctctctcttaggacctggagggaggtctctatattctaaactaaaatgggctcagagcagacagagtccatatcctatgtaggtaggacagtaactgttttgtccttgcacataaatagaggaagaaaaacttgggggctgggtttggaaaataaaatttcaacaaactacagaagacccacttctccttctagaacccaccctggaaatcccacactcaacccagtctgatctccgtaaatttcaactgttctttagaacttctggaaatgatgtgggggggtggggaggggaagggcaggggttcttctggccttgcagttagtacagggctgttcattcaaggctagggtcagcactactcacaggtttgaggacttcacagataaaccaaaaaaaccaaaatacagtaaaatgtcatgacttcattaatttagaatttgttttgatctaaatgaggatacatttatcttgacaatttctatgaaaagggcttcattaaataaatgtataaaataaacaagaatgagggaatgcttcaccagttaatttacaatcacatattgagtacctttaataagcccagtgttaactgctatagagcacatgggtaaaacataagatgggcaaaacattcttagtgaaaaagggagttctgaggtcaaacgtgtttgggaaatgcaaggtggacaaggctaaaataggtttcttcgcaggaagaattctcagagcctttaataggtcaatatgcattgcaaatctctgagggggaagagattaggcagcgcttctcaaatttacttgaccggaaaactcttgttttacaaagttccccttattgcctacagaaacacttggacaagagaatacatatcaaatatatgatgtacttcaatcaaagagcttataatcttgttggggaagcaaagcttataaatacgcataaaacaaagattacgtggtggctcatggccataatcccagtgctttgggaggccaaggcaggaagatcacttgaagccaggagttcaagaccgccctgggaaatacagcaaaagaccctgtctctataaaaaacaaagttagccagacatgatagcatgtgcctgtagtcccagccactcaggaggctgaagtgggaggattgcttcagcccagaagtttgagaccagcctgggcaacatagtgagaccctgtctctacagaatattttaaaaattagatggatgtggtggcgcctgtgtgtagttccagctacttgggagggtgaggtgagaggattgcttgagcccgggaggtgaaggctgcagtgagccatgattgtacccctgtgctccattctgggtgatagagcaagaccctgtctcaaaaaagaaaaggaaagtacagaaaaatgttcaagcttttcagaaagagcaggatagaaaaaaaaaatacttcctcttggccaggtgcgatggctcatccccgtgatcccagcactttgggaggccgaggcgggcggatcacctgaggtcaggagttcaagactagcctggccaacatggtgaaaccccatctctacaaaaatacaaaaattagccgggcatgatggcgggtgcctgtaatcccagctactcaggaggctgaggcggagaatcgcttgaacccgggagacagaggttgcagtgagccaagataacgccattgcactccagtagcctgggtgacagagcgagactctgtctcaaaaaaaaaaaaaacttcctcttaaaatctgcaaacatcgtcttttatttttattcaagggccttaaaaacaaccagagctttaggccaagccgtaaagcccatctgtcagagatgtgagacgcttgcttctatattcctaacaagataaaagtccagtgcttaaagatgacccaccagggcctagcacaggtccagctttgctgtcactgacacagatgacacaacaccaaagacttatttttcaattctaccaaactgagataattagttcccaaatccctgagcatttacttctgcctcaagaagaggttactgaactccataagaattcttctcaagaaagaactaccaaagaataaccttatttcatgcacaacacagctctgagatcagactccacctcattgccttaatatttgcttcacacagggccaagcatggtgctttgcacatagtaggccctcaacgaacatttactggacaaacaaagaaataaagctttaaatacttgggggacttgcatgctttttggataaaagtctggttttttgaggagagaagggaagataggtagaagagagtctgctaaactctaaagataaaaaggaatggcttttagaaacacactgacactgggagagcttattccttcattcattcacccaacaattatttattgaacacctacatagcaggtattcttccaggtactggagacccatagtaggagatagataaactccctcaccttcatggaaattatattgaggcaaagtagttaaaagcataggttttggagtccagcttttgaatcccagctcaatcagtactagagaaggtaggagtgtagttcactgctcagcttcctcaccttgaaaatggagagaataagccaggcatgatggctgacgcctgtaatcgtagcactttgggaggctgaggtgggcagatcacaaggtcaggagatcgagaccagcctggccgacatggtgaaaccttgtctctactaaaaatacaaaattagctgggcatggtggcacatgcctgtaatcccagttactcaggaggctgaggcaggagaatcgcttgaacctgggaggtggagattgcggtgagctgagattgcgccattgcactccaacctgggcaacaaaagggaaactccgtcttaaaaataaattaaaaatataaaaagaaaaaagaaaaattagctgggcgtggtggcgcatgcctgtaatcccagctactcaggaggctgaggcagaagaatcgcttgaacttgggagggagaggttgcagtgagccaagattgcaccactgcactccagcctggcgacagagcaagactctgtcaaaaaaaaaaaaaaaaaaaaaagaaagaaaagaaaatagaatattcctagcaaattagttctaagtagaacaaaaaaaatttaatggagagaatagtacctatattatggtattattcatgaggattaagcaagaatccgtgtaaagcaattagcaaagtacctggcacgtagtagatttttaataaattatatactctgagcacagctatgcctaggttagtcctatcatgttcttgtttctttctttcagagaccttatttcggctggcaattaccttacccgcttgttcattatctgactcctgcactcctcccaagtgttcaatgttaaccagatggcaaagttaaccagacagaggaaatccacataattactctagatgaagccccctaactgcggattagaaggaaaagagatgaagggtgctgcactaataataacaaccattttcaaccaaggcaggattctgggcctagaatcttcagtgacaaattaccaggagaggaggagggaaatgaagagctggaggcctagggagatggtgtgaggagaggagactgtgcctttccacttcttaataattaatgttctcctgctgctctgagtctgcatgtaagtggatttgtgacctctcagctgatgaaaaccatagcacaagaagagtaaaagtgtgctgccttgtttcttacttgctaattagccacctgagcccaggggggtttataagtggcctcaagcccaattactgattttgttcccagaggcagagaaggcttgagtcaaatcaccctgattctcaggggaaaggcagcaccgagcatccagggtaccctctaatggcccaggcctactcttgtccagcaatgtaccaccaagatgttgaactttaaaggactatgtctgaccaggaaggacctgctgtctagagctgccattctgattcttggagctcgtatacagatacatccgcaaccatggggcaggaaacagatgtaccagtgcagtcaagaccaatacctgctcatacctgtggccaaaagcatgatgccccaggctctgcctccaattctaccatcttcttccatctttctcttttatcaggtctctgccctcctgtactttgtacttagattctcctctgccaagcccattcagactgtgactggtaggagtgctgtgctcagctttccacttgagtgtttatccaagaagttggataaccctctcaagttatggcctccattccagtgcgcctcagtctatggggatgcattccactcacccttgggcctagggcaggcctcagtgccctggtctctcacttgtctgagatcagactctatgtaccaagtgcaaagccatggtgagctcttgcttaggtggtttatggctagaattgaacaagcaaatgaggaaataatgctagttggcatctagtacatgctcacactgtgccaggcattattctaagccctttccaagtatgaactctcattctgcccaacctccctatgaggtaggtcctgttattaacccactttacagaagagaaactgggacttaagaaggccgagaactcagcactacaggaaaaataaaaataaaatttaaattaaaaaaaattagaagccgagcgtggtggctcatgcctgtaatcccagcactttgggaggccgaggtgggtggatcacttgaggtcagcaagttcgagaccagcctggccaacatggtgaaaccccgtctctactaaaaatacaaaaaattagccaggcatggtggcgggcgcctgtattcccggcagggatgtactcgggaggctgaggcaggagaattgcttgaacccaggaggaagaggttgcagtgagccaagatcgcaccatggccctccagcatgggcaacaagagtgagattctctctcaagaaagaaaaaaaaaaacattaaaaaaaataaagaggccagggacattgcccaaggtcacaagctagaacatggcatagccatgattcaaacccacactgtcatattccatttctcaactctgatcatgctcctataatgcagaaaaattcaaatatacattcagcccccgcccccaagaggcccataacccagcaacagaagcaagcacagacattgagttttagccaaaaaacttagtttttcaattcacagcaggtcatggcttttttttttttatgattctctcatacaacagatatacgtacaacatctactgatgaatgaaacaaaactgaccaaaaccagaagtacaggacaattacataatctcttaaaacaggaagtgactcattaagaaaatattttctcattcttatatgggtactaatggctgaaaagaagacacttatctttctcacatctaaccaaaaataggacacgaccaagcaggatcgtatctgaaatcctggaaaatttagtattatatttgctaatttgaccttctcttagcctttcttcccataaaactccccatggtaacattttaagtgagcctgaaagatagttctgactcattttaagagaatgttgagaagctctaaaactggaaatacaatgatcgatcctcttaaggaagagctaaataattaaacagaatgtcattccacttatctaggctcttctcattctcttttgatgcagcaccagtgattcagtttgagtcagacatccaacaacaactgagcaaaagaatcatctcagatccaagcaatggtgacgcgcagatagaagagactgaggccaacgaccaaagcaaaggacagcagaactgactgacacagctcagaaaatatccaaagctctgtaagtgaacacacatttattatgtctttaatgttcccaggaaagcttttgtcgtctatctaggtgaaatgatggggcatgtgataatatgtgaagccagaatgccttccattaatattaatgcccctctgggttccaggactcctccctgcttcagcatccaaaagaaaaggcaagactaaggctcaccaactaccgtaaatgatgtctttgtgccagagacactgttatgtgtcccccaaatccatttcatttcctcctgacacacagcgagactaatttctccatgtccactacagttagatggagccacatgactgagttctgaccaatctaatggggtggaaatgatgcacattatcacttttaggcctggtccctaaaatctcttgtgagatccttcacacattctctcttcccttatctgctagccagatgcaagggactctgtagaaaactccaagacctcagaagataatggagccactgaatagccacatgaacaaagctcccccagcccgatccacactagcctgtgacatgaatgagaaacaagtctctattgtgttgtaacacatattcattttttttttctttttttgagacagggtcttgctctgtcacccacactggagtgcaatgccaccatcttggctcactgcagccttgacctccttgggctcaagtgatcctcctgcttcagcctaccatgtagctgggactacaggtgtgcaccaccacaccagctaattttttttttttttgagacagaatcttgctctgtcacccaggctacagtgcggtggtgcgatctcggctcactgcaagctctgcctcccaggttcaagcaattcttctgcctcagcctcccaagtagctgggactacaggaacccaccaccatgcccagctaatttttgtatttttagtagagacggggtttcaccatattggccaggctggtcttgaactcctgacctcatgatccgcccgcctccgcctcccaaagtgctgggattacaggtgtaagccaccgtgcccgagcccacaccagctaatttttaactgggctcaagtgatcctcccatctcagcctcacaaagtgctggaattccaggcatgagccaccgcacccaggatgaagcacagattcttgaactggtttgtcacggcagttggtgctgatcactccaatgaatacagcttgcctgtgccatgatctcaatctgggggcaccagttaatctgcagcttccacacctacctgtctcattgccaatgcaatcgattatcaggcagattcctaggggcttgctcttcatcttgtatctctcttcaggtatgctctggaaaggaagacaagaaatgctaaagactctggatattgctctgtttctataaggtcccacccatataccatctcttcttttggatttcctttggcaggtgagtcactcaacagacacagcctgaagtttcccattacggcaaatgtttcccattaatatcaaatttttcctctattagggtaatgtgcttaagacaaattattttcatttttatttaattttaatgaaaatcccactctctttattggctttgtggaataaagataatttgaaaaagagagaaaacatgagtgatttgtctccacagtaacctgaagttatataagtggcatgttcccaagtacaaagggagcccttctattgcttctgcttacaaagaggtgtcaacctaagaaaaagccagaacaagccaaagttcagggaagtatcactgctgactaatatgttcagcagtcactgagttgagatgaggagtgctactttggaacttccctgcattccaaagttcactaatgcaatccactttaacatctttctctttgttattcagggttcccttgtatggaagttctcaggagaacaacactctcagagtcccactgtctcaaagaattcttaatggacaggtatttttaaagaagtcagggttatccacagctatgtacatataataccaaatcagatcatttattctgtacctgaggcaaaaaagcttctgattcctgaatggatttcttcactggttcttctgggggatgagagagagaaaccatttacaaagctgaaggagagctaagtccacccctacactggctgagtttctttgtataacaactgttctcccttcctattttcttcaattatctcttctttccccagctatacttggccccaaggtttcaacctcacactgaagaaagtgacataagaaaacacaagtcccagtgctatcaggggctatctggaaaagctgcttaaacagcaagtgaaagaaggctctcccctaccccgttctaggtgaggaacaggtggctggtgagtttttaacttgataggagaatctaataacctcaccacccaacaatactgatagctttcctatatgtgctgaaactgttgacaatacctaaagggaacagccttagagagtgcagagcagggaaagtttatatgtgtttgctagttataaaacagatggcactgttttcatagtccagtgatactgggagatcataaaataaaatgtcaatggcaagacagtgacaatgggggcagtgagcctggcaaatggagatgagcctaaagctaatttgctagaaaaaaatgacttgattaggtcagggaggtggaagaacaaccagttttgagcagagattgtgccactgcactccaaagtgggcaacagagcgagactctgtctccaaaaaaaaagaaaaaaattaaaaaaagatacacaggatatattaagtgaaaaatggattattaaaaatatgtataatattgattctgtgaacttaaaaatgtatatttgtgtacatatacttacacatgtattaatatatgcttaaatataaaagaatctggaggcataaaaatcaaacattaatagcagctatctctgatacttgaaagaggaaatttcattttatattttttgtattttagcaattatatattaacagaacaaacaaacaaacaaagaaaagccacaaaataatctatgtgatatatctatctcagtttaaggcatttagcaagaaattactaaattgaagttatcaccatcctcatcaaattcaatgatggctgaacagttcaaatctatttggaagtccaaattaatataaatatttggtttgattattattatttatttatttatttagatggagtctcgctctgtcacccaggctggagtgcaatggcacgatctcagctcactgcaacctccgcctcccaggttgaagcgattctcctgcctcagcctcctgagtagctgggattacaggtgtgtgccaccacacctggctaatttttatattttcagtagagacagggtttcaccgtgttggtcaggctggtctccaactcctgacctcgtgatccgcctgtctcggcctcccaaagtgctgggattacaggcgttagccaccatgcctggccgagtattttaaacttctattaaattaagcccaagttattagaaagcttttctggggtggggggcagggtcttgctctgttgcccaggctagaatgcagtggcaagatctcggctcactgcaacctccacctcccaggttcaagcaattctcctgcctcagcctcccgagtatctgggactacaggcatgcaccaccatgaccaggtaatttttgtatttttagtagagacggggtttcaccatgttgcccaggttggtcttgaactcctgacctcaggtgatgcacccacctcgacctcccaaagtgctgggactacaggcatgagctaccatgcccagcccagaaacctttttcttttattagcaaataaaccaagtccaagcaagagcaagtaagcagctctcctaacaggatcatagggatatttggattctcacttacctcatctgtacaattatgaccaaggataaaattgccatcagggagcaaatggaaagaacaccaattgtttttaattcctatgcaaatctactaggtctcctattttccctttaaacaggcttcggaatactaattctcatcacctcaccagtgttttaagaaacatgctatcatttcaggaattaattcgcttctcagtagtttttgctggagagcacaatattaggtagagaatgacagacatgagctacaccagctgactaatccgggcaaaataagtttccaggtgcagatagcacaaagactgagtcgtaagatatctgtaaggggactgccacacaaagagggcttctattaggccactgccctactcaaaacattcatgatgtcccaccacacacaggacagattccaagcctcttggataagactgaagccctccatcacagcccatcaatccgtttcctggagttcggaaccacagccatgtgcctcatcagtgtaagactgagtctcagctctcacttcaaggaggactcaagacaagcaaaagaagtaaacttttgctgggtgcagtggctcacgcctgtaatcccggcactttgggaggccaaggtggtggattacttgaggtcagcagtttgagaccagcctgaccaacatgatgaaacgttatctgtactaaaaatacaaaaattaggctgggcgccatggctcatccctgtaatcccagcactttgggagaccgaggtgggtggatcacctgaggtcagaagtttgagaccagcctgggcaacagaatgaaaccccatctctactaaaaatacaaaaataaactgggtgtggtggcacaagcctgtaatcccagctactcaggaggctgaggcataagaatcacctgaacccaggaggcggaggttgcagtgagccgagattgcaccactgcacgccagcctgggtgacagagcaagactctgtctcaaaaaaaagaaaagaaaagataagaaaaaaattagctgggtgtggtggtgcgtgcctttaatcccagctactcaggaggctgaggcatgagaattacttgaattcaggaggtggaggctgtagtgagccaaaagtgtaccactgcactccggcctgggtgacagagtgagaccccgtctccaaaaaaaaaaaagagtaatcttttaaaaaatgatctatgggatcaagtgctaatgttttaagagagaaaacagctcatgcgggttgaaatgacccatctttaaattgcacgttttctttcttaggaaaggggggatatcatctgtagagtatccagatttattaaataggctgtaagacaagaacttatttaccattcctcttcctgctgctagatatttggtttaacatggttcattatcatggttggatcaatgtttaacatggcctgattagagctccattccatttcagttataaacatcacatctcttaacatacggccaagatgatgaagctgatggagtacgatggtgttcaaacttagataagctaattcaatagacaactagaaatgccaatgagtctatcgtaagagtttaaccagtttttattttgagagcttacttagattatgtagataaaggaaatgaccaactctaaaaatgcaatatttgtactagaattatcaagcatttataaataatgaatattaaaaaaaggtggtcttacgttgagcgccaagctgttccttaagtctttgttctttacttctcccattatggagcttcaaatacaaagaataaggtcatacttcctgttagttatttcagaggtacactatacattacacctctttaaatgtctcaataggattcttaactcaggaaaaaaataaaaatatcgtcccaacagttaaattatctaaagaatagcaagagctgttaactccataaatcccgtatcatattaccaaagaacagggaaattctgcttttaaaagatgaaaataggccgggagcgatggctgacacctgtaatcccaacaccttgggatgccaaggtgggtggatcatctgaggccaggagttccagaccggcctggccaacatggtaaaaccccatctctactaaaaatacaaaaatttgctgggcatggtggcgtgcccctgtaatcccagcttctcaggaggctgaggcaggagaattgcttgaacctgagaggcagaggttgcagtgagctgagatggtgccattgcactccagcctgggcgacaagagtgaaaagtgaaactctgtcacaaaaattaaaaaaaaagaaaagaaaaatatgctaagctagcatattagaatgtttcaaaacagcccaataaaatctgatgttacagtatagtatagttgctagcatagctccaggttaggataagctgttggaacatgagattgacattccacctgttccttcaacacaggggcaaagtacagcatggttaagagtcggatttctaggccagacagacctggctaggaatcctaattctgccacttattagctatgtaacctcgagcaagttatttaacttctgtatgtgtgtttcttcatatgctaaatgaggataataatagataccttacagattttgtatgaagattaaatgcacacaaagcactcagcacagtgccaagcacatggaagtacataataaatgtccagttattgcttttctatcattgcctagctacacataagcaacatatggtcctgattcttgataatcaaatattcttgataaaccacttctgagggctagagtaagagtaatcagagaatgaaagattaaaccgaccctttctcttctcagatgacaggtcctatgtaagatacacataccacatgctgtcaacccatctgagacactcagctttcaaatgacagttcttctctgaagctaacctagccaaaagagtgaaatacactatctgttaagctgtgtcagtagctaagtctgtgtgtctaaattaaaaacatgtaagttgcctttttcactaataattagtaacttagccagaggctgatcatatcagatagaaattggccgcatgcatgtgtattcgcttttacatattattagagagaggtaacatatcaaatcaaagatggattttaaaagcattgtattgtagccaaataatttttaaattcttttttttttttgagacagagtctcactctgtcacccagggtggggtgcagtggcgcctgcaacctctgccgcctgggttcaagtgattctcctgcctcggcctccagagtagctgggattataggcgcctgccactgcgcctggttaatttttgtagttttagtagagacagggtttcaccatcttggccaggctggtcttgaactcctgacctcatgatccacctgcctcggcctcccaaagtgctgggattacaggtgtgagccaccatgcccagccataattttttaattctataatatcttgtggtatcctgtggcatttaatcatacagtaatttttgaagcacttctgcagcctcatatgaattaacttctaggtattcggctcctaaaccttttaagaaagtcactgcattcatatgccatagtgcctgcttactaaatgaatgaatgaataatcagggtcacttttttttttctttttttgagacggagttccactcttgttgcccaaactggagtgcaatggcacaatctcggctcacgacaacctccgcctctcaggttcaagtgattctcctgcctcagcctcgcaagtagctgggattacaggcatgcaccaccacacctggaaaattttgtatttttagtagagacagggtttctccatgttggtctcaaactctcgacctcaggtgatccacctgcctcggcctcccaacgtgctgagattacaggtgtgagccactgcacccggccttagggtcacatattaaatatagaaagtttaaggagaaactaatatgcaaagcatatgggctcacaacaggctacatagcaatgaatatgcttcatttacaaaatagaaacacaatagtaaaaatatggcaggttttttaactaagaatgacaatataatttatattagacagacaatagcagagaaagctcagaaaacctggatctgaatcctaaatctgctttttctcattatttggtattacagagactcagaaggacaaaacaaagcacatttcattcttttaaaaaatatatgctaggccaagtgcagtggctcatgtctgtaatctcagcactttgcgaggctgaggcgggcagatcacctgaggtcgggagttcaagaccagcctgaccaacatggagaaaccccatctctactaaaaatataaaattacccgggcgtggtggcacattcctgtaatcccagctacttgggaggctgaggtgggagaatcgcttgaacccgggaggcggaggttgcggtgagccaagatcgcgccattgcactccagcctgggcaacaagaacgaaactctgtctcaaaaaaacaaaaagtatgctctaagatatggtatgacaagtatatagtttattatatacatcacagtgcagtgaaaggagtatgggctgggcccagctctgctagtagttagaagtagacaatcagttaatgttctttagggctaagtttccttattttgttcattaagggagttggataatataatccgtaaatccattttagctctgaaattgcattgctcagtagtgtctcttacagacatattctccaagaaaccatttatattacaagagtgggttttcattacatattttaaggaaagcatttatatatatatatataatatttttttttcttttagagacaaggtctcactctgtcaccagggctggagtgcagtggcacactcacacctcactgcagcctcaacctcccaggctcaagcaatttctcccacctcagcctcccaagtagctgagactaaaggcacaccatcatgcccagctaatttttgtattttttgtagaaatggggttttgacatattgaccaggtttgtctcgaactcctgggctcaagcgatccgcttgcctcggcctcccaaagtgctgggattacaggcgtgagccaccacactcagccaaaagcatttttttccttctttttttttagggctttctggcaaaaactgaaaagcctgctagacaaattctaaaagagctgttaacactgccaaaagcatttctaatttaaccatgaaattgtacccggctctaagtcctcactacaaactccacatatctttatatgaacatgaggataagattacaccaagatttaacttctcaagataaaagattaactaaagaacaattccgataccttgtactaagtactaggaacacaacaaccataagtgactatatgatacacttatgctcatgaacaccctcaaaaatcttttgtttcatcactcaataacaaaataacttttgctgaaatcattaaaattagctcagtaaaaaaacaaatgcacaaagaagtacaaggatatttattttatagcattattagtagtaacaaaagattggaaagcatctaaacatacagcaacaagaaagggctaaacacattataacacatttagaaaatgaaacgatttaatcattcagaatgattaagtagaggcagttccatgttaatcacatggaacaatttccaagaattttcagatcaggacaatgggcatagggtgttatcatctgtagaagagaaaaaagcaaaaatgaaatatatgtgtagactatctctggatagttacagaatgaactagttcacaacagctgcctttaggaaaaataattggaggtcagtattataggggtaggaagaaaacattttttttgagacagagttttgctcttgtcacccaggctggagtacaatggcgcgatttggctactgcaacctccacttcctgggttcatatgattctcctgcctcagcctcccaagtagctgggattataggcacctgccaccatacctggctaatttttgtattttttagtagagatggagtttcaccatgttggccaggccagtctcgaactcctgacctcaggtgatccttccggctcggcctcccaaagtgctgggattacacgcatgagccaccgcacccgggcaaaaaaatacttttaaaacctcttgtagtacatttaaatttttttccataggcatggtgcatctatttttatttttaaagttacattttctttttttaagttacaatttcaagtgaataaatgaacagtgaaaaaaatgtccaattgtccaactgtatgtatgtatgtatgtatatatatatatatatacatacatacagatacagatgcaaacccacataaaaaagagtctagaaggaaatataccaaaatactaacagtggttgtctttggatagtggaatataggtgatttattttcttttatctttctctatagtctccaaatatctcaatgaacatgtattagctttgaaatataagaagttacacgtttttaaaacaaatacacatttctatcacaattttttcagatattaaataaagtacatgctgtgagaatatgcatatttttattagaactctgaaacggtttcatgctgggattccatatgttttctccagactcaccctgaagttatttgaaggatccttgagactcttttggattgctgcttggagaacattcctgtaacttgtccctgctccttgaactataaaagcagaagggaggtactgagttaaaacttacaaattattatcaaataaatcttcaatagtggttca

SEQ ID NO: 803 - DNA, 2422 bp, Homo sapiens
tgtaatgatgggagggaggatgcaaggcaggacttacgggtcctagccagctgtgctgcacctggtccgtgaggcagtgtggagtccaccgaaacgaccctcaagcctgatgccagttccagaagcccagtcggcaactctgccaccttacactcctctccccgtggaactgcctgggggtgctggcatggggacatgagggatgtctgacaggagaaacaagcatttcaagagtgtgtggttggcttcgctgtcctttggggggaggaactggaatcagtcaacaggcaagtaagttgttattgcacaccttttatgtattctgctgggccgtgggctgcggagggcactaaaggggtagaacatcctgctcctcttgaagacgcccagcctttggtcccatgacctcaggcacatgcgtaatctaagcggcagcccagaactcatgacgggtgcccagttccttgatgcctcctgaaggaaatgctgcaagctgttcagaggatggagactgcatgggggtgttcgtaggcaaggaaggcttcaagaaagaggcagctctgagctgcttttcaaagaagagaggatttagacaggcagagagaagtggggatcactcaatagaagtaaattccacaagctctgatctctatccctaatagggaacggggctcctaacaatagcttttttttgtggtctgaattcaggcccgactcccagttccagcctgaacactggtcagctgaagacaacgctgccaccttcatctcttccctgcctgtcctgcttacaacagttgcaagaagtttatacccacattaagcccccagaggcaggctggcagccagccttcgccactggtgcagagaactgagtcaaccacccggtgttcctggctgctccccctgagaagctttcccaccctgttccctgagtcgagagtcttggctgggcacctgctgcactgtggacgtgcggacgcggcctccagaagggggaagggagccctggctggcttctctgagacgtgttgagtggcttgccattgaagactgtttcctcactcaggcagctgcatgccccaagtgagtgacttcctctctctggactcagtttctgaatctgtagacaaagagggtggaccagatggtcttggaggtgccttccaggtcacatctctcctgtttctaacagcaggtggaagcaggtgaggagggcagtcgggcagagaggaatggagaggaattcccccacagaggctcttgggaaccacacaattccccattctggtgccacctgcttcaaggatgtgagtgagagcagtgctggccttgaagcctacatcggtgggtagtctagcctccctagatgtgtccttaggtgtcatgggatccatatctggatcatcaaggagacctcacttaggcttctcttgacttaccaggaaaggctaagtcttgcttcgggcaggcagctgcctctggggcccgggcctgtggccccaggggaaagaattgttgccccaagatgctcatgcaatgttgtgtgactgtggcaaggctgtgccattttagctgggatcaacacgctaatgggcacaggtccagggggagtgcaggtgccttcctgggtgcaaagtggccctcatccccatagcacacaatgtctgcacagctgaggctggaagggactggctgagggccgtgctggtgtgggcagatccctggaagatcacctgggccatctcctcattctaaagatgagaagaacgaggcttggagaggatgagtgtcttgttgagggttgcacagcaagttggggacacagctgcaggaaatccaagtctcctgattcctagcccatgatattttctctcccaccaagttgaaaggctgaggtgatgggaggcctggcataccacagatggaaacttgcatcgttgcccccggggctcagatgattctctaaaaatgtgtctgaggaagtgagagtgcagggcctctcctcacacgttggagctgtaagtagggcacgtgctttcagctccaggcaggactggagaaggttatggaagggcagccaaccaagaagcacttatttaagcatttttatgtgcctagccctgagctaggcatagtagggcataaaggagctttgaaggaccctcccaacacagcaatttcactgcagctggtgagcaaatttaactcacaaatcaattacaaaaacaacctcatgcaagctactgtttgtgtaataaaatgtaagaacatatatttgtatttgcgtaaaggaaatctggaaggatataaaaagataataaaagtgttaactaaacagttacgtgatggggtgggggtgagatttttgtcctttgtaccttttaattacaaaattattttgaactatgtgaatgcattt

SEQ ID NO: 804 - DNA, 28756 bp, Homo sapiens
agtcccagacagaacctactatgtgcggcggcagctggggcgggaaggcgggagctgggggcgctgggggcgctgcggccgctgcggccgctgcagccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcctggcgaggagcgcgagcccgcggccgcagttcccaggcgtctgcgggcgcgagcacgccgcgaccctgcgtgcgccggggcgggggggcggggcctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggtatctgccgggccggggcgatgggacccaaacgggcgcaggctgcccacggtcggggtggccgactcccggcgagaggatggggccagacttgcggtctgcgctggcaggaagggtgggcccgactggattccccttttctgctgcgcgggaggcccagttgctgatttctgcccggattctgctgcccggtgaggtctttgccctgcggcgccctcgcccagggcaaagtcccagccctggagaaaacacctcacccctacccacagcgctccgtttgtcaggtgccttagagctcgagcccaagggataatgtttcgagtaacgctgtttctctaacttgtaggaatgaattcagatatttccagagaatgaccacaacctcttcagtagaaggtaatgtgggattaagtagggtcttgcttgatgaagtttaccagtgcaaatgttagttaaatggaaagttttccgtgttaatctgggaccttttctcttattatggatctgtatgatctgtatgcagttcccaaggttcatttaccattattaaaaaatttttgtcttagaaattttatgtatgtcaacgcacgagcaaattatcaggcatggggcagaattggcagctgggtggaggcttcggtggaggtgagcactccgaaaggaaaacagagtaggcctttggaacagctgctggaagagataaggcctgaacaagggcagtggagaagagagggtaaaaattttttaaggttacatgaccctggattttggagatctcgaatttaaaggtgatgcaccagggatgaacgctcagattttcagtttgaaagctggcgtgacatgtaaaggagtggagaataatgtaccattgtaatgatgaggcgcctctaggacatctaggataatttcaggcgtggggatctaggtgaattgaactgttggagggaagggaataaccaaggaaaagaatgtgggggttgagagatgccccgtttaaaacctaagagacctggatatttatggttgtaagaggaggcatggcagaggaaatggaaacagtaagaaaggagcagatgctgcatctctttaatgggacagatacaaggcatttgggtttgacacttaggtcactggtagagatgatgacaagagcccgtagctaaagaattgataaaagccagtctcaaaaatcccaatatagtctggtaatgttaatgtttctttggttcagatagctgactctcaaagttattttcctaagaaactgaaccaaaagtggacgctatatgtaaaaagtttttatagaagtgttataagagtaggatagagacataattaaacatgttttaaggtaattgagtggaacattaagcacctatttttaaaagtatgatttaatatcaatctacaaagtacacaaatataatacaattgtatcagacagttgtgacagcactgattagaggctgaacattattctaagtctttaattcccacaacaaccctagaagcaggaactattgttatctctattttatagataaagtaaaccacaaggggttaacacgttttgtcttgtgggtgacaaaatgcattcaacttgagcactttgactcagaatcttttttttttttttttttaagagggagtcttgctctgtcgcccaggctggagtgcagtggcgcgatctccgctcactgcaagctccgcctcccgggttcacaccattcttctgcctcagcctcctgagtagctgggactacagacgcctgccaccacacctggctaattttttgtatttttagtagagacggggtttcaccgtgttagccaggatggtctcgatctcctgacctcgtgatctgcccatcttggcctccccagaatctttactatgtcatacacaattgcaaatgattaaaactaaatattggatataaattggataatgccaaagggaaaaatagttagatttaggtaatgagtgataagtatgaattttggtaagacttttaagttcagttttttaaaggagatctctgccaaaccccaaaaacaaagagccctaacatcagcctaaccagatttcaaatttcatcttttggcggtatgcatttttaacagtcacccctcaactaacacatcatcctccctcaactcacattctactaaccccatcaatgcaactccctgcccaccttactcaacatatacaccgctgctagccccataccccgaaccaaccaaaccccaaagacaccccatacggtttatgtagcttacttcctcaaagcaatacactgaaaatgtttcgacaggctcataccaccccataaacaaataggtttggtcgtagcctattagctcttagtaagattacacatgcaagcatccctgccccggtgagtcaccctctaaatcaccacgatcaaaaggaacaagtatcaagcacgcagcaacgcagctcaaaacgcttagcctagccacacccccacgggagacagcagtgataaacctttagcaataaacgaaagtttaactaagctatactaaccctagggttcgtcaagttcgtgccagccaccgcggtcacacgattaacccaagtcaatagaaaccggcgtaaagagtgttttagatcaattcccctcaataaagctaaaattcacctgagttgtaaaaaactccagttgatacaaaataaactacgaaagtggctttaacgcatctgaacacacaatagctaagacccaaactgggattagataccccactatgcttagccctaaacttcaacagttaaattaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgacgaaggctgcaaagtaagcgcaagtacccacgtaaagatgttaggtcaaggtgtagcccatgagctggcaagaaatgggctacattttctacttcagaaaactacgataacccttatgaaatttaagggtcgaaggtggatttagcagtaaactaagagtagagtgcgtagttgaacagggccctgaagcgcgtacacaccgcccgtcaccctcctcaagtatacttcaaaggacatttaactaaaacccctgcgcatttatatagaggagataagtcgtaacatggtaagtgtactggaaagtgcacttggacgaaccagagtgtagcttaacataaagcacccaacttacacttaggagatttcaactcaacttgaccactctgagctaaacctagccccaaacccattccaccttactaccaaacaaccttaaccaaaccatttactcaaataaagtataggcgatagaaattgtaaaccggcgcaatagatatagtaccgcaagggaaagatgaaaaattataaccaagcataatatagcaaggactaacccctgtaccttctgcataatgaattaactagaaataactttgcaaagagaaccaaagctaagacccccgaaaccagacgagctacctaagaacagctaaaagagcatacccgtctatgtagcaaaatagtgggaagattcataggtagaggcgacaaacctaccgagtctggtgatagctggttgtccaagatagaatcttagttcaactttaaatttacccacagaaccctccaaatccccctgtaaatttaactgttagtccaaagaggaacagctctttggacactaggaaaaaaccttgtaaagagagtaaaaaatttaatacccatagtaggcctaaaagcagccaccaattaagaaagcgttcaagctcaacacctatcatccgaaaaatcccaaacatatgactgaactccttgcacccaattggaccaatctattaccttatagaagaactaacgttggtataagtaacatgaaagcattctcctccacataagcctacatcagaccaaaatattaaactgacaattaacagcctaatatctacaaccaaccaacaagccattattacccccactgttaacccaacacaggcatgcccacaaggaaaggttaaaaaaagtaaaaggaactcggcaaaccttaccccacctgtttaccaaaaacatcacctctagcattatcagtattagaggcacccctgcccggtgacatatgtttaacggccgcggtaccctaaccgtgcaaaggtagcataatcacttgttccttaaatagggacttgtatgaatggctccacgagggttcagctgtctcttactttcaaccagtgaaattgacctgcccgtgaagagacttttaagttcagttttttaaaggagatccactaaatgtcaggatgtccatcatatctatgcacatagataagtcctcaatgtcatctgtgagttcttggaaactgtgactttaagtgaaacaatgtagagcaaaaccaattttaccataggctactggatgtacacaagagttaagttcctagggcatattgctggtcacaaaaacatcaccaaacttctaaatgaaggccaaaaacacttctaatagaaaacactgaagtaaatatgagctatacatacatttaagaagaataatgtgcatgtctttgggatgtggaaggaaactggaatacctggagaaaccccatgcagacatgggaaaagcatgcagactccacacagacggtggccctggccaggaattgattatttttctcatcaacgttagaagaaaacgatgttattcaaggacatgttgtatataaatacatgaaaatatatgtatattcccaaaatatacttaggctttctttgtgattttataggtaaacagaatctggtgattatgggtaagaagacctggttctccattcctgagaagaatcgacctttaaagggtagaattaatttagttctcagcagagaactcaagtaagtaccttaacataaattcaccacaagaaaatcatgtctcatagtggagatcagtatatgataaaatgaaattgtataaaaggagctattgatgaagctgcttaatatcacaaaggtgattatagaaaattaataagcagttatttatactacatgacaataacttattctactacctgagtaattgatttcatcaccttgaaaagttacattaaacattaaatagctcactgtggtatcagatttgcaagttatcttgaaccatcattcagtaggcccaaatataaattatacagtgtaatcaataacctgtagtttcacataaagtcaaaacaactattttttgggacttgctaaaattaagtgatgatcccctttctggacccaaccctaaatgcaataaaatgtgaattttaggatgggctgaaatgggtcataatcttctactctgttattcctagttaaccacaatacccaataatattttgtacttaacattcattacccagtgtctgaaggtaaaacatttcaaagtattgaaatggttctagagatcctggagagaagcgggtatctccagttagcctctgctaagaattttcctgtcctccaacccagggttggagtcagtagttcatgaagcctggatatgccctggtgactggagagtgggaggggtaatcatattaagactgcccaggaagtcaactccaatggcttgggaggttgaggggtggccagaattggacctgtgttaatccattctcatgttcttataaagaactgcccaagactgggcaatttgtacaggaaagaggtttaattgactcacagttcctcatggctggggaggccacaggaaatttaaaatcatggtggaaggggaagcaaacgcatccttcttcacatggtggcaggaaggagaagtgccgagcaaagggggaaaggccccttataaaaccatcagatctcatgagaacttaactatcacgagaacatcatggggggtaccaccccccataattcatttatctccacctggtatcacccttgacatgtggggattattacaattcaaggtgagattttggcggagacacagccaaaccatatcaggatctaaggggaaggtctgggatctggcatgttaatcattcttagtctaataatataatcaccaaaaagaatgcagtatcctagggcactactttcttgggaacagtagtcatagtattcttttcccatgtgtattggtgaagattcaaccaaagaagcagaaccagtagtagatagatacaggtatattaaagagttttattgcgaggaattggcttacacaattatgggggctgggtacgtgagtccaaaaatctgtaaaacgggccatcagaaaggacaagctggaattctccagcaggggctgaagtggtacaggtgaaatttcttcaggaaagcctcaactctactcttaaagcctttaaactgattgattcagcccactcagattaaagtctgaccgggcacagtggctaacccctgcaatcccagcactttggaaggccaaggcaggtggatcacttgagctcaggagtttgagaccaaccgtgcaacataatgaaaccccgtctctacaaacaaattagccaggcgtggtggcatgtacctgtagtttccaggaggcagaggttgcagtgagccaagatagtaccactgcgctccagcctaggcaacagagtgagatcctgtctcaaaaaaatttaaaaaaaaaactgaattgtaatcacatctacaaaatgccttcaaagcaacacctagatacagtatctgaataaccaaggactatatcctagtcaagtttaacactatgggaaggaaagaactacacagctatataggctaaggggattcaggcttacatagattttctcccaagttcttcctagaatggcataggtaaaaaccgagaagaaagtgtatagaatatttgcattgattgcctctgggcgacggggcagatttgttgatgtgcatcttgctgcctgcttccatcttcatgctgttctttcttctggttgctaggatgctctgattatctctttccttggtagatttcaaattcacagactatatcgccattccaagaaactctttaatgatatttttgaatactactcaagtttgtttatggctagcttaagctcaaacagaaagaaatctcagtgggggagatgttcacttgagccagcatttctcctcgaatatgatgagtgtaatttttttttacgaccttcctgtgatgcatgtaattgggtttggttgcttcttctgtatttatatataacatatgttggtgtcttgtgcttttttttttaaggctgagaaaatttaaagtctttgttatcaagcatgccagggaaatagtgataccagttagtaaaaaatgttagagctcttttttgttgttgttcttccttccacttccttacttgttggtcagtcccacacatatagtgaacagctgctgagtgccaggcactgcagggtcctgaataagagggcagagatttatacatggaaatcacttgcttatgccaactctaaagatacttcatttttcacccctctcccccaatgtaagaagaaactgaatcctcaaagtgatcacaaaattttctaccaaacactatagtaatttagggtaaatatttcttaagtaaggtattgagggaaaatgcttttccaaagttgtctagacagtcaagttgtggctttaaaagaacttgaggtgagaagggtgggaatggccactgatgagtacagaatgttttcttttttggtgtgatggaactgttctaaaagtagataggagtgatgcttgctcgactctgaatctactaaacgtcactgaactatacactttaaaagggtaaatgttatggtgtgtgatttatatcaataaagtggcttttaaaagtctttggaaccagccgggcacagtggctcacatctgtaatcccagcactttgggaggccgaggtgggcagatcacgaggtcaggtgttcgagaccagcctggccaacatagcaaaaccccgtctctactgaaaatacaaaaattagccaggcgtggtggcaagcacctgtaatcccagctactcgggaagctgaggcaggagaagctcttgaaccaggaggcagaagttgcagtgagccaagactataccactgcactccagcctgggcaacagagcaagactccgtctcaaaaaaaaaaaaaaaacctcgttggaaccaaaaattaaataaacaagttttactgtaatgctatagtagcctggacaccatctttagaaaatccaaaattgcctccattatgtaagatttaaatagtctcccatccacgaaagttaacttaatttcatgttataattttttacgatctcactatcagaatctccacagtgattaaaacttcttgaaggtgcagttctctctccccctaccactcacacacttggagtagcaaacactgacctggtttctgatgtctactatggcacctaataactttgtgactttaggcaggttacaagtaagccttgttgaacctctttccttacctattaaatgagatgaataatgacaacttttttgggtgattttgaagactcactgaaattttgtatgtaaagtttctggcacacagaagggtatagatatcagttcctacccccacccccataaacttgctactttatatcttatagaacatacacattaatattaatattaatgaaatcacagtgaacagactcatgatctcattttcaccttaacatattactttgttcttgtttccctccatcttgagacaaaaatccactgccacctaaatcaactctctcatctcccctgacttgattctggattcctttttttctatcttcaccttgctctgctgtcccaaccttttagtattatcaaaggcaaaataaaaattttgcgatgaattctctaaatttaacattgtgtttgggaagaaaaaattgcagtttagggcatacatgcagacaagtgaccttccatatgtctgaagaacaaagggaaggttagaggttttatttaaaaggagaaatgttactgctctttgagaaagttcattggcactactaaggtttgggggagctagcaagctccgactggcgagcagtgagtggtgggcaaaatcagttctagagttgcagcaagttatctcagaagctatagataaaactggtttcaggttacaacaagcagttccagcagtcaggcttacagagaattacattcttggagcaatgttttataccctgagtgcttttttcccctggcccctcaactctgatttagttgggtatgacaagaatgacccactgtcacccaggccagagggcagtggtgtgatcgcggctcactgcagcctccacctccctggctcaagcaattctcctgcctcagcctcccaagtagctgggataacaggcatgtgccaccatgcccagctaatttttgtgttttttagtagaaatggggtttctccatgttggccaggctggtctcaaactcctgacctcaggtgatctgcccacctcagcctcccaaagtgctgggattacaggcgtgagccaccgtgttcggcctaccctgttttaaacctcaccatagtttacttttcttctaccctcaactttctcagagctttcttgtattaaataactttagtatgattaaaataaaattctatactacactttggttgtagtctgtcatgcctgtgcctttgcacatgtttttatctcctttgacactcagttaaggagtcatgccctgaggagtattctccctcatcaccccggccctgcgttcctgtatagcgtcctctgcatgtcttcgttgtatgtcctttcatacattatagtcactgctgagatatttctgactgctatcacaatctctttgagttcagggactgcatattttatctctatccccagaatctagcataacccctagcaaagtaggaattcaaaaatcacagaatgaatagtacataggtgatttataaaaatagaaccatcccacatagtaccactttgtaacccacctctttttccctcaatatattagaaaataaagtcctgtaaatatttttagtggctgcatagtattccattatgaggctggatcatacccaatttttaatatgagcatacctcagagacactgcaggttcagttccagaccactgcaataaataaagcatatcacaatataggtagtcacataaattttttctcagtgcatataaaagttatatttacactatactgatagtctaatagatgtgcaatagtatatctttaaaaaatgtatgtaccttagttaaaatatgactggaaaatgctaacaatcatccgagccttcagtgggtcataatcttctcactatggagtgtcttgccttgatattgatggttgctgactgataaaggtgatgattgctgaaggctggggtggctgtggcaatttcttaaaacaagaatgaagtttgccacattgatagactcttcctttgaagaaagatttttctggagcatgtgatgctattttataggattttacccacaacagaatttctttcaaaatgggaatcagtcctctcaaaccttgctgttgctttattaacttagtttgcatagtattctaaatctttcgtgatcaacaatgttcacagcatcttcactgggagtagatttcatctcaagaagccagtttctttgctcatccataagaagtaattccttatccattgacattttatcatgagattccagcaattccatcccatcttcaggccccactttttttttttttttttttgagacggagtcttgcctgtggcccaggctggagtgcagtggcccgatctcagctcactgcaagctccgcctcccgggttcacaccgttctcctgcctcagcctccctagtagctgggactacaggtgcccgccaccacgcctgctagttttctgtattttttagtagagacagggtctcactgtgttagccaggatggtctccatctcctgacctcgtgatccgtccaccttggcctcccaaagtgctgggattacaggcattagccaccacacccagcccaggttccacttctaattctagttctcttgccatttccaccacatctgcagttatttccacccccaaagtcttaaacccctcaaagccatcatgagggttggaatcaactaactccaaactcctgttaatgttgatattttgatctcctatgaatcatgaatgttgttaatgccatctagaatagtgaatcctttttagaaggttttccattgactttgcccagatccatcagaggctattgcagctacggccttacaaaatgtatttcttaaatagtaagacttgaaagtcaaaattactccttgatccatgggctgcagaatgagcaggaatattttgaaaggaatcttccttcctgagaagtaggtctcaacaggaggctttaaatatttagtgaaccatgctataaacagacgtgctgtcatccaaacttcgttgttccatttctaatacacaggcagagtatatttagcgtaattcttaaaggccctgggattttcagaatggtaaatgagcattggcttccactgaaagtcatcagcttgcattagctcctaacaagagaatcagcctgttctttgaaactttgaaactaggcattgacttctcctttatagctatgaagtcctagatggcatcttccttgaatagcaggctattttgtctccactgaaaatctgttcttagtgtagccaccttcatcaatgatcttagccagatcttctggataaacttgctgcagcttctacattagcacttgctgcttcaccttgcacttttttcttatggagacagctttttccttaaacgtcatgaaccaaacccttgctagtttcaaacttttcttctatagctttctcacctctctcagcctttacagaattaaagagggttaaagccttgttctagattgggctttggcataaggtactgtggctggtttgatctatccagaccactcagcttcctctacatcagcaataaggctgtttgcttttttgtttttgtttttgtttgagacggagtctcgctctttcgcccaggctggagagtgcagtggcgtgatctcagctcactgcaagctccacctcctgggttcacgccattttcctgcctcagccccccaagtagctgggactacaggcacctgccaccatgcctagccaggcatacacttttttgtatttttagtagagacagggtttcactgtgttagccaggatggtctcgatctcctgacctcgtgatccgcccacctcggcctcccaaagtgctgggattacaggcgtgacccaccgcgcctggccaagctgtttgctttcttaccattcacattttcactggaatagcacttccaatttccttcaagagcttttcttttgtatttacaacttggctgttagatgcaagaggcatggcttttggcctgtcttggctttgatgtgcctccttcactaagcataatcatttctagcttttgattttacatgagaaatatgcgactcttcctttcacttgtacgcttagaggccattgtagggttattaattggcctcatttcaatattgttgtgtctcagggaattgggaggccagaagagggggagagaaacaggaatagccagttagtggagctgtcagaacacataacatgtatcgattcaccatcttaaaagggcatgatttatggcaccccataacagttacttgcaacagtaacagcaagatccccaaaacgtattttaataatgaaaaagcctgaaatattgtggaaattaccaaaaggtaacagagatagaaagtgaacacatgctgttggaaaaacttcaccagtagacctgctcagtgcagggttggcacaaaccttcaatttgtaaaaaagaaaaacacctttatatctgtgaagcacagtaaaatgaggtatggcttagtagggaaccccatttttaaaggctcagtatgaagggtcttaaattgaagatgtatttttgcgttctggttaagacactattccatttcagggttttttgtttttaagtggtttcccaacactcctcagggaaattgagcaagaattccatcggcagtcctcacatcaggaacagtgaaaaaggataatgtttatatggcacccgagataatcagataaggccagaagacaagagtcagagggttctgcctaatctaagccccaccatcctgatgtttaagggcccctgaatcggaggaccctgccacaggcaccaactgaagtcttttgtccatgtaacaaattgcagctcaagtttcaaagtcaaatctgttggagttcaactcggaggtccatcatttcccggctgtgtgaccagtagtttcttaaccattcagcctcagtttcctcatctataaaaaggaatgatagtaccacgtacaattgccagttaaatgcagtgtgtacattatctcatttagtcttcatgcaaaccttcaagactcaatcacaaagaaatgtccacacatttcttaacaaagaatacatatgctactacataccaactctcctttgtcagggaatccaatctagattggtttaaaataattataggaaagaaattcagcagtgaaatatgtgactatattggatgcttgctatttgtcatttactgtatttctagcgcttgtgccatgtaagggctgatgaactcaaaccgtagctcagctttttgcatgctcttttttacccacctagaggtccagtgtttcctgtgatacttacctctaaactgctaaatagccacattttacggaagcatattcttcatacctttgctctaacttaaatctctaactttgcactatatttaatatgggttttttggggggaaggggggagtggagttggttttttttgagacagagtctcgctgtctcgcccaggctggagtgcagtggcacaatctcagctcactgcaaactctgtctcctggattcaagcgattctcctgtctgagcctcccaagtacctgagattacaggcacgtgccaccacacccagctaatttttctatttttaatagagacggggtttcactttgttggccaggctggtctggaactcctgacctcccgtgatccgcccatctcagcctcccaaagtgctgggattacaggcgtgagccaccacacctggctaatctgttcttcactttcttttctatactcactacaaaaaagggcaaggaagtcttcacagctgcacttactaacaccgtcacggctctgttttggccatcatctgtttattaactaaactctcttctctcccaactccaaatctttgtttcttctagattgagttctctccctgaagagcctaatccaacctggtccctgtaactgccctgataccttaggagatacctgggcttatttaacttctctctggccaccatgtctttttccagcctgagtcaaagtatattctttgctctaacctaattcttttaagaatgacagagtaaaataagtaaaatttatatgaggagggagagggaggaggcaatcaagagaatgaatagtccctattcttgattaatccttattataactatgagttcaagggcaattatataatcttgttaaagcaccaggctaaaaacttgacatggaattgtaatttctgttgtgtatctaattactatgaaagcctagttctacctgtttcatcatttataaagggaattgcaacccccaccacgaccaacaaagtagtttcagagattgggagggactaagctagtcaatgtaaaccaagcttgtccagcccatggcccgcaggcctcagtgtggcccaggatggctttgaatgctgcccaacacaaattagtaaatttccttaaaacatgcacagatctttttttttttaaagctcatcagctattgttaatgtttgtgtattgtatgtgtggcccaagacaattcttcttccaatgtggccaagagaagccaaaatattggaccacccctgagtaaacactgaaattaattaacttcttcccttttggattttaattacataagtaataataagctcattttttaatacttcacccattcctgtattgtttgaaacataaatcctttccccattcccaaaggtaacaacatattaacagtctgaatgtcattccaagcttttctgcagtcattcaaacatatcactctttttctaatattaggaaaatcttcacacatacagaaagaactttacagtaaactcaccacctagatctaccattaacattttactctactagtttcatcacatttcatccatcaattggtcttgttcatttttgcatttcataataaactgcagacattagtatatttccacctaaatacttcatcattcataccattaatgattcagtcttggccgggtgcggtggctcacgcctgtaatcccagaactctgggaggccaaggcgggcagatcagcaggttaggagattgagaccatcatggctaacacggtgaaaccacgtctcttctaaaaatacaaaaaattagccgggcgtggtggcaggcacctgtagtcccagctactcaggaagctaaggcaggagaatggcatgaacctgggaggcggagcttgcagtgagctgagatcgcgccactgtactccagcctgggctacagagcaagactccgtctcattcataaataaataaataaataaaatgattcagtctttctttacagtttttttctgaagtaaatattacatgagacacacgtcttaaatgtacatttgctaagttttgataaatgtatacacctgtgtaaccccagccctatcaaagatacagaatattacctatcacccccagaaagttctctcctgccctgtccaagttaatctttatcccacccctccagaaataactactattctgatgtttttccaccagagatatcacaagatatcacatggttttatgattcattgtgaaccacagatgtacaaatataggttaaattattggtcagaggccatactgatgttaagtgctttttgttgaaaggattcatatttatgatgattttagttctatagtcactgcatcttagtcagattatttgactagtatggatggattttacaaacattttgtggaattctttttttaaccttagggaacctccacaaggagctcattttctttccagaagtctagatgatgccttaaaacttactgaacaaccagaattagcaaataaagtagacatggtctggatagttggtggcagttctgtttataaggtaagtgtagttgttggtaaataaaaacaaatgttctgttctactttcagcttccttgccatttaaaggaagtggaagaaacaggtataactcattgtctgaacctttaaaaaattaagccatgcgtataggaagcagcacattatctgtactgtaaattatttgttgttagttgaaattatttgttgtttgatactatacaaactaaatagaaatgcaaaaataaatattttagtctgtatcagccttttttatttattcatttatttttgagacagggtcttgctttgtcacccaggctagtgtgcagtggcactgtctcactgtagcctcgagctccaaggcccaagcaatcctcccacctttcctcccaagtagctgggattataggcacacaccatcgtgcccggctaatttttgtatattttgtagagtcaggattttgccatgttgcccaggccggtcttgaactcctgggttcaggcaattcacctcccaatgtgctgggattacaggtgtgaaccaccacacccagcctatttatctttttaattggcaaataattgcatatatatatatatatatatatatatatattatgtacaacatgttgttttgaaatgtgtatacattgtagaatggctaaatggagctaattaacatgtattacccacttattttgtgtggtaagaacacttaaagtctactctcttagcaattttcaagaatacatttgttattaactaaaataatagatgttgtacaatagatctcttgaacttactcctcctatgtaactgaaattttgtatcctgtgaccaacatctccccaataccaatctactttcaaatcaaagaataattgatgtttccaatttaaaatccattctaaatcttttcctgagaattgtacttgcattgcactggtttctactccctgaatgtaccctagatacactgagttatgcctttgtctttcaggatgaatatatctcttactgagaaagggttggggctctcagttgatatacactaactagatgtatatgaatttattacaagtagaaaacttcttcaaccaatttttttttgttttgtttttgtttttttgagatggagtctcactctgtcaagactcagtcgcccaggctggagtgcagtgacacgatcttcggctcactgcaagctccacctgccagattgacgccattctcctgcctcagcctcctgagtagctgggactacaggcgcatgccaccacacctggctaatttttttgtatttttagtagagacggggtttcactgtgttagccaggatggtctcaatctcctgacctgctgatccacgcacctcggcctcccaaagtgttgggattacaggcgtgacccactgcgcccggccaatatacctcttttttaataccaaatgacttccagctttaaaatttttgaggataacaaatagaattctttgccttttaaaacaccaatgaaaaattaacatttatgaggaggaagaaaaatctagtttctgccatgtgggtggtcttgtggtaagatatatacagtgaaattattttagaaagaagaggtaggccgacgcctgtaatcccagcactttgggaggccaaggcgggtggattgcttgaggtcaggatctaaaaaccagctgggccaagatggtgaaactccatctctcctaaaaatacaaaaattagttgtgtgtgggcgcgggcccctgtagtcccagctacttgggaggctgaggtgggaaaatcacttgaacatggggggcagaggttgcagtaagctgagatcgtgccactgcactccagcctgggtaacagagtgagactctgtctcaaaaaaaaaaaaaaaaaaaaaaaaaactctcagtttcttgggctcctgtttctagaacctcttatgttccccatttgtaatagaagaaaagggacattttttcttgatatttttatccaagtatgaatttcttctaagaaaacaagttatttattttgttcagtgcctaccacactttgaatgattcattaccatagtcacttgaaaatgtattctttaagcaatataagtacgtaaatgcctttatataatatgataaatctacatatagataaataggaagtagaaccttcgaatggtatttttacacctgcctcacatcacaacagcttgtagatatcattcaggcttatcttcctatgggccaaatcggacctcccagcctgtttttgtaaagaaagtttcagtggaacacagacccacccattcattcagttctgtctgtggcctgcaaaggtaggaaaccctatggccctcagagcctaaaatatttaccatcactccttttacagaaggtttgccttgtataatcaactttttttttctttttttttgagacggagtttcgctctttttgcccaggctggagcgcaatggtgcagtcttggctcaccgcaacctccgcctcccgggttcaagtgattctcctgcctcagcctcccaagtagctgggattacaggcatgcgccaccacgcccagctaattttgtattttaagtagagatggagtttctccatgttggtcgggctggtctcaaactcctgacttcaggtgatccacctgcctcggcctcccaaagtgctgggattacagacgtaagccactgcagccgacttataatcaactttaatgcagaacttcaccaccacagtcaatctaataatccagacagctcctaagtgactaaggggcaggtaacatagacagcatgtgcaggacaaagggataattcacgccctaggcaggacagagcagaatggctcaagatttcttcacactacttagaacagcatgtcatttaaatcttatgaattatttctggaattttccagttaatattttcagaccacagttgaccatagataacaaactggaaagtgaaactgcagataaggggggagtctgcattccactttttaaatttttggtacagtaagaattagtagagcatctatttggttgtagcaaagataataaatgatttaatataaaatgatatattgaaaataaaaagtgaaatttgttctgtacccttatttggaattttaaaaataaacacttggatttgttgtgtgtgtgtgtgtgtgtgtgtatttttcttttctataaactatttgagatcaagaattactgctttgttagaattgcaattaagacatactttttatgaatgagaattttaatacactcattctagggcaactttttctgtagaaattatcaaccatattttaggcagtagttagaaaagtcatgtacaatataaagccaaatgttaatacaattgttagcaccaagaagcagaaaaattacctatctactagcattgtaattatcttctgagaattggaagcattacaaaattttatgtatatgtattaagtatgctcttggggttttccatagtcaaggtctcattaaattgtactatcttattcatacaagtttatgtaaatttttctatggagagcaactagataatttggggctcttaactctaaacagccaaagggaaaacaataaaagagaatgcttaaattaaaaagttcttgtaagcaaactggaggccagactatatttaaactcagtctctcataattattgataatggttagtgtcattctcaatataactaaggcatactttgcagcaccccagatgaaagaatagtatattttaataatatgctttggcagcaccaagcatatttttaatacctagtataaacttaactaaacataaatcttagagtttctttgtcttttgacacacattaagaaaactgatgttgttttatttcaaaggaagccatgaatcacccaggccatcttaaactatttgtgacaaggatcatgcaagactttgaaagtgacacgttttttccagaaattgatttggagaaatataaacttctgccagagtaagtataaggttattaattagtctgaagcactttggatttcctgcttaagactatagaaaataacatgtcttttcagactacaaattgggttcactgtgtactgctaggatgatgggtgcaccaaaatctcacagatcactactaaagaacttactcatgtaaccaaatacaacctgttccccaaaaacctatggaaataataaattaaaaaaaaaaaaaaaaagcttggcacagtgactcatgcctgtaatcccagcactttgggaggtcgaggcaggggcagatcacctgaggtcaggagttcaagaccagcctggccaacatggtgaaaccccgtctctactaaaaatacaacaaattagctgggcatggtggtgcatgcctgtaatcccagctacttgggaggctcaggcaggagaactgcttgttcctgggaggcagaggtcgtagtaagccaagatcacgccattgcactccagcctgggcgacagagcaagaccgtctcaaaaacaaacaaaaaaaaatattaagtattttaacacctgagcatgtgatgtctttccccttgtttaggtcctatttcgttcagcgatgttttatacctttcagtgttaatttcatacttatgtattctattccttttgatgctattgtaaatggtattttctttagtttcagactgtttattgctagttacagaaatgcaaatgatttttgtttattgatcttgtatcttgcaaccttgctgaactcatttgtaattctgtcaatagattccttaggattttctctatacagtataatgtcatctgcaaatataggtttacttcttcctttttaatctggattttttctttgcctaattgccgtggctagacctgccagtacagtgttgactaaaagatagcaagagcagacttacttatcttgctcctaatcttagaggggaagcttttctctctcatcaagtgcgatttaagctgtgagtgcctttatcacattgaggaagatcccttctgtttccagtttatttagtattttttatcatgagagtattatacattttgtgacatgctttttctgagtctattgagatgatcatgtggtttttgtcttttatactaatattttaatgtactattaatatggtatatcacattgattttcatgttaaactaatgtttctgggataaattctacttggtaatggtatataatcctttttatatgttactgggcttaggttgctagtattttgttgaagatttttgcatttatattcagaagggatgatttatagttttttttgttttaatgccttcccctggttttgttatcaggataaaagtgacctcatagagtgagttaggagatgttctcttcccttctgtttttttgaaagagtttgtgacagattgttagtacttcttaaatgtcttagaaaattttaatagtgaatcgattgagagaggaatacggaaattgctccaaagtggagattctaaacaaggctatgggagaaagcaaaaaactcttccattgcaacatttgatggtcatttgtactttcaggcatgtactaacataacatcataacagcctctttaatggaatggagggaattctctaacgggagacctagagtaagtcagtccttcattctatggagaaaaaggaaacctgtgaagataaagtgaatatactttgtccctggaaaacacattgctcagttctggagcggctttctctccagatctctgtgcgctggggaacttagatttgctttctactgtccaaatataaactttggtcattctccacctcccctatccctttccccacagctactcacttagtttaagtcccgttgtctctatcagttaacctcttgtggttatataggtttctgttcaaacataaagtcttttattaacaccattcttcccgatttaaaaaataaacagactaatatagtgaaatacagatgaaagagagaacttgtgagacaagaagagaataaaattagaatgtggaaggagccacaagtgatgggagccagagcagacggtcatattaataaagtaaggtggttttactttgtgtctgccgtcagctctgtacgtcattgtgcagtcgatttttcaacagcactgtgccagcctatcctctagggctctgctctcattcatcttgcctggaagaaatctttctcagactatttcacactagaccccaaccaaaccagcaggcccagatattttatattggcagttttctacttaatgagccccaaacaggcttttacttctagttaacaatcttctgtgtgaccacatagtcaaagagaagacagattaaaagaggcctgtggaggcagtagttggctccagagctgggacagatgccccttatcagtggacaccttgaagtaggttttggatgggctgatgtttcttcttctgaccctaaaacttcctgtcaggatgctggcatactcgtccacatgactcggatatccctttgctcctgagcctgtgcttcctgtagagtcttgattttaattgtattttggttttttggtttattttttgtttttgagatggagtcttgctccgttgcccaggctggagtgcagtggcacgatcttggctcattgcaacctccacctcccaggttcagcgattctcctgcctcagcctcccaagtagctgggattacaggcacgtgccgccatgcccagctaatttttgtatttttagtagagacagggtttcatcatgttggccaggcttgtctcgaactcctgacctcagatgatccgcccgcctcggcctcagcctcccagagtgctgggattggaggcatgagccaccgcacatggcccaaaaacttcttgatatgttgcttttgtcttatgaactgacaatcttgacacttgagaattttgcacaaaaaatgtatgtagatgttacttttcatgactcattccagagagactaaaattataatagaaaatggttaatagaaacattgcttcttcccctgaaatataaattattccagaaagtatctttttcttttccctataattttgttacattgtatctctgtttttgtttttttttttaccaaaaatgcataatctctaattagtcagcaaaggttaatgtctattattactcagcaatgtattgaatatcatgagacttaaaagtttactgtgttgtccctgcctacaatgagtttaaaaaatagagaaacgaggcgggcggatcacgaggtcaggagatcgagaacatcctggctaacacagtgaaaccccgtctctactaaaaatacaaaaaattagctggatgtggtggcgggtacctgtagtcccagctactcgggaggctgaggcaggagaatggcatgaacccaggaggcggagcttgcagtgagccaagattgcaccactgaactctagcctgggctacagagcgagactccgtctcaaaaaaaaaaaaaaaaaaagagaaatgaaacaaaccaataatactagtaggcaccatttatagaacacttgatgtgttaggcacaatgctacattcttttttggttttgggggatgggggcggagtcctgctctgtcactgaagctggagtgcagtggcgccatcttggctcactgcaacctctgcctcccaggttcaagcaattatcctgcctcagcctcctgagtagctgggattacaggcacccgccaccatgcccgggtaatttttgtatttttattagagacaaggtttccccatgttggccaggctggtttcgaactcctgacctcaagtgatccactcaccttggccttccaaagtgctgggattacaggcgtgagccactgcacctggccaacaatgctacattttttacaaggatgaagactttattgacagccaggctcggaggcatgtcacacagcagaaccagagtgaagcacagtctgattcaagcaggcgttcctgaccacctggagcatactggggtgcagcctgcatagtactgaagaagtaaccaaagattggggttcattggaggctggaagggtcagaagattcctcagtggagaagctgggtttggaaggggagctggagagaacacaggcttaagtgagagttagggaacaggaatagcagatcctaataaaggaattacaatctgccacacattgtggaattagggcagtatagtctccatcaatcaaacagaagcagagaacctgtcactgtccagggcacataatttcagttatgttctaaacagcttcagattgtatttttgtcttttgcttacacaagaaatgtgataccaaatgtaagtcttgcaaaaaattcttaagaaatttcctgttagctgggtgatagagtggaaagatacaagggaaactgctgactggtttttgagagaatgaggaatccaaaggaaacaaaaaaggagaaattacactttttgttttctaactttctatatagtttacagtttttttcttaccatttgcatatgtagtatactagcatgatatttatccaacttgacagtggcttaccattgtgaagaaaaaagggaaaccttttatttgctttatgcactattgatgcatttaaactgagaatcagggaagctgtgtttttaatggacacataatttaattatatattttttcttacagatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacacctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataa

SEQ ID NO: 805 - DNA, 2053 bp, Homo sapiens
cggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttgggtgagtatcagcccaacaagaggtcccaggggaactctctcaatagatctgccctttatatttccattcaacttgagggcccacagtgttcccgcctgcctccccttgccctccaggtcctcagtggccagtctgggttcacactcagtgaccacacagtgaacccaactaggggtggagagaaagggccataacccagagccctactgtggcgtgagagtcagcctctgtgattgcctttcccagctacgcaggatgcaggctctggagagagaacaggatgccctgtggcagggtctggagctgctacagcatggccaggcctggtttgaagaccatctgagggaggcacagcgacagcagctgcatctaggggcccttggtgaggtatgggggctgcccctctgtgtgaatggggggaggaccagggagggaggaacagggaatgtgtagacacagcctgagaccactctggagaggggagagttaatggtcagggatcatgagttggaggcagcatcgtaatgacaggatgccaccaagtgttaagttggtgttcattgttggggctggaggaagctggtctgcattccattcagagggatttggatcactccatggagatgagggtgtggcctggattattccaatggggcagggatggacagggaggctccatgaagagtagtgaaagggggtattgtgctatttgagggagatggaggaactgatgtgctaaagagatggaggtggagagtactggattttcccacctgcctgggagggtactgggacgaggggatccagatgagagggatggcctgtggtgacaggaatagagtggcagacgacctcaggttttcaccatgttgtcagcctccaactcctcctctagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaat

SEQ ID NO: 806 - DNA, 7107 bp, Homo sapiens
gcattttaatgtccctctgcttggatttgctacttagtttttctttaatcaggatagggtgtacacataacttttaggtttcacttgtgcttataaaatccggttaaaatgatcttagtgtgtcttttacacttccttttacattttgaggacatttaatgagctcttttggttgcatttaacatcattcccaggacagggagaaatctccacgccagactcagcgatggaagtagatcttttagcaattgagacagtttactgtcgtcgagaggaagatattgttaatggtgacattcgtctgatttatctgtgttggtggaaatggtaatgcaggcattgtttgagggagctccagaaaccattgttctggggtagaactcgcaactactttgtgtggttcctcaaaacgtccctcactctccgcctccgaataaaatgtttttataaggaaatactagggagaacccgggcccaccgactgtatgttccaggtatcctttctggggtaggtaagtagggggctgtgttccctcccgcgctggttgcgcggcctcttaccgggacctcctcgatggcgtgaggtaaggagtggatcgagaggtctccgagtcctgagctgagcgcgtgtgggccgtgcaggaggtcctcgtgccgcctgtagtccctgcgaggatccaggcccgacagctggtgaggcagcccccggtgcgtgtgcaggagcccagactcctggctctgcctctggccgggccagcctgggtgctgcggctgcggctgggcgtgcagggggttcaggctgtaggggtcgttgacgtgggagtaaggatcttgcgactgggggtagataggctggtagggtggggggaagtatgggggctggaagtcggcattgggggtgtgggacagcggcggggcgctcgtgtagggagattgacctacagtgcccagctggggcaaccgtgccgtcccgttgctggtgccgtcgtgacggtcctagaagagagcgagaggaaaggtaaagaacaaggaatcaggcgtcgagctacaactatccacacaaaatccacttgacaagtctgcgtgggaaatcgcccgttcccgttggctggccgccgggaaaaaatcagctctaagttcttttcaggaaataccctcaagtgaaacagaccgaacaacgcagagaaactgtatatggagggggcacaagagactatttaggggtttctttcaaagagaggaaaagatagaaaagggtctcctggaacacagcccattaaactgcagcgtgaaatctctcttaagcaaaattaaaattcctcctaaatactaaacagcagaagcggccttttcttttcccccgatttgaacctgtctgccactgcgttattgtttattctcttccatttatttggagagaaaaaaatcataaacgttcaaagactgttaccgtttcatgactacttaaatagaaacatatttcgcagaggggctgtaacaaaaacacacgtttaaattaccagcttaaagaaggttttaactgcaggatcggggtctgtctttttcgcttcctctgttaggagcctttttctcgacagagtcgatttatggtttggatagggaaagggggacgtcaagtcaaggtttaaaatagaaagattcagccttattgggtttaaaagagagaggtgcaccccggggctgtggccccccccccccgccccttccaccccagccccaaagggcagaagaaacgcctgactttaggtttctctattgcaattcccttgcaaaacaagcgaagagagttgattccagagaccgcgaaccctcggcggttcggccgcaggtcccgagggtagggggcacaccgcgctgcacttttcctgcagacagtttaagcatcaaatgttgagaacatctcggggacaagtgaagactcaaggaaatcaagatgaacgtggggagaaacacgccttgggaagccgcggcgaggtaggtctgcgtgctcggagaggtcgagcgggggctggggtagggggtaatgcactcgatttagggatggaaaagagcgagagaaaggcggaaggtggggtgggggatgcaaatggagagggtgtcctgaaggaaagctgggcgtgaaacccgaggtttcgggcagctccacggcaccaggtttccagaatccaattcctaaagaaacagcaacgggggtggggatgggactcaccatggctgaaaaactgtgaactaacatctgcgaagagtctggggtaacgagtcagggtggaaaaaaacaagcaagcctggagcgcccggctgccccgccgcccgagcgcgccccacacaaaaggcgccgagagccccgcgccacccaggactccagtcacggcgccgacgctccccggagcgcgggagcccggctcggatccatccgaacttgaaccaccgattcgcgcggcgccttcagctggtcgaacccacggtctctatcctgccgcgactggttatgattcaaagttctttaaaaatgaaaaaccccaaaaaaggaaaaaggaaaaagtatgtgtgagtgtgtgggtgcgtgcgtgttccttaatccgtgtctccccctcttttcttagcggcggcttcgcttgagcttctaataaccgcgctgggcagcgttcctggagcctcctaatagcagatattcatgactattaatattacacgaatacttaataagggaagaatgcctggaaatcgagcgtgaagcggagaggcaactcgcgccggagccggctctcaatgcagtccattgacgggagtctcagtgtagcaaatcggagtggggagagggagcgcgagagacaaaaagcgagcgagagagggagcgggcgagcgcgcggggggccgcggcgcggcgtctggcgaatcacagggaaggggcaacattttaaaaggttgcagggcatgcaaaagtgaaagagaaagaggcagagagggagaccgaaggagagagcgcagagagggagaatgtgtctgcgtgcgtgtgtgagaaagaaagtgtgggcgagggagaggagccccgggtggggagaggggagggagggaaggagggagagcccgagaggaggaagggagggaaagagggagggaggaagggagggagggagggggagggggcccagccggagcgcacggagggggaggccgcgggggagggggaaggggagaggaagcgagcgaggacaatcagacctaaaaggctggggcagacctcgggatgcagcgggggtcgtgcgtagcgggtaggagctgcttgggaccgcgtccgggcgctcgtggggctctcggcgcggcaggcgcttcccggccctgtctggccgcgggctccgccgcttcgcagccgagtctgggactcgggactcggctgcccgctgctgcgcggctcctccatgacccggcgccctgcccgggaccggcccgctcgctgcactggtcctctcctcggcctcctcttgagctttcctcggacaggggcaccgtgcgctccccggccaccgtcgctctgccctcggctctctggggccggggattccggatcgggagccgggatgcgggccggggcgcgcacagacgctaggcggcccagcccgggcgccgctggcaccggctcgcggctcccggcaaaaacccgtccgactggctgggccactcccgcctgacgcccccccagatgacacgactagctctcccggcgtgctgcctttgccagtctacccgccaggttgtcagaacaagcggcacctcgcctcctgcgtgtccctacagagccccggcacaatcagactgccccaagccagctccgaaacccgaaatccccgctccggcgcttgcccaccacggccaaagttgtggaaacagctttgactttattctcctctctctctcatctttttttgcctcgcttacacacgcattcacacttgcccccacaggatccctctaggggtgcaagttcatcccccacctagccacccaccccatccagtcggcacctagagccgcacggaggttcggaccccgcccgccgagggcgcccacacctggagctgggtttcggcctctgcgaaagtgaaatgcccaagcctccggccaaagcccagaccagtacagtatgaattgtcctatgagactgaggggttcggcttcattcctacctgcccgcaaagctcgcccccagcctcgaaaacaaagcgactggtctgacgtggggtccctgcgcccctcctctagcgcgacaggacccccccagggaagagccagtacccgtgggatgtcaccccgtccccatctaccggggtggggggcctgaaaggagaacgatttaaaataatcttcagaaagaaaagggaggagggagcgggtgacacatcgttcacataaacccaatttctggtttcgagtgaagtcaagatctccgcccctgcgcctgcacacacacctcctgcctaacattctcagctgcaaatgccaaaaaagaaaaaaaaaaaaaacagcaaaagttgggactgccacctatttatttaggtaatctccagccctacacaccccaacccctctctcggactcattgctcattacagtgttggttgtaaccgttcccagcgcctcctgcgggtggacaggtcgcgctagggtctcccttgctgcctcaagaaggcgagctcaggggactctgcgttttaaaatgggttccaaagcggcgcgctctgtcggcccagcgggcttgcggcaccagaggtggtctgcagccgcgcaaggattcccacggtcgttctgggctggtgcagaagctggtgctcccgcacccagcggccagcaggctcggcgcagcacatctccccaccccacccccacacacccccgtggggtgcgtcgatcctgtagctcagagggagaagctacttagaacttcgtgaagcacagaggatctggagcgagccccgcagctgggatcagtggtcttaagttgaacccgcttacaggaagatgcagcccagctcacagcgaagtgtgggggggccgtctctaaagccgagaagggaaccgctttagaagtgggggtggggggaagaaagaatgaatgaatgaatgaatgaatgaatagaaagaagaaggaatattaaagatcggagaggaagttcaagagagaaaagagttttctctttcctttctgttcctggtgacttgggccctcaatctcgatgaagataacacgaggagtgcacaggcaagtgcccagttgccagcaattgcttcaaaagcccatgttcttcttttcccccattcttaggcacagccaaaattggtcagaaaggggagtaaagtgggacacgagcttcaaagtagggaaaccaaagaagggagcatccacgtcctctctctgcagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctgggtgagcgcaaagtgctggctgccggcggtgagcgcaggaggaggaggaggagggagaggaggtggaggaggagaaggaggagggagaggaggagggcaaggaggaggaggaggaagaggagggcgaggaggaggaggagggcgaggagaagggcgaggaggaggagagaagggaaagagctcccgtgtgcgctcggagatctccctctaatggtagaaacttttcccttttccagctctttaccaacagcctaatcgcctcattagcatatcaacaatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattccccttcctttctttctccgcttccttttctccagagatgccttctgcaaagcccggcactgctcaaggtccaagcgccacgcctggggcccagcttctagcacttctcccttaaccctgctaccacgatccgagctgcccttttggccccgtgcaattttattagaaatcattatccctttcgcaattaaacataaccaccaaaccaagaccggcgaagtcactccaggattttttcccaacaagggatcgcctccgctcgaggcagccaccccctcgggccgcagcgccttgggagttttattggctttgagctttcccccaggttggagattctgccaagcggctccggtggctctgctggggtttgcaatcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgcatcaaaataaatcaccgggaaccgacttttagctgtgttaatctgctctagttttcccaagattcccctttttaattaaagcagggagagttccttcatgatttggtgatgctactaacgcgggcgtgctcgcgaggcagagcccggctgccgcggaacctggaggcctgggagccacctactcgtccagactggtcagtccgggcttttggactcctcaccggggcctgctgggtcctctggggcttttatccctttcggttttgggatttttttttaagtaagaaaaaaaaaaaagaaaa

SEQ ID NO: 807 - DNA, 228706 bp, Homo sapiens
aatgcgcgcaagaagggaggtggcaaaaatcatgtccaccgggggggctcaggtaagggctggggaggtctcggggttaaacattcggccctttgttcaccaaggcagcagagcccttggcgtccgcagctcctcctccccgactgctccctggcgccagcgtctcccgaggacaggcggcaagggctcggacgcccaggcttggctgcgggtcgggatcccacggcctcggcggcgcgcggcccctgcctttaccttgtagacgtcgccgtaggtgccgctgccgatgcgctgaatcagctcgaagtcctcctgcgggttccggcgggacaaatcgaagccggggttcatggcgggccccaggtgccccccgcctccctcccgggcaggggaggggggccgctcagggggccacacggagagagggcgccgcggccggctcccggctcccccggcggtcacaatcacccggctccacgctgcggccgccgccgccgccgccgctcccctcacgccgctgcggacgacgacaagcggccaatcgtccccgccccccgcggcccgccgccgcgccgaacctggtcacacccacaaggagaggagaaccctcgcagcccctcgctcggggtgaaactccaacatggcttccgctttcgccgctcctccccctccccttactccggctcctccaacctcctccccttttcccgactcccgcccgactgcgcagccgcgatcccggagggagcgcgccaggcctggcgcgcacccgaccccttgcgcgttccggctccgcgcgcctgccaggccggggccggcggcggaacagcttgggacccgaaacgcctcggcttttctgcggacccgcgcccggccgctgccgccggacgcttgaaaaggtttgcctggcccagggaccggggttaggactagcagaaagtggcttcttttcgtttctgattcccctaacgacaaagttggaccttggtctatctggtcccagttccaagcaggtagcatagtggtaatatccaagacagccaatgtcccagcctttattattttagaagcagctacatgtaggataccatggagtgctgcagcctttctgggattgcggggaggggtcactaaacacaccgtgaggaaaacccccaggaaaagtgagctgtgcttgcttgcccctgtcaccgacactcggacccttggagttggcctgccagggtgcaaaggagggcaggccaggagggccgcgagggaggtgtgtgcagtgggcagagcgtgaaagctccgggaggaaaacacgcggaacagctgcccaccatcccgcgtgggaggcaggcagagcgcagaactaaagcagtgattgacctccctcttcgaagagggttggattatcaaagacgggcggggactgcgcaggctgtcaagcaaccctgtaaagaaggggtggagagtggactagatctattaccgcacctgaaatataaacacgtgacgatccggaagctctttagctgtgaccttacctacccaaaaaccccaccctgcttaagacccagattgcgcgtcttacatctgagctatgtggactccagctccgattgttaatacttgcccaagaaagcttgagggtaatggaaggttatttttctgttctcattgaacttcccaatagacatttgcaggagctttaatcaattaggtgatggccactttggcaataccacgttggagttttgcttcagaaatgctttcctaatccccttaggcaccacaccttctaaccactaatattccctaatacctcgtggctcctgagaaactaggtctcatcaaacctgttaaggataagtataataaattaatagtagagcaaactacttagagttaactgcttcatactttttcaaaaaatcttttgaatccttttgctcataggaaaattgcatatgtactaaattctcaaattgtttactttgagtatctgttgactaaattgatgtttgaaaatggttatctcttcacctatataagtagcctttcagttgtgtaatttttaattattaaattttaaagcatcagtaatatgaaagtatcacttaaattattgccttaggagtgcatatcattgaatatcttctcgatggatctaccttcaggctctggtatcttgagaaactcctgactataaatgttattccatagccaaaggtcttgcttttgcttgtttaaggtacttgcccaggacccagattacaggccttccttcagtttgtccacatttggagaattgtttggcatgtttaggccaagcgcaagaataattagccaaggattcagataagcagacctgacaaattatcccaaatggaagccaggtctgctcttttcctctgccttttttttttttttttttttgagaaggagtttcgctctagttgtccaggcttgagtgcaagggtgcaatctcagctcactgaaacctctgcctcccgggttcttagcgattctcctgcctcagcctcccaagtagctgggatcacaggcatgcaacaccacacccagctaatttttgtatttttagtagagatgggatttctccttgttggtcaggctgctcttgaactcccgacctcagatgatccgcctgcctcggcctcctgaagtggtgggattacaggcatgagccactgcacccggcctctgcctttttagtgccagaaagccaaattctcaggactgaaagctgcacaagaaagttctaatgacttcagtgttttgtttgctgagattatcgtctgtccaaataactttgcatttgcatcactaatagactgctttcaaaaggaaaagacatttcagtagggctagaacagtctttaaagttttgtctgttccattttggcagggccaagctagtccttttgagaagagatgaatttccatgtaagggcctgatttgccatgtgggttacaacataagtaaaacaactgctcacaaagaaaatattttgttttttgtaatatatgcatgtggccaattccagtgccttttccccctgttctaacaatcctcagttttgctagaagtaacactaatgatcacactttcctagaatcagagaaagagcttccctcttctatgattagaagcattcttagaagtcatctaatctttttaactcaggaactgcttctacagcatctctgctggatttgctgctgcttgaatactttcaataaaaggtgactcattgcttcccaaaacaacccacctcgttgtgatacagtgctagtaaatgatcataataactaggagaaaagtagtaatttctaacattgctaagtgcttacaagataccaggaatggagccaagtatttttcatgtgttatttcatttaattcgcacaacaacctaatgacataggtaatattatctccattttatgaggcacagacagattaaactgctcaaggtaacacagaaggctgaaatttgaacaaaggcagtatgacaccaaggctagattcttagccactagtctatactctgcttatatacaatatactgtaaaaaatttctcttatggtaagccaacctctacctccctgtaatgtatttagaggcaatgattattagattctggtggtattgaatacagaaaagaaaagccacaatgccttccctcaaggagttgacagtctcataaatagtgtgagaagcacagagaagggacattaatgcagacgggaggaagatttaggaatgaccccttggctgggcgcagtggctcatgcctgtaatcccaacactttgggaggccgaggcgggtggatcacctgaggtcaggagttcaagaccagcctggccaacatggtgaaaccccatctctactaaaaatacaaaaattagctgggcgcggtggcacgtcccctgtaatcacagctactcgggaggctgaggcaggagaatcacttgagccgggaggtggaggttgcagtgagctgagactgcaccattgcactccagcctgggcaacagaggaagcgtccgtctcaaaaaaaaaaaaaaaaaaaaaaaaaggaataaccctaaagctgaaccttgaaaaatgcataggcagacaagggaaagtggtgcatgacaggctggctgcttagcgccttgaagcacctacccgtttaagcatcacacagcaaggaacacaagaaggccaagataggcagcagtccccacctgccagcatgtccaggccatccttctattgccccatcccccatgggtttctggcttaggaaccccttgatcccctgcacaggctcccaatttcatcctcgacctcttgtctgacaactcactggagccccttctttggcctattaacctcagccctcctcatataacataaccaccactcacattttcagtacattagctgctctggaaacaggatactgagcaagccttagctcaaaaaaatgccagaagcaggtcatccaccaggggaggaaaatcacacagagagcatgtatgtgaaataatatggcacatacaacagacaattgtgcttaaattctgaagacagagggagatggtggcaatggagctaaaaaaatcaggtttctttttttaattaaaaaatttttatttatggccaggcgctgtggctcacacctctaatcccagcactttgggaggccgaggcgggtggatcacctggggtcaggagtttgagaccagcctgaccaacatggtgaaaccctgtctccactaaaaaaaatacaaaacttagccgggagtggtaccacgtgcctgtaatcctagctattccggaggctgaggcatgagaatcgcttgaacctgggaggaggaggttgcagtaagctgagattgcaccactgcactccagcctgagtgacagagtgagattctatcattaaaaaaaaattatttatgtatttcatttctccccagctttaaattgaggcataatgggcaaataaaaattgaatgtctttacagtgtacaatgtgatgttttgatatatgtatatgttttgaaatgattactacagaccagctagaaaaatttacttacaaaattcaaacatgcttaagaaaaatttatactttttttaaaaagtcagaaactggcttgtgaggagctggttttcaggtgggttatcatatgtttaagctgcagagacttccaaaaggttatacagccttacctagtacagctctgaaccaggctacctaggtttaaatcttatctctgttccctgactgaaaaaccttgggaagttatttaaaactatagctgttttgattaatcaaaaagaaaatacagggaaaggagtgcctggcactatagtaaccccacaaaatattaattattattattttgagtgttcttttttctttttctttcttttttttttttttttgtttgagacagagttttgctcttgttgcccagcctggagtgcaatggcacaatcttagctcaccgcaacctccgcctcctgggttcaagcgattctcctgcctcagcctcctgagtagctgggattacaggcatgcgccaccatgcctggctaattttgtatttttagtagagatggggtttgtccatgttggtcaggctggtctcaaactcctaacctcaagtgatccgcccacctctgcctcccaaagtgctgggatgacgcatgagccgccgcacccggcctattttggttgttgtaaagacattctaaagatgccagtcttataatgtcagttctaaagatgacagtcatggagatggagatgaagatatgacttaggaagcaattacgataacatatataagagaccctgaattagggtctggagtgctgagaatggagaagagagaaataacacaggagataattgggagatggaatgcataggcttggggaagtgaggaagcaggtggagacattagtgacttgcaggcttatggtataggcaattgggagggtcatgatagcatttgccatgataaagggaactggtataatttggtagagagtcaaagtagatgatctgttttgtagctaagtttgaagtgctcaactggaaatataaaattagtgataaaaatgtggatctgaaatttagaaacaatatcagggctaatatttagatttgaggagtcatacttcagaaaaatttattgggcattgatatggtttggctgtgttctcacccaaatctcatcttgaattatagttcccataatccccacgtgtgatgggagggacctgatgggaggtaattgaatcatggggccagtttctcccatgccattctcatgataataaagttcttagaagatctgatggttttataaggggcttctccttcgctccactctcattctctctcctgctgccatgtgcagaaggacatgtttccttccctttctgccatgattgtaagtttcctgaggctccccagccatagggaactgtgagtcaattaaatatctgtcctttaaaaattactcagtcttgggtatgtcttcatagcagtgtgagaatgaactaatacaagcattgatcatgtgtcaaacactatattagattatgatgatgcaatagggcatggtctctgaacttaaattgagaatacagagaagttctcagtgaaaacttcagagaggtacagggaagtagagccagaaggaaatattagatgcccctggggctaataatttggctctttttcaaaccaatatatgctttttaattttctttaaatcaattttttttttgagacagggtctcactttgttacccaggttggagtgcagtggcatgaacatgactcactgcagccttggcctcccaggctcaagatatcctcccaccttagcctcctgagtagctggaactacaagcacacacaccacacctgactaagttttctttattttttgtagagatggtgtcccatgatgtttcccaggctggtgtcaaactcctgggctcatgtgatcctcctgttctggcctcccaaagtgctaagattatagacatgaactactgtaaccagcctaaaccagtattttaaaaaacaggtactcaatatttatttacaaaaaagggagagctctgccttgctgtgggtggagctgggagttctcacgtgtcaactttcaaccactcttattctgagcaatttggctcagttctcagatttgcatacccccaatagtgtttctcaattgaggttttattagcattttgggtggaacaatttttccttgtgtgggacgatccccatgcatcataatatccctgtccaccccatgtcaatactgctcccagccatactgacatcaacaaaaatagccacacacatttttgaatgcccaaggtttggctgggagggtgggagtgtgagtggttggattgagaatgtttgcttagcatctcccttgggagaactgtcacccacaccaatctgtttatcaaggtatttatttctatctcatacagtatatttgctgagagaagttctgatatgtaaaatattatctgttttattacatttccaatgtccaaatgatgttgtttcactgtcctccatagattcacagccaacattccgcttccacctgccccttatcatatacttcctgggactacttaggagagcacccaatgtagtctttgtaagttttaaagtcttcacagaggaaggaacatctcagcagatgcttaaaagacaagtagaaaattagccaggcaaaaaggtacactccacgcacacacacaaaacctagttctgtttacggtgaatgtggtaacagatgaggctggaatggtaagcaggaaccagtccatgatggaacatataaattgtgttaaatgattaggatttttctctttttttttttttaactgagaacaaaagggagctattgatgagtttttggcatgtgaataacaagatcttatttgtgacttggaaacatttcactagctgcagtatggaaaatgaattggagacaggtggcaagactagagacatgatatgagaataatcaggagacctttgcaatggtataggtaagagaaaatggtggcctgaattaacatctggagtgcatatcaacatacagtgatggtagtatttgaaattgtgggttgagattaattctcatagggaaaatgtatggaataggcagaaaatgggttcctacaaaaccccaacatttagggtgtgagcaaagtaagggaatttagcaaaaaaggccaaagaggtgggacccagtgtgatatgtggtaatggaattgtgtggcacctattggaatgaacagtcaggtttccctccagggaggtaccggccgtatgggctgtgattagctgacagcctcccaccaccatgcctttgggatctatcacagcatttacacagaggtctccctctctctagatcctcccagccaatgcctgagcatggctattgctttccaatgtagtttcttccgatgggcagtctttgctctggggtccccattggcctaattgagcctttctcagagccgccacgcagatagactctacccaattcttccttctcctattccctttatggtattaagatgtggtattaagatgtggattgcaatctgacattcttccctcctactgctacttttcctctttatccttcacaagtgttttcacagatttcttgcacttcaattcaatcttactatctactgaagtagtacaaattgtatcaatgaaacaaaagaggaaattttaaggagagtggatcaacactgttaaataccaaagagagactgggaaagagggggacagaaaagtatcgttagttgtcattatggagatcaatgctaaccttaactatcaaagttcgtattttctcttctgctattgtgtctcctcttagttatattctcccaaatccccttcagcctttctcatacatcatgaactctatacatctcatctggaccccttcgtatggacacatttaacttgttaatatctttcagagtaaactctggcaaagaattgagctcagtattccaaatgcagtctggtcactgtttactatggggggattgtaactacctattactggaacgctttattatagcctaaacttttatccaatttttttatagcccaacaaactcagggtcactgtactgctcgattctgggagatgccattcatactgttatctataattctaaaatcctcaacccctacctggccccttggtcctgatgaagaaaaatctccaaaaatcatatttgccctcctctaagatcatcacaagtgttcttgaacccacactgtcataaagtgtcagggacaagaaacctggtctcaagcatctcactgtgaagtttctgccctgacatcaatctaacaggctagatgttatcttctcatccccaggcaaatataacaccaacaacaacaaaaccgagcacccagtacctgtatgttatattgctaccaggtgagatcttgaaaacacaaaagaattatctagacgagaatctttcatcttcttgggaagccaagattttaaatgatatcttttcagactcattcagtcctggagggtacaggctacatcaaaaataggcaataaaatctggtcctgtaccgtatgacaacatttcagtcaacaacaggctgcatatatgacagtggtcccataagattataatggagctgaaaaattcctattgtctactgatatcatagctggtgtaatatagtagtgcaacacattactcacatatttgtagtgatgctggtgtaaaacctactgtgctgccagtcatgtcagcattcagtgcatataattatgggtagtacataatactcgataatgataatatatgactgttattggtttatgtatttactatattatttatccttattttagagtgtattcctcctacttatttaaaaaaaaaagttaactgtaaaggagcctcaggcaggtccttcaggaggtatccagaagaaggcattgttatcataagatatgacaggtccatgtgtgttattgtccctaaagattttccagtggggtccgggcatggaggcatatgcctctaatcccagcactttgggaggctgacgcaggaggattgcttgagcctaggcattcaagaccaggctgggcaacatagcgagatcttgtctcaaaaaagttttttaaaaaaccttccagtgggacaagatgtgaagatggaagacagttatattgatgatcctgaccctttataagcctaggccaatgtacgtgtttctgtgttggtttttaacaaaagtattttaaaagtaaaaaaaaagaattgaaaaaattaaaaaatacaaaaatgcttgtagaataagtatataaagaaagaaaagactgaacatggtgggatgcatctgtaatcccagctacatgggaggctgaggcagaaggatcattggagtccacgagttcaagactagccctaaaagaaaatatttttgtacagctatatcatgtgtatgttttaagccaagtgttattacgagttaacttttttttttttaatttaaaagtatataaagaggtagtggctcactcccgtaatctctgcattttgggaagctgagataggaggactgcttgagcccaggagtttaagaccagcctgggcaacacagggagaccccatgtctataaaaaatttaaaaaaaattaaccaggcctggtagtgcatgcctgtggtcccagctattcaggaagttgaggtgggaggatcactcaagtctaggaggttgaggctgcagtgagctgtgattgtgccactgcactccagcctgggtgacagagcaagaccctgcctcaaaaaataaacaaataaaattgcagtaaactaagattaatctattattgaaaaaaattgtgtaaatttagtatagcctaagtatacagtgtttataaagtctacagtagtatacagtaatgtcctaggccttcacattcactcactactcactcactgactcacccagagcaacttccagtcctgcaagctctattcatgggaagtgtcctatataagggtaccattttttaatctttcatattgtgtttttcactatgtcttttccatgttgagatacacaaatacttaccattgtgtaacaattgcctacagtattcaatacagcaacaggcagtacagttttgtggcttaggagcattaggctacaccatatagcctagatgtgaggtaggctctatcctctaggtttgtgtaagtgcactctatgattttcatacaacagcgaaatcacccagtgacacatttctcagaatgtatccctgtcattgagcgatgcatgactgtactgaagaacgctaaggaagtacacgctgctaagggacagaccgagggatggttgagatcatttttttaataaaatcttccttatatttatctgttatcccatgatatattagagcatagtgtttccctgattccatcttacataacatccagcctagaattcccctcagatgcctctggttaagaggtgttgccctgtgtcctagttcccaaatacagagcgctgttgggccagaccgacctggcccagaacaaatatagtcacatacattgtgtttgcagagttgctcactgccccagagtcatatcctgctggccttttcactagaagctttattgtacgttattattttctcctaggaggacttcacccctgcacaacaaaacctgtataatagtaaagcaaatctatttgtagatttagaaagttcatcttttttgaaaaaaatcatccactaatttggtttaaacctggattggagtttttctttctcaaaacagattaaaactggaaataaaagctcagttaaggccggggatggtggctcacgcctgtaattccaacactttgggaggccaaggcaggcagatcacaaggtcggagctcgagaccagcctgaccaacattgtgaaaccccgtctctactaaaaatacaaaaattagcagggtgtggtggcgcgtgactgtaatcccagctactcaggaggctgaggcaggagaatcacttgaacctgggaggcggaggttgcagtgagccaagatcctgccattgcactccagcctgagctacagagcgagactctgcctcaaaaaaaaaaaaaaaaaaaaaaaatcaaaacagccgggcacggtggctcacgcctgtaatcccagcatattgggaggccaagacgggcggatcacgaggtcaggagattgagaccatcctggctaacacggtgaaaccttgtctccgctaaaaatacaaaaagaaagctggacatggtggcgggcgcctgtagtccccagctactcgggaggctgacgcaggagaatggtgtgaacccaggaggcggagcttgcagggagccgagatcgcgccactgcactccagcctaggcgacagagcgagactccgtctcaaaaacaaacaaacaaacaaaaaactcagttaaggctgggcgcggtggctcacgcctgtaatcccagctctttgggaggccgaggcgggcggatcacgaggtcaggagatcgagaccacagtgaaaccccctctctactaaaaataccaaaaattaaccgggcgcggtggcaggcgcctgtagtcccagctactcaggaggctgaggcaggagaatggcgtgaacccaggaggcggaggttgcagtgagccgagattgcgccactgcactccagcctggggggacagagcgagactccgtctcaaaacaaaacaaaacaaaacaaaaaaaaaaacagttaaaatagttcgaataccagttttccattactcctattccctgctcacagttcaaggtcaatgggaagataactcttttctcaaactgacccagatctctgcaccgggaaacagatccgtttgctgggtctgagctaatggcaaagcctgtctaaatcaaggtatgcctcttcttcttcttcttcttttttttttgagacggagtctcactctgttgccaggctgaagtgctatggctcgatctcggctcactgcaacctccacctcccgggttcaagcgattcctctgcctcagctgggactacaggcgcgtgccacaatgcctggctaattttttgtattttagtagacacagggtttcaccatgttgtccaggatggactcaatctcctgacgtcgtgatccacctgcctcggcctcccaaagtgttgggattataggcgtgagccaccgtgcccggccaaggcatgcctcttcttagtatttgagccagaccttcagcctgggatcatatcgtctgggttacttacagatactttaaaaatatatgaatctttttttttttgaaacagagttttcttcttgttgcccgggctggagtgcagtggcgcgatctcggctcactgcaacctccacctcccgggtccaagcaattctcctacctcagcctcctaagtagctcggattataggcacgcgccaccatgcccagctaattttttgtatttttagtagagacagggtttcatcatgttggccaggctggttttgaactcccgacctaaagtgatccactttcctcagcctcccaaagtgcagggattacaagtgtgagccaccgtgcccggccaaaaaaatatatctttacattagtagttaaacataaattagtagttaaattgtagtatgacctctctcagctaggcatttgatgctatcaggatagttttaacatgtggtgatggaataattgttttccttgtaaaagaaacaaaaggaaggaaattcatgaaagtttccccaccactttgtattttatttacaaatggttaaacttgtaaatgaaatttgtgaatagcctctttcaaatttaagcgtggagcttcttatggtcagtctgtgtctatctcaatgtctggaaatgtttgtatgaaactgtactgcctaaaagcataacactttttcattgctgatgccagtatttagggtttatgtatcctctcacctaaggagagcattattctgtcattccacataaactcaaaacacctatctgcaaatctgagtgcactctgttgtctgctatatggtgtgcaagctcttaattagtctctcttgccccagtctcttcctcttcttatgatagcacacctggccaataaacatgcttccagaatgccaacaatggaaatatggaagttccgaggtgaagctaaatttggaataaatgtgagtttacatttagacatgttgactttgaggaaataagagggcattcaaggaggagctattacaaggataatgacagattctgaatacgaagtataagagggtaaattgagccatacaaatagagaccatagatggagtcatgagatttatgaatggggtctgagggtgtagagcaatgtgagcaaccttctttctttcttcttcttttttttctttttaaacaaggggctcttaaaagtaacagaggtgggtggaccttatttttgtaaacattgaaagtgaaaataatgtcactgaattcaatgacaaaaatgtgtgctttaggatgatttcatgaagtatgactattcttcctccaggcaagtgttttctggcatttccttggtacatatctggcgtgggatttaagggatggatagtggaggtccaagtggagaactgagagaagaaggggaaccagagaagagctgtcaactttcaaaatgttggaagaaggaagaagggagaaaataagcaaaagttcagcaaactgagtacttgtgaaagagattgtggatttatgtttgaggactaaagagaatagaatagaactcaagtgtggctttacaaaatgaatgggttcctctttgatgttttttttttcagagttggaagtaaaggttagaatacctttttaaaattactgtgtatcttggctgggagtggtggctcatgcctgtaatcccagcactttggtaggccgaggcaggcgatcacctgaggtcaggagtttgagaccagcctggccaacgtggcgaaaccccgtctctactaaaaatacaaaaattagctgggtgtggtggcatgtgcctgtaatcctagctacttgggaggctgaggcaggagacttgcttgaacctgggaggcagaggttgcagtgagccgagattgcaccactgcactccagtctgggcaacagagtgagactctgtctcaaaaatcaatcaatcaatcaatcaataaaaataaaacaaaataactacatatctctatatgtggctctgagcagagtctcaggcatgtgagactccaggatttattagggctacaagaagaatgccaatgagaaacttggcaatgcttctttgaacaactaaaatgttatctggtcatatctaagatgtcacaacacagaagcagctttctaatcttttataacttaatttgcatggctctttagagtttataaatgtcttcacatttatatcttattttatctttggaatgacttcctgaattattatcatccataatttataaatggagaaattgaagcttagagaagtaaactagaagcatatcagagtttataattagttccagtcaatttaacatctactgagccttgatctgagtttcaggttgtactagatactggggatgcaaaagttaataaaatgtgcaaccagtcctcaaccattacaccattactttctttgcttttcccaaattctctcccagaggtttgatatccacccttcccttgggttgggccggttcatagtgagatacaatactgagcgtcacctacacaaacaccagcttatagaaagtattggctccagggtactctggaagttccacacctatgatgtagttagcagaattgcaaaagtggttcatgcctgtaatccctatgctttcggaggccaagtcaggaggatcgcttgaggccagaagtttaaggctatagtgagccattagttgtgccactgtactcctgagcgagaccctgtatctaaaaatgaaaaataaaaacaattgcaaaggtaaagaagatcagggaactcttatacaaccacattagaaggcaattcagcaaaatctaataagctaaagatatctttatcttacaatctagcaatttcacttctccgtgtagaaactctcccttaaacatacaaggagatgggtaaatgaatgttcattgaagtatcatgtataacagaaaaataattggaaatgatgtaagtttccatccacctgagaatggataagtaaattgttttgtgatcacacagtgaaatactacggattagttaaaatgaatgaactagaactggaactaaaatatgcataaatctcaaaaaatgtaatactgagtgataaagtagcagaaaatacataaagtatgctactgattacactaagtttaaacacatgaaaatactagatatttctatgtatgataggcattttagaatatccatggtaataataaaaaagtcatattcaagatagttgttatatcctgttgaggaaaaaaagattatcatatagcgtgcagaaggctttagctgattcacttcaaaaaaaagaatctgaagcaaatattacacaagttaatacttgacaaaggtgagtagggagaaaaaaagaggttgttattactttctgtatgttgatgcttgaaatatttcatttaaagatgtatatggctcctagactttggaattcttggcttttgtgattttttttatgtgtgtgtgtgtgcaggattttcttttttttcctcttcccatgttgaaattccatccattctttgataactagcttgtctcaccagcttattgagaatttccatgatggctttgtcagttcacagtgtgttctcactttttttttggatttatttatttatttatttagagatagggtcccgttctgtcacccaggctggagtgcagtggtacaattatagctcactgcagcctcaaactcctgggctcaagtgatcctcctgcctcagcttctcaagtaggcagactacatgcacatactaccatgcctggctaattaaaaattttatttatttattttttttatagaggcagagtcttgctttgttgtccaggctggtcttgaacttctgagctcaagtgatcctcccgccttggcctcccaaagtgctgagactacaggtatgagcaaccatgcccagccttctccttttttaaaaccccttctaagtgtataaacttctcttgtatatatgtttgtatcgctagatttttttgatgttgttggttaaatatatattgtcttgcgttactatttgactttaatatacataaatcttgtttctccaattatattgtaaaaagtcttcagagcagggacaatgtcttcagctttgttcattcttccacagtgcccagcagagcctaaccaaatacttattaaagtaaagtggtatttttaccaataattataactcttcctacaaaacctttacatagaaagtttaaaataataatttgagctacatttgcttttattttcccagagagagaatgctaacgagctgtgaaatgaccaaagatctggcagcagaagggaaaagaaaaaataatgggtttgtatattatacattctggataatcagctcttgaatgattaagtgtggaatacgtcttacggggaaaagcagatttttaatactcattttgtcccggcgcggtgggtcacgcctctaatcccagcactttatgggaggccgagacaggcggatcacgaggtcaggagatcgagaccatcctggctaacacggtgaaaccctgtctctactaaaactacaaaaaaattagccgggcttggtggcgggcgcctatagtcccagctactcaggaggctgaggcaggagaatggcgtgaacccaggaagtggagtttgcagtgagccaagatcgcaccactgcaccccagtctgagcgactgagcgagactccgtctcaaaaaaaacaaaactcattttatgaccatggaattgttgtattgatcatttccagttttcagatgatcctatgccaaacttacacattattttggaaaaacagaattctcttatgatatgtcgtataactatatacaaatgtaccttatgattgttctgccttcacatcaatatttattggactagacctggaaatggtggtctgggagaactaagaaacaaatattattccacctgtggaaccacgaaggagttttgaagaaaaaaaattaccttgagttcaattcactcttggtatatcttgtaaaaagtgcttgcggcttgaagcaaccacttgaaattaaggttgcctgaaacctcagaatgaaagtttagtctagtccagatgaaagctaaagagcacaggaaatagtaagaggtctggactacattgtctctccttggaattgaaagttggtatctaagaagaagacacacttaggaatcagtattgttacttttagcaaaagggacagttgccatggtctaggtcaaaattaccaccatttagtccctggagattttcctcatggacctttgtaatgttttattaaaccaagtcaccatctcctggttctttgggataggcgctacgacacccaacacagagttccctaaattaaactttacctacatctgtatttatgagtgcattttaaactttgcagtatatttcagggagagtatatctctgaaaattattactcccctctagctctatgtcatttgcctggcaaagaaatcaaaaggcataaaaatatcttgcaatttggtgagagattatatagtccttcatgttcaccccatttgtaggtattaatgttgaaacaaaatcctaaagcaacatgaccagagtattattgcagtcatcatgagccttatcattgatctctgcagtttttttcttttctcagataaatagaagcaagaaaaataatggtatatagagaatacatattattaatatattgggttctcaaagttcctaagtctaagtgtttataacctagaattaatttcccatggaaatagtgtaattaattatggttagatgccaaggctaggccacaaaacctcatataatattagtaggtgtggcaggataaattgattgataaaccatattttattttcttgtctactggctcataatgggaaaacgagaagtatttctttatctcttctctctggagggcgggttaagctgtggtgattttctgatgcctaagcccatgaaggcagatgattcaatgatttggaatgggaaggactccaagaaaagggaaatggcctgatgtcaggagaatttaggtctcttgaacctgtctggagagaaccagacaggagtcagtttctataaatggtgaggagctgtgtccactcccaaatagaccaaaatggtatagatgtccaatggggatgtcagccaggatattttgtctcagaagtgagaaaaatactaaattacacaaggatataataagccaagggtgaatgttgtaaactctaggtcaccattaagagaataataaaaatatttataactaacataatatggaaataggaaaagggagaaaggatagttaattaaaaataattaagctaaaggatggcaagaagaggccaggtgtggtggctcacgtctgtcatcccagcactttgggaggccaaggcaggcagatcacctgaggtctggagttcaagacgagcctgaccaacagggagaaaccctgtctctactaaaaatacaaaattagccaggcgtggtggcacacgcctgtaattccagctactcgggaggctgaggcaggagaatcgcttgaacctgggaagcggaggttgcagtgagccaagatggcgcctttgcactccagcctgggcaacaacaagagcaaaactccatctcaaaaaaaaaaaaaaaaaagatggcacaagaaaaaagataaaaaggagcaagtaacaagtggggcaaatagaaaaaaatagtaaaatggtacctgtgaacccaaatatctcattgagtaccttaactattaaaattaaatataaattaattataaatttaaaatattaaataaaaatggcataatattccactaaaagacaaagattgtcatactggttaaaataattgcatatgcttttttacaaaagatacaacagtaaaagaatagaaaaaaaacatgttatgtgaaagctgtaacccaaaactcttatagctatacaataacatacaaagtagagtttaaggaaagaagcattattagaaataaagtgggatattttacaataataaaaatatcaatccatcaggaagatacagtaagtctaattctgtgtacaactaacaatatagttcaaaatatattaattcaaaaattcccaaaactgcagggagaaatagatctacaataacagtaagatcttttcagtaaccaataaaaaagtagacacaaattaataagaaaacacaaaatgtaaacaacatgattaacagaatttacaaaattgatatatattgaatatttcaccaaacaactacagaattcactttcatttcatatgaacatggaatgtttactaaaagtggcaataacttgggccataaagcaagcctcaatgtatttgaaaaaattgacataatacagagtacgttctttgagcagaggggaattaacctaataatattttaaaaactagaaaaatttcaaatatgtgaaaattaagcagtctgcttctaaataatccataggtcaaagaagaaatcacaatgaaaataagaaaatattttaaactaaatcataatgaaagtatgacataaaaaattttaagatgtagctaaaactgtgtattgggggaaatttattatcttaagggctagaatcgatagctttaaacaaaaattacctaggtatttatctcaataagttagaaacaaaatgcaattaaacttgaagaaagcataagaaaagttaagagaaaaaagtaatgaagaaaatgtacagtaggctaggcatggtggctcatgcctgtaattctagctctttggaaggctgagatgggtggatcacttgagcctaggtgtttgagaccagcctgggcaaccaaatgagaccccccatctctagaaaaaatttaaatattagttgggtttcattgtgcatacctccggtcccagctacacagaggctgaggtaaggggatcacttgagcccaggaggttgaggctgcagtgagccatgttcatgccactgcactccagcctgggcctaggtgaaagagtctcaaaaaaaaaaagtacagtagagaaaagtcactgaaagaaaataaaactgataactccctagcaaaactaatgacacatacgatatacaaataaaaaggaggaaggacacatattacctctgtcagacataaaaaaaaaaaagacaccactgtggaccccacaaacattacaaagttgaagagaaaatatttgggacaacttaatatcaataaattagaaaatttagataaaatgggaaatttctagaataactcaatttaccaaaagtgacaccaaaagaaataaaaaaccccaatagtcctgttatgacatgacaaagcatgcatctatgaacaaatttttaaaataaaacagagtaaaatgtttatgaccttgtatttcacaagtatttcttaaatactacacacacacacacacacacacacacacacacacacaaactacacaaatattacacataaatataaaagaaggccaggcacagtggctcacactgtagtaccagcacattgggaggctaaggtagaaggataccttgaagccaggcgtttgagaccagtctgcgcaacaaagcgtgaacctatctcttaaaaaaaaaggaaaaaaagaaaattaataaattagacttatgcaaataaaagttttgctcttcataagtaactattatgaaaaagaaactgcaaaccacagactggaagaaaatatgtgtaaaataaacacctgatgataggcttgtgttaagaataataaagaattcttacaactcaataagaacgcaaattaactcaatttataaaatgggcaaaagattttaacagacatttcatgagtgtcaataagcatatgaaagcatgctcaatgttgttaatcactgggaaaatgcaaattaaaatcataatgagataccattagatatgcactagaatggctaacattgacaagactgacaatgccgagtgctaactaagatgtggagcaactgggacactcacatactggtgatgggaatgtaaatagcatagtcaccttgggaaaatttgacagtttcttaagttaaatataaacttataagacccagcaatcctaatcctagatacctacttaagaaaaatgaaacatatgtatatacaaatacatgtcttgaatgtccattgcagctttattcataatgactaaaaactaggaacaacaaaatgtccatcaaaagatgaactgataaacaagttgagatatatccataaaacagaatactattcaccaataaaaagtaattaactgggccggacatggtggctcaggcctgtaatcccagcactttgggacgccgaggcaggcagatcacttgaggccaggagtttgagaccagcctggccaacatggtgaaaccccatctctactaaaaatacaaaaattaatggctgtagggacaggcacttgtaatcccagctactcaggaggctgaggcacaagaatcacttgaatctggaaggcagaggttgcagtgagctgagatcgcaccactccactccagcctggacaaagagcgagactgtctgaaaaaaaaagtaaaagtaattaactacttgctgaaatgacatggatgggatttcaaaattatgctcattgaaagaagccagacacaaaataccactaactgaatgattcaatttatataaaattgtagaaaagaccaagttatagtgacagaacacatatcagtgttgccagttgtcagggaggtggaagaagagaagtaacttcaaaaaacacatgggagctttttgggataatggaaatattctgtataatgattatgatgatggttaccttgtaaaatacacttataaaattaatgcaattgtattctttaaataggtgaatttcattgtatgaaaattatatcccaataaagctaacaaaaaaaaagtaggtcaaagacttgaacaggtgcttcataaaagagaacatccaaatgaccaataagcatatgaaaaagcataaattaaaagtagaatgagataccattatgctcctatcattatgtctaaaatcaaaaagatggaaaataccaaggattgctgaggacattggcacaactggaactctcctatgctgctcacagggatgtaaattggtattaccactttggaaaattgtttggcaatgtctaggaaagctgaatacgtgcataaactatgactgggtaattctagttctgtttgtagtcaaaatttgggaaccagtagaaaggataaataaatggttgtaaatctgtgcaatgcaatactacacagcgatgagaatgaatgaattactgctacatatgacatggaaggagcatataaacataatactgagtgaaagaaaccatacacaaaagggtacatttatttaaagttagaaagcagggcctggcgcagtggctcacgcctgtaataccagcactttgggaggccgaggtgggcagatcatgaggtcaagagatcgagaccatcctggccaacatggagaaaccctgtctctactaaaaatacaaaaattagctgggcgtggtggcacgtgcctgtagtcccagctactcaggaggctaaggcaggagaatagcttgaacccaagaggcagaggttgcagtgagctgagatcgcaccacttcactccagcctggtgacagagtgagactccatctcaaaaaacaaaacaagacaaaacaaaaaaaacaaaaaacagaagacattaagttatggtaatagatgtcaagattgtggttacctgacagaaggtaataactgggtgagagcataaggggccttctagagtgccagtactcctccttgatcttcatagtagttacatgggagttcactttgtgaaaattcattaggattctatccttatgatttgtgccactttctttatgtatgttatattcaataacatttctatttaaaagttccaatcacaccaatacctatataacaatcataactcagagcataatctataaccaagtaaatcctactcatctgactttgcctgacctaataatataaatgaaaatccaaacattcaagacagaaaattacttgtagcacaaaagcacctttcactttataacgcaacacatcaaatgcatgaaaggaacgaggatgacatcacaacagatccatttttcaattgtgtagatgtattcgaaggaaagaaataacgtgcttgctgtgaatacgttcactttaaacattatgtctgttagtaaaacactaaaatcagcccaaatatccaaccactggatcaagatttaatgaattatgatatactaatacaagataataacatacattaaaaatgacgaatagaacaccttgtagaaacactaaacatttttgcaggtgtaatgtcacataaaaaaatctaaatgtaagaggatgtgtacatcatgagtctatctatgcaaaagtggaccaataggtaaaatgaacaaagacaaactgctgtgttggagtggcagatttatggatttttgtcggggaagaggaggtacccttatggaaatagtctttgttattatttgggtcagttgactttttttgttgtaagcaacagaaactaacttaaatgaaaaagagatttcctttcaagccgtataggagtagcttacagaatcaaaggcattgctgaatgaccaagaggaacaggaaccgggaaggtgacagaaatcttagaaacaaaagttctttaaccaactctctaggattctgcctccttgtgattagctttaaataccttttgttggctgggcgtggtggctcatgcctgtaatcccagcactttgggaggccaaggagtgggtcactcgaggtcaggagccaggccaacatggcgaaaacctgtctctactaaaaatacaaaaattagtcgggcatggtggcgtgtgcctgtactcctagctactcgggaggccaaggtatgagaattgtttgaacctgggaggcggaggttgcagtgagccaagatcgtgccactgcactccagcctgggtgacagagcaagaccttgtctcaaaaaaaaaaaaaataataataataaaaataccttctcttcccatgtgcctccactcaagattcaaattaataagagagaaaatctgattgttccagtctgagtcacatatccaccttgtcccttgattggtaaccatatcagaaccacctggagttgaggaaaggtacttccctaaaacagagggatagtgctgtgaccagaagaacagggagcagaaggatgctaggtggaccaaaacaacaattccatgaaattttatgccatcttttccataaatagaatattactagtttttcttatattaaatgaagatatacttattgaagatactttgcaaaatttagaaaagtataaagtaaaagaataatgaagagaaaaatcatcttttatcactatctgcaaccctgtattatctattgctgcataataagttaccctcaaaactagggtgaccaaagacggaaagtagattagtgaggggggacaaaggactgagtggttatagcaaaagagtatgggatttcgttttaaagttctaaaactggattgtgatggttgcacaaatctgtgaatgtagtaaagccattgaaattttaatgggtgaatgttatgagacgtgaattatgtatatcaatacagctgtatttttaaaaatactaaggtgactaactatcccagtttgcctaggatgtccctggtttcagtattgaaaatcctacatcccagtaaacccctcagttctggtaaaaactagatagttggccaggcatggtggctcacgcctgtaatcccagcactttgggaggccgaggtaggcggatcacgaggtcaggagttcaagaccagcctggccaacatggtgaaaccccatctctactaaaaatacaaaaattagctgggcgtgatggcaggcgcctgtaatcccagctactcagggggctgaggcaggagaattgcttgaacacaagaggcggaggttgttgggagccaagattgtgctattgcactctagcctgggcaacaagagtgaaattccatctcaaaaaaaaaaaaaaaaaaaaaaaaagctggacagttgatcaccttactcaaaatgtaacaacttaaaacagtaagcatttgttatctcagtttctctagattagaaatccagaaggagcttaactggatgtttctggctcaaggtctctcatgaagttgcagtcaacacattagctggggctgcagccatctgaagcttgacctgggctggggacctgcttccaagctcactcatgtgatgctgacaagaggccacaatgtcttgctatgtgagtctctcattgtgtgccctcataatgtggcaactggctttccccataagcaagtgatagagacagagaaaggaaagagaatttgccttatgtaataatatctcataaatggaaagggagaaaaactaaggactcagatagatgttctagtgtcttttaaaatttttgtaagtttattttatttatttattttttggagaccgggtcttgctctgttacgcaggctggagggcagagacgagaaaaggggtcccagaacctctggggctcaagcgatcctcccacctcagcctcctgagtagctgagctggaactagagaggtgtgtgccaacacttctggctttttttttttttttttttttttggtagaggcaagggtctcactatgttgctcagaactcctggcctcaggcagtcctcctgccttggccccctaaagtgttgggattacaggcatgacccaccatccaccatgccctgctcatgtcttttaaaacctaatcttgccatcactcctgtcatattttactggtcacacacttcacctctggtacaatttgaacgggaactacacaagggtcttcatgctaatgtgtgaatataaggaaaccagatcattgagcattcctggaacctcacttctacaaactgtaatcctaacttttttttttttttttttttgagatggagtctcactctgttgcccaggctggagtgcagtggcatgatcttggctcactgcaacctctgcctcccaggttcaagtgattcccctgcctcagcctcctgagtaactgggattacaggcatgtgccaccacgcctggctaatttttgtattttttggtagagctggggtttcaccatgttggtcaggctggtcttgaactcctgacctcaggtgactcgcctgcctcagcctcccaaagtgctgggattacaggcatgagccactttgcccagtctccattttactgatttttaaattaaaacatcctcattatagaatgcatggacaattcaagagtataatagagacgcatgttacaatgaacacctttgaacataaattttactcctatctctgattagatttctagttgtgcaattattagggcacatggcttacacatcttgagacttgttccatattgccaaaatgcttttctgatacttgcagtgtatcagatgcccattttgccatacccttgctagcctccagtattatttttagtaactctgccaatttctaggtgaaaaactgtacccccttgttttagagtgctttttaataggaaagtggaacattttctcataggtttagtggacaccactaataaataagcatttaacagattgtaaatcctttccatatatatatatatatgtatatacgtatttatttaacatttattgagtgcctattgtaagaacaggaagtatccctgctgccaaaatactcacagtcaagtgagtgagactgaccaaaaaaaaaaaaaaaagttcaatatattctaatctgaggaaacatttaaaaagcaaagtaaagaaacagtttggttgctaattgagactttaagtacttttcctgcactggaacatcaagtagagaggtggggaatgatggagtattaagagaataagactagctaagtgagatcagatctcattggcctgtccagctctgttaagaaacttaggtctaatccctgaaggcaatgggaaagcaaggaagagttttaaacacccacaagtgaaatgatcagatttgtgcttttgaaatctccttctgctgaactgtggaggaaaagcggaagagtggtactaatggaaataggacagccagataggaaactgaagctgtagttcaggaaagagacaaggatggcctgacctagtggaacagagagaaggatgttgagaaatgttttaggtttaaatggcagccctcatcccagcctaagcctctggaaaaataaagcaataaaacaaatgattggaagacaggctctaaaacatttattgctgaaaaaaaagctaaggtataggtcttagcttagtgtgagagccaaatgagatgctaaataaaccccttgattagggtatgtgcctctgatgtgaatgttgtggtgtgccacctagatttgttttcccaaatatacaatttattccccctgctgggagtgctgcttgcagacacgtccatcaactagtagtcatctttagggatggccttgtctaaagagagccactagcccaaagtcatgctccctgcctgaggtggtccatgtgtaatgactgatccaagtagaaaatgtaaagtcttgatcccaatttgagacaatttcgaaaggccatcccagctttggtgctccccaaagtccagctgaggtctgcattgagactgaatctcagctcaacttctccctttgcccaatcttgctcccttcccttcttttcctgtttctaccctttccgttctacccttctcttctcattctttccccttccttctcctttcctttccttaggatccacaaggaaacacctgtcccttgggaaaaagcgtcgatcccaagagcattccccaataaaacctcctacacactaatttccgtttcagaatctacttcccagggaatccaacctgtgatgccccttgagaaaaactatacctggaggattagaatgtgtgtcccctgtggccagcagccacgaggaggaagggtggcagaaactagcatgcccagtttgtcctttccaaatttacaaatcataggtcattccaccttccctgagatagaatggttaagtatgtggacatatgccaggatttacaccacctgtgtttcttcaataaagtgggaaacattgagataatatccagtgatattaaggagctagattcactaggaataaatgtattagatatagttgaggaaaaatagcgccagtcaagaattaccgatgggtcttaggtaactgagtaggtggtagtgtcgtttaccgagattaaaaaaacaagcctggagggatctatgagtttcatttgaaatgcctttgggatgtcaaagcaacttgttcactaggcaattaaagatataaatctggagtccaggaacatgacctagagaactgatatgaatgtatatacatacctatcagcatacacccagtaatgactggtatcccgcaaggccgacagatataacttagggaacagaagtcagttaaaaaaaaaaaaaagaccaacagactctaattagtattttcagagatttgaggggtattacctaactaaaacaagacaaaagatgctatgaaaagaattatcagaaatacaaggaaatcttgggaatgagaatatgattggcaaagttaaaatttcactggaaggattagaaaacagagttgaggctgggcacagtggctcacgcctgtaatcccagcactttgggaggccgagatgggtggatcacctgaggtcaggagtttgtgaccagcctgaccaatgtggtgaaatcccgtctctactaaaaatacaaaaattagccgggcgtggtggcgtgtgcctgtattcccagctactcaggagggtgagacaggagaattgcttggacccgggaggcagaggttgcagtgagccaggatcatgccactgcactgtagcctgggcgacagagcgagactccatctcaaaaaaaaaaaaaaaaaaaaaaaaaaaagaaagaaaaaggaaaacaaaatagagttgagaaaatattccagaaagatgaatatgaataaaaaggagacagtcgtggggatgaaaaaaatccaatggtcaactaatagtatctttaatatagatccttttctggttccttttttgttcattaattcttggatgagtttctgggcagtttttagtaagaagtgtgtaggaagagaggccaggggttttgtgttaggctgaaggaaaggacccagcagagggaagaaatgaatggcgaggtaaagaagggaataacggatggaggacccttcctgagaagactaaaggggggtgtatccaaaacttgggtgcaggcactcaccttaaatgggaggacaccctttctttgtgcaggatggaaaaaaatacgtgcagatgcagagaaccttctaggtggcatgattggaaatggagttttccaatggcttctattttgtctatgaagtacggacactgtctatagtgggtgaatgtgatcgttggggtggcatatgagcatggaactttagggagtatgaagatttttaaaaatagcctaaatgaagggtgaaaggggggagaaaagctgcttagggaaataagaaatgattgcctgactactctgagggcccaggtgagctggaggcacgtagcagtgaatggttgagagtagattttgataatcagagccaaagtgaggactcactacaatagaggagacaaactagtttcagaaagaaaaggcatctaggctcttttcagaagaggcttgtataagtgaaaaatagaaaaacatccttctatgagtcatcattctcattttcatcagctccctgggcctgcttattttcctttgatgtttacaaagggacatgtgattacataagggaagggtaaagggtataataaaccagggttgtaagagaaggaccaacagaaggaagagacttgaaacccagctgggagcagacaggggaaagggcttccttgaattgtcttcatggttttgtgagaggtgtgtgaaccagagcaactccatcttgaataggagctgggtaaaatgaggctgagacctactgggctgcattcccagacggttaaggcattctaagtcacaggataagacagaaggtcggcacaagatacaggtcataaagacctttctgataaaacagttgcagtaaagaagccggctaaaactcaccaaaaccaaaatggcgtcaagagtgacctctggttgtccttactactacactcccactagcgtcatgacagtttacaaatgccatggcaatgtctggaagttaccttgtatggtctaaaaaggggaggcatgaataattcatcccttgtttagcataatacgccccttgtttagcatatcataaaaatgggcaaccagcggccctcagggctgctctgtccatggagtagccattcttttattcctctactttcttaataaatttgcttttgctctgcactgtggacttgccctgaattctctcttgcgcaagatccaagaaccctctcttggggtctggatcaggaccgctttcctgtaacagtccccaggcacagaaactctgagggaatcagacacttagttgtctttattgctccctcttcagtatatagaacagagcctggcacacctaggtgcaaaataaatatttcttgcatgaaagaagtccacagtgcagtcactggcttttttagatggttagctcactagaatttcattttttttttctcctcctcctttacaaaaagttttcagacagactttgggcctgctggggcattttcaaaagacaaatagtcctgctgctgctccagaggacccaccgcccacctcccagtcagaactatgtctctctgttcttgttggaaagggggacacagcttgctttgcaagaaacttgcataggaaatggtgcaatctgggctgtttttcatcttctttcaacctaatttcctaagttaaaagaaagagaaatttaaggaatcttaggaatatgaaacttctctggaatgatctttactgagctgtgtttggaatcagctgaaatcctgaaggactgtcaagccagccaagaataaaagaaaataaaaaataacttaaacaatcctagccaaaatctgaaaatgatatctagagcagctgctatttttttctttcccagaatggtttgcctttcccccagtttgtaattgttataggattgttttaggttattttggagtagaaaagaagaaagaaggaaggaatcgagtgttttggaagtagtatgatgcggttagttctaccttttaagctttataatttacacagctgttgtacacatgtgaactccctctcattaggatgctgctgactggtacaggaagtttttattcatggcattctccttaggagtttgtttatggcatttaggtcctctcctgccttccctccccacccccaccccaaatcaatctatatttgtaatttatggatgatctctccagggcttaatctgtggggtaaaaggctgtcttatctgctctacatttactgaaaaagggtgcaagaaaaaccgtatctagctggccagatgggtagggaacacttggttgcactaaaaattttccagcaatggtatccccagcttgcccttttgcccgaatagtgcacaaagtcagcaagcatttcccctgaagtgtccacctccacacggccaagactggcttggctggttaccagaggcactgagaagattgaggaggcagcttatagaatactttgcttgcatcctcgttctcatcccattgtgaggtaactgccccacaactgagctagataagagaaaggaactgaaactgatttgcccaaggtcagtctgggtggatattgagcctagaataaagcacagaatagctgcacctggggctggcccagggcatgctcagatgaatcactggcttcaccagaaatgcagctagtctggaatgcagtgcaggggcccagatgcctgacactgaacagtaacttagaaaggggaaggtcttttcctacacatagtgaagcttcaaggaatctttaagaaaatcacataagaaagatgaataaaaactttttcttcctcctactccttcaacccctatttcaggttcttccttagagcaaacactgatttcaagttggagtgtgtcttttcatctttttagttatttatatatctttattgatctatctgtgtacatacatctgcatctacatatgtgtgtatatgtatctatctatctatctatctatctatctatctatctatctatgtatctatctatctatctatatctatacacagacagagagagagccagtgagggaattttgctttgttttgttttgactgaaatggtatcacacagtggattgttcttcaactttgcttttttttttttttttaagtttagccatatctctcagagatttttctgtgtcagtacattttagtttttttcaactgctgcatgctctcacataagtcagatgcatcactaagtgtcagtctttcgatgatcatttaggttgctatgctatcagtttttaccactataaatagtactatagtgaaacaaccttgtacctgcttcctttttgcacatatgcaagtatctctctacagtggataccaaggtgtgagattgctgggtcaaatgataggcgcatccaaagtgtgaaggattgctgccaatgtgtactccaaaaaggttggccagtttatattcccaggaatacggtaagagaatgtctgtttttccagatgcttcccaacacatcagtctttcttatttattgtcaatccaatgtataaaaaatagcatcctcttctttttgtttccccccaaaaccagtaagactgagcatcttttcagatgctcgtttgccattcatgttccttctttgtgaattgcttatttatgttctttgcccatttttcaattttgtcttttttctggggacatataaaggcaagtcctttgctacatacattacaatactttcacccagtctctcctttggatttgaatctcattttgttgaacagatgtaaagttttgatatagtaaaatttattaatcctcttctttatgactttggtattttttgtattgtttcaggaggccttttctacccatggtcataaacatggtctcactgcaattctgggaaatacaaaatttttaaatgaagtatttttatggtggtccaaccccccatcatctgtttgtctgaattactgcaatagcctcttaactagtctccctgcttccttcatcgcttccttatagtctgttctcaacacaacagccagggtgattcttacaaaacagtcaaatcatgccatttctctgaatcaaatcctccaatagcttttcatgtcacttcaagccaaagttatgacaacggtgccacatgcatcctctgcacaccatgacctttttcacctcattacctactactcttttccagttcttgacacatactaagttctcaataaatattggtagaattcataaataaattttatccccattcatttcgggtaaaaagtattgaaaatgttggcattgatatggggaagctcccatacactgctggtagcagtgtaaatttgtacaaacctttacaatttataaatacttgaggatgagcagatccttcccctaggcaatgctccttctaagtatacactctagagaggttattttatgtgtgcataaagagactgtaggaaaatacttattatagccttgcttttaatggtagatgggaggaaggaaacaaagaatgaatgaatgaagaaatggtcagaggacaatttatcctaataaaatatatacaaaatttactaactcatgaatgaatgtttacttttgtagaatgtcttttttaaaaaattccatagagggttttttttgtgtgtttttctgtatgtaggcaatattatgaacaaatatatagatattttctgatgtcaaaacattcttatattcttggggtaaattctatttggttatgaggtatttttattttttaaaatacattcttgaatttaattgactaggattttatttagaatttatcttttcctaaggtttctaattagagatatagggtcttttatttttttctttctttctttctttctttttttttttttttaagtgaaagcagtttgttaagaaagtaaggaataaaaggatggctactccagccgggcgtggtggctcacacctgtaatcccaacacttcccaacactttgggaggccgaagcaggcggatcacgaggtcaggagatcgagaccatcctggccaacattgtgaaactctgtctctactaaaaatgcaaaaattagctgggtgtggtggcacatgcctgtaatcccagctactcgggaggctgaggcagaagaatcacttgaaccagggagtcacaggttgcagtgagccgagatcacaccactgcactccagcctggtgacagagtgagactgcgtctcaaaaaaataaaaataaaaataaaaaataaaataaaatggaatggttactccatagacagagcagcctataggatcttttcaattcagtttataagtgagtttggtatgtaatatttttactgccatttgttttgggtgttagggctaccctagaatcatagagtgaattggatagtacctcctttctttccaattttacaaagtagttcctgtatgatagctactatttcttaattgaaagcttgataaaactcatttgtaaaaaaacatttgaggccaggctcggtggctcacgcctataatcccagcactttgggaggccaacgcaggcagatcacccgaggtcgggagttcgagaccagcctgaccaacatggagaaaccccgtctctacgaaaaatacaaaattagccaggagtggtggtgcatgcctgtaatcccagctacttgggaggctgaggcaggagaatcgcttgaacctggcaggtggaggttgcagtgaaccgagatcgggccattgcactccagcctgggcaacaagagtaaaactccatctgaaaaaaaaaacaaaaacacttgggcctgatatttattgataagtaataattttgattgattgttgtttgatctattactgatttttttaaatctattcaggctccctatttcttcttgagtttattttgataatttgtatttgtttaaaaacatttctactaaatccatgtatacaagtttattagcatgaggttgaaaaataacattttctttctttctttctttctttttttccgagatggagtcttgctctgtcgcccaggctggagtgcagtggcgcgatctcggctcactgcaacatccacctcccagattcaagcaattctcctgtctcagtctcctgagtagcttggattacagatgcttgccaccacaaccatctaatttttgtatttttagtagatacgaggtttcaccatgttggccaggctgatctcgaactggctggtctcaaactcctgaccgtgtgatttacctgcttcggcctcccaaagtggtgagattacaggtgtgagccaccgtgcccagcaatattttctgaagaattaaaaagcttgtatttgtagccaggcacggtggctcatgcctgtaaaacccagaactttgggaggctgaggtgggtagattgcttgagcccaggagtttgagaccagcttgggcaacatggcaaaacctcctctctacaaaaaatacaaaaattagccggatgtgctggcacatacctgtagtcccagctactcaggaagctgagctgaggaggatcgcctgagcctggaaggttgaggctgcagtgagcctagatgatggcactgcactctaacctagaagacagagtgagaccctgtctcaaaaaaaaaaaaaaaaaaagttgtatttataaattttacttgaattgtttatattaccttttctttcctaatatttttgtgccttctcttgtctttttgatcagccttaatagaagtgtgtcaatttaattagttttttcaaagtacagtggtcccttggtatttgtgggggattggttccaggacacacttgcataccaaaatccaaggatgctcaagtccttgatgtaaaatgccatactatttgcatatagcctgcacaattctcctgtatgcttcaaattttctctaggttacataaaatacctaatatgatataaatgctatgtaaatagttgttatgctatattgtttttatttgcatatttattgttgtattgttattttttatttttcagaatattttctgtctacaattggttgaatctgtggatgtggaaactgcagatacagatggagagccgactatactagctttttgtttcatttttcacttctggtgtgtgtgtgtgtgtgtgtgtgtgtgtgtgtgtgtgtgtatctgtgtgtgtgttttattaatctctgtgcctgcatgttagtttcttcctctttatttggattttcactaacattcttttcagcttcttcagttggatacttgttgccaatatattttttttcattctaagaattaaataaatgggccaggcgtggtggctcatgcctgtaatcccagcactttgggaggccaagatgggtggatcacaaggtcaggtgtttgagaccagcttggccaaagctggtgaaactccatctctactaaaaatacaaaaattagctgggcatggtggtgcgcgtctataatcccagctactcaggaagctgaggcaggagaatcacttgcacccaagaagtggaggttgcagtgagccaagattgcgccattgcaccccagcctgggcaacacagcgagactccatctgaaaaaaaaaaaaaagaataaatgaatgtattaatcaccaaactgctcttcatcagaaactcttagcagtggtatgttgaggtctccctgcctaccgtatatgtctcttaactctgcgggtgcaatattttgtcatgggtcagtttagcaatattgtactatttcccaattttctaagtgtgttcatttcagagtttatcctattcattgttctttctttcttttaaaaatttctatgactgagctggacatggtagctcacacctgtaatcctagcactttgggaggctgaggagagtggatcacctgaggtcaggagttccaaaccagcctggccaacatagtgaaaccctgtgtctactaaaaatacaaaaaattagctggccatggtggcaggcgcctgtaatcccggctactagggaggctgaggcaggagaatctcttgaatccatgaggcggaggttgcggtgagccaagatcatgccattgcactccagcctgggcaccaagagtgaaactctgtctcaaaacaaaaaaaaacttttctatgactgtatttttaattctcaggattttaatttgttattcttcataatcatagctattttatttctgacggttcgtgcttcataatttttatgaatgttattcctctgcttaattcctttgaaagtcttgaacaaattctttttaaagaagtaattttcagatactctagtattttgtttttacctggtgtgaatgcttctccatgttgtggtttctatttttggcagtctttcttatttctctccctctctccttttctctgttccttcttctcttccttcattccttccttcctgtccccctaggcttaaccttcctggtctcatagttttgccgttacctactttctgggcctcccaggcctagacctcggttttatcctatagtattgtagatccagttccttctctagggtcaaattccgtctttaagactatgcctggttcttccatgtccctaggtatacagatgtttacaagcctgtagccctaggcaattcctttcaagggggtagccttatcccagcccttgatttcatgtgagtcttctgcctcacatgggttatttagttcttagtaccctgtatgagtcttgcccctggatgcctctgtttgctgttggcagaattgagctggtctacatcttcaggctacttaccatattgtttctgttccatttctgggctatggagatgtttttaagtgtgaaaatgccttacatttttcccattttatattaaatctattatcactatcattttggattggcgtggtcctcaaagccccatcttgactagaaatcaactagcatttgcttctctgcagttcgtaatctagcttcctctctcacctttctcttggcaattgccctctctgaagtcactgctgttgtttccgagtcactgaatgaaaccgtttttccttcagcccccattttccttcactcctctgcagcatccagcagtgttgactgctcttccttttacctctctcctgttggctgttaggatgctctgctgtcccggatcactacctcttctgatgcttccagtttttaaactgctttcactttttcttccccttttgtaactgtggatgtcccacaaggccaagtccttggtgctctggttttaccctctatttcagctaattttgcttattctcatctttggtcattgctaagtccctatctgttcaccagggcttccccctcccctgagttctaagctacagatctgcttgtgacacgttccacttgatgccctgctgttccatcaaatttcctcccctttaatcctcccaaatgccattacagatatcattattcttagatggagtcttgctccgttgcccaggctggagtatagtggtgtgatctcggctcactgcaaccttcacctcctgtgttcaagtgattctcctgcttcagcctcctgagtagctgggattacaggcatgcaccaccacaccagagtaatttttgtattttttgtggagatggggtttcaccatgttggccaggctggtctcaaactcctgacctcaagtgatcctcccacctcagcctcccaaagtgctgtgattacagaagtgagccaccatgcccagcctgttatagatatcatctttcccttagtttctaaggctcagaatcatacccttccttgattcctcatattttctccagagtcagttaattatacatcctatccatcctctttcctgtcatttcctctttttgccattgcacggctcacacacctgctatggtcccttgttatttcttcttttggaccattttggtattcttccagagaagcaggacagttaaatgtggcaatatttggactcatttgtgttcaaaatttgtgatatggattcttcccacatcccctgccccaataacaaaacttaccttataaatattcacagctttctttgctgccctctctctgacaccaaggaggaagaattctctgatgaatgagcaaagtttaaagactttgtgtttatgtgttctgggtaatggatttactttagaagagcaagaaactgttcaaaagaaaagaatttaattgagctgaaacctaaaggatgagtagggactctcaggacaacccagggaaggatggagttgtattccagatagaggggtggtatggtttggaactgtgtccccaccaaatctcatgtcgaattgtaatccccagtgttggcggtggagcctggcaggaagtgacaagatcatggggacgtatttctcatgaatggtttagcactatcgtgttggtgctgttcttatgatagtgagttcttgcaagatctggttgtttcaaagtacgtggcacttccccccttcgctctctctcttgccgtcactctagtcatgtgagatgtgtgcttctccttcaccttccaccatgactgtaagtttcctgaggcctccccagaaaccaagaagatgacagcatcatgcttcctgtatagcacaaagaactgcgagctagttaaacctcttttctttttaaattaccctgtctcaggtatttatagcaatgtgagaatggactaatacaagggggaagcacaagcaaagacagaaggaaaatacaacagggtgtctgtgagtgtgtgtgcacatttgtgtgtgcatgtggcggggtctacaaagagtcactgtgaaccagggagtggggagtgctgagaatggacagaaaagattcatgtgcccagttgagaaatataatttgaggagtcacagaagtattgttaagtgagagttgagatcgcatggccacgttcgtcgccaggtttctaactttggatggcatctttcaccacgcaggactcaatggggaggaagcaggggtatgggttgaggattctgatgagactgtcactactactctttcttgcttcattagtgttgtttgtgacacccagaagagctgaagggggcatctttgtggggaaggagtagaagggtagccctcagaaagggggttcctgggatagtcagaatgtgtttaccaggaagagaggcagaattaaggggctggcaacatagctgggaagttgactgcatgggttgtcatatctaaaagagatttcaaagatggaaacaggagcatgggcgaagttgagatctcagccccctcattttactgttcccctacttgtgaaattcattttagttcttcagggcccatctgaaatgccagcttctctctgaaggttttcctttagaccttggctggaagatatctctttctctttggaaactctataacttgtggtttgcaagtattttatggctttgtattcccccttatgtgtaagatccttgaagattgttttgcatatctttgtatctcctccaccacctgagactctctgctgtgtgtaggatctctgctgaagaaatcataatggaactgaatctgtactttcacaggaaaagtacatgctacaggatttaataaatatgaatcttacataaggaaatagctcaaggaatttgaatatttcaaagctctatccatataaagcctgaataattcatgcaaatatttgaagaaaagaacaaaagcttatctaatatttcagtacactgctctttattttggtccataaaaggagatcttgtgcttagttttggtggtaaactcagctttagcagctttgaaatgcagattagatcaattacatcacaattatatttgaaaattgaaaaacagcattatccaaaagtcaaattccaaatttatgccttttcaaaggaagtgtcatttggaaagaaactgattcacaccatgaaatatgtggcatttcttttggtttccagtctcttctatagtagtagaaggctcatgtgatatgcagacatgtgcttaatcaaatttagctttccttttcaagttaagaaaatgtatatgaagtatttctgagataaaaagaggcacagtctttttttttttttttttagcacaaacatctcctatgctgctgcatttgtcttaattccttatttgaaaatttggctttgtttatgtaatgtacaaattcctattcacttaaaacaggaccagaatagcctggaaccctatagagctaaatgatattttagagtgctgatcctcattttctcttcggtaaagaacacaacacgattatttgtatttatcttgtcgtacacacactcaggattactcactgaggaatggggctcaagtttggttgcaagacttccatttactaggctgtgtgatgttgagcaagtcacttaatctctgaggtaaaatgaggggcctgttgcctaaaattccgtgcttctgtaatttaagtataattgacccagatgtttgatgattactttgaaaattgaaaaaagatgctagtggccataagaaatttgtaccactgtgccccgagtagtgcttctgaaatagtaacacagggagaaggttgggaggccccttctttgtcatttacatagggtttgtttgtctgaagtagcagatgccaagtgttaggggtccaaagatgctaccagaattagaggagatggagaaaaggctaacggaattttcttaattcgaaaaaaaaaaaaaaggccaggcgcggtggcttacgcctgtaatcccagcactctggaaggctgaggcgggaggatcacctgaagtcagaagttcaagaccagcctggccatggtgaaaccccgtctctactaaaaatgcataaaattagccgggcatggtggtgcgcgcctgtaatcccagctactggggaggctgaggcaggagaatcgcttgaacctgggaggtggaggttgcagtgagccgagatggctccattgcactccagcctcggcaacaagagggaaactccatctcaaaaaaaacaaaaaacaacaacaataaaaaacccaaagcaaaacagaaatgagtttctaattgtattgcaaattacttgcaggactgaaaatgattgaactgtcacacatttctacattaataagcactatccaaaagaatcagttacaacagagtaatttaccaagattaatctttaaaaagaatctcatttttaagagctcattttcagggttgtagatatatatatatatatatatatatatatatatttttttttttttttaaacgaggtttcgctcttgttgttcaggctggagtgcaatggtgcgaactcggctcaccgcaacctctgcttcccgggttcaagcgattatcctgcctcagcctccgaagtagctgggattacaggcacacaccacattgcccggctaattttgtatttttagtagatggggtttctccatgttggtcaggctggtctcacactcccgacctcaggtgatctgctcgccttggcctcccaaagtgccgagattacaggcttcagccaccggcgcctggctggttatagctttttaaaacaatttgcttattgtttcttagtttgtagaaagtttctcttggagatttgtgaaggaaatacatgtgatcgcttttgtgatgtgttcagatggaaagaaaatctaactttcataagaaaaattgtatcacactagatgcaggaaaaaaatagatattcgaagaaccacataccagatgcagatgaaatgtaatgtataaagactatttttataatgattttttaaatttagatttttacaatatggattttaaaattttatttcacttttaattgactaattttatacatttataaggtacaatatgttgtttcaatacatgtatacattgcaaaatgatcaaatcaggctaattaacatatctatcaccttacattcttattatttctttgtagtgagaatatctaaaattgaaatacagtcctttttattgtaactgagagaaacaagagcaatgtatatgtggtagaatttaaaagtcatatgtgtatatttatatatgtacatctacgtacaattgcctgtgtacatataattatctgctatatattatgcatatgtaatacatatgcacctgtgtaagttggaattcttatctattctatagaaagaaaagttctacattgaaatatagccaacatccagttaactctgaaaaaaaatcacatcattgcttggctttttctgttgttacttcctgttggcctagtggcaatgattcattataatgcaatgtaattcaatatcacatggtgaatttaaatggctgtataggaaatctgtaacactgttcttgcttaaaaatgtaaaacttcaatagaaggcggttcatcagagaatttggtaacaccaaatagtaaacgctttgatttcagtaatactaagaccctgatagaattaaaatgtgactgaattttacttcttagtaattattttatagctaatatgtaaaaaaaaaaaaaccacccttttcatcagttcattgtctttctgaaagtaggctgcttccattatatgtactgaaatatattttcctaaatgttaggcttatttgatacaagcactcattttattttatttatttatttatttatttatttatttgagacagagtttcgctcttgttgcccaggctgtagtgcagtggagatcactgcaacctctgcctccagggtgcaagtgattctcctgcctcaggctcccgaggagctgagattacaggcgtccgcaaccaggcccggctaattttttgtatttttagtagagatggggtttcaccatgttggccaagctggtcttgaactcctgacctcaggtgatccacccgccttggcctcccaaagtgctaggattacaggcggcagccaccacacctggcctgcactcattttaaagttggaaaaacagaggccccagtgattagctttaggacggaaaccagtaaatagaaataaaaacacacaaaaatatatacatatatatacctacacacatctatacctacaaatgtttatatatgtatatacacacatatacacacacctgtataatatacacatattatatatattatttatttatttaagtttttattctttgtttttttgagacagagtctcactttgttgcccaggctggagtgccatggcgtgaccatagctcaatgcagcctcgacctcccaaacacaagcaaacctgcctcagcctctcaagtagttgcgactacaggcatgcaccaccacacctggctaatttttgttttattctttgtacacatggggatcttgatatgttacctaggttggtcttgaactcctggcctcaagtgactttcccacctcagtatcccaaagtgctgagattacaggtgtgagccactgtgcccagccaaaaccaaacatttttgagttaaaagcccctaataaggatggcagaattagataaacaaataggttcaataaagaagatcttgacaaagttttaatctactaatttaacgataatggaaattagtggaattcgagagtgaagaaatttctgcatttataaaagaatgaatagaattttggcagagaagccactttgtttttgaaacgagttaagaatcaaggaataaattaggatgatggcaattacctggttaatgatatccaatatatgtaaattatctttgctgtgggtaggaaatttgtttattttccatgagcacttcaagaaccccattaacaaattgagttacatcttttgactcaactttcattatctgaatagtcctgctgggacaggtaatattctccatttggggctacaaatgtttgcattagaaatcaatctatttgtaaatgttgtattcaattttacatgatcttgatcttattttgtttaaatttgttgtttttttcaatgacaagttgatgcttccataatacatttaaaaacataacatacaatcctgtagttctgactgaactttcgtcaggtttcagcactgtaaaccaagaaacatcaacagatgaaaagttctcctcccaaaagggttaaaagtctccggggtttctaactagattgacttcagtatattctagacattcttttgctgttgcttggctcatttccttcttgataagattctattttccttcctcttcctcttctctctgttacttaatatagctccaaaatatggtatagtcctccaaaccattgctttcagtgaatgtgtttattatgagataactgaagattctgggggcacgtgtgtttcttatgttcctgttagtttgttgcttcccagtccacttctgatataatagaatttggaaccagattttttttttttttttttgctaccattctgacattgtaacagccttttccattctctttgaaccaagattaagccacaattcagtcttaaaacaataaatcatcatttgctccacattcttgacccttggcttaataaggagaaaccttaggaacaaacaagcctcttttactctttcaagtattatcactgtgatttgaatttgtcccccaaagttcatgcattgtaaacctaatccgcaacgcaacagtgttgagaggttggatctttaagaggtgattaggttgtgagggctctgccctcatgcatggattaatgccattgtctccagagtgggtcactgattgtgggagtgggtcctgataaaatgatgagttcagcctctgatgagttcagcctccttccccagtctctcttgctctctccctccctcaccttcctgccttccaccatggaataacacagcaagaaggctgtttccagatgctggcactttgccctcaggcttcccagactccagaactgtgagaaataaatttcttttctttttaaattacccagtctatggtattgttatagcaacacaaaatggactaagatggtaactttggcatctccagagtgtagtgaaataaggacaattccaattccctttttttttctgtgacccattccctcacctggcaatgaaggatctttgctgcttgattgacatgtgcaaatggttagctgaaccccttgattccatatgtctccctcaaaatcactttacatcctaaggccaggatttggcccctctccctagggccactgaagttttagctaattccatttgtattaaaatactggttaagagctataatggagggtgattgactctgaatcttgacaaatttagaatcttttccggctattcaatcaggctttgccaaccttcatttcctttatttttcaaatgaagaaaatgaagcaggtaattaaggataaatttcttgtgtgagacaacatggggagcctgtggcacttccagaattaggccaggaatccctctgccagggaattcagtagaaatctctgccaagttatctctttgatgtctatctccacaattcttatttgctttgaaaactactgcctcctaccttcgtttcagatgtggaaattgaagctgtaataaatgttaagtatcctaaaagcaggactcacatagcaaattcaaggcacaacaaggattctcaatcgttgtgtgtttgtgcttttttctaacaattcctgcctactgccttcctgtgttaagatagggagaagaggattgtggcagattctggtgttttagtgccatatgctctcttcatatgaatgctattaatcatctgattacagtaaattgatttaagtgctggtgagatcaacatctcctgaaatttattaatctatttattgaacacctactgcatacaatgtagtacattaggttcttttgggggaaaatgaaaaacaaaaaacaaaaaacaaaaagcatatgctcctgacagagtatcttatactatagttaggaaaccacatctacataaaatgatattagaaaacagcatatgaaaacatatttccttcatcccatagtaagatgaaactgtttttcctttttagtggttttgccttttccacagcattcccattatagccaaagcctcttttttttttttttttttttgatacagagtgccactctgtcgcaatctcagctcactgcaacctccgcctcccaagttcaaatgattctcctgccccagcctcccaagtagctgggactacaggcgcctgccaccatgcctggctaatttttttgtatttttagtggagacggggtttcaacatgttggccaggctggtcttgaactcctgacctcaaatgatccacccacctcggcctcccaaagtgctgggattaaaggcgtgagccactgcacccagccaaagccgctcttaatatgaccccttagaatgagatctattttgctcgcaaagtgggatcaaaccagaatccgtttcttccacattttcttgacatgctttgcatttcatttagcaatttctttgagtttctcttccatgttacatttcttcttgacatagaaactagattttcaatggtagacattactagccattttgagccagacttgactatgtggttggttggattcccactgacaagtatcatggtgggcactccgacacaccatttctctagctgcttccatgtgagtgcctccaggcagccagagattattttctcttcccttgcctgcatctgtttactcctccccattggatagggccagcttgggtgacaacattccactggactgtagcacagtgcacgatctatcagctcaattgggattctgcctttggggaagtgcttcctttcagggactagagaggtaagagaaactagtcctgcctggtaggagacctggctccttcttcccccaatcccctttgcctgtttttgatgctttggttctgctctttgctgggtgaaggaagacagcagtgttggctgctttagttttgggcttccctactatggcaccatttggggcagcagcctagatggtgctgtacttggtgggggacaacccctcacccccaagcattttgctgcttctctctggctgacgtgtttcccttttaatgtgtactataaaagaaaagaagaggaagaaagagagaggaagggagatgagggagagtgggaaggagaaaaaatattaatttttgttcttatgtgaaattaacgtcttacttgctttgtgtctcctcttacccaagttggctgcagtgatgccctctctgacacagtaggtcagagaccctgaggttcgttcgttctttctttctttctttctttctttctctctctctctttctctctttctctctctctctctctttctctctctctctctctttctcgctttctctctttctctctttctctctttctctctctctctctctctctttctttctttctttctttgatggagtctcactttgttgcccaggctggagtgcagtggcacagtctcagctcactgcaacctccgcctaccgggttcaagtgattctcctgcctccgcctcctgagtagctgagattacaggcacacaccaccacgcccagctaatttttgtatttttagtagagatggggtttcaccatgttggccaggttggtctcgaactcctgacctcaagtgatccacctgcctcggcctcccaaagtgctgggattacaggagtaagccaccatgcccggcccttcatcctattttgatgtcagagaccacgtatggatatagtgctggatgctttatttaccaacttgagcctttaattttgcctctgaaatgaattatttattagcaaatacattaacataacatttttcatttggaggcatgctaaactgttgacctttttcgtaaagattctaagggggcttgaaaaggaaaaacctagaaatttataaatactgaatagagtgtccatccttcttcactttgtttcctagtagcgctttcatcctgtcacaaattggttcagcagcagaggagttaatatgcacaagcacttttctttgtcataggacgacattccatttgagtcctttaaggatgtgctggaaagggagtggggaagttacaccgcaaatattatcttccccagatgcaaacaagtttctttactagtagaactggaaaatatgtgccacttgctaattttttacttctaaacttttgttaggctgttaaatttggtgaataataccatgaattattattataaagattagcacatctatttacaatagaatatttcaaacagacagaaaagcatacaaaataatatgacaaaaaatcatctatctacaatccagccctaagtgctagatagtatttcatgtaataaaattttgccatatttgcttcagatctccctttttccctccctcccccttttgccctcttcctccctcccttttttcccctttcctctgtttcttccaagttaaaacctttttttcctcaacaagccaccagaagtgctgacaaagttaaaatcatatagatgtagttaaaacccctgaaaccaatctatctcattcctctcttgtgatctgcagggtgacaactaccctgaatttagagttttaattcctctgtgtatttttatattatttaaaattttttttaataagagctggagtcttcctgtgttgcccagggtgaagggcagtgcctattcacaggtgcaatccactatgatcagcacaggagttttgacctgctctgcttcccacacaggtgggttcacctttccttaggcaaccaggtagccctctgctcctgggaggtcactatatgatgcccagaactagtgggctcaagcaatcctcccgcctcagcctcccaagtagctgggtctataggcacacaccaccacacccagctattttttatatttatactatatatgtatccataagacataaagttgatttgcaagtttttcatcattaaatgatatattatgcgctttcttcttaatctctcactcaacatgtattaatactcatcttttttttttttttctaaacagtctcactctgttcaccaggctggagtgcaatggtgtgatcatgactcactgaagccttgacctcctgggctgaagcaatcttcctgcctcagccctgcaagtagctgggcctacgggcacacgccgccatgcctagctaatttttgtattttttgtagaaacagggtttcacatgttgcccagactagtcatgacctccttagctcaagtgagccacctgtctcagcctcccaaagtgctgggatttcaggtgtgagccaccatggttggcccctaatacacatcttttttttttttttcttttttttttgagatggattctcactctgtctctcaggctggagtgcagtggcacgatcttggctcactgcagcctctgcctcccaggttgaagcgattctcctgcctcagcctcccgagtagctggattacaggcgcttgccaccacgctctgctaatttttgtatttttagtaaagatgggttttgccatgttggccaggctggtcttgaacttctggtctcaagtgatccgccctcctcagcctcccaaagtgctgggattacaggtgtgagccactgcgtcaggccaatacacatcttctagtttatttaaagtgctagatagtatttcattgtataaaaagaccacagtttattcattcttttgttgatagatctttaaattgtttccattatttttcccttacaaacaatgcatgataaatgtttttgtatgtgtctccttgtgagagttatatatctaggtgtgacatcactgggttctatcacaagtctttggaagtaatttttatgtggatagtgcaacaatatgactagttacttaaaagaaaaaaattaagtcaagataagtggcggaagacacagaaattcagaaataggatgtaaaatagtaatggaatagtaggtaaattagatacataatcctatgcctttttttttctttttgagacggagtctcgcactgtcgccaaggctggagtgcagtggcgccatctcggctcactgcaagctctgcctccggggttcacaccattctcctgcctcagcctcccgaatagctgggactgtaggcgcccgccacatgcccggctaattttttgtatttttactagaggcagggtttcacggtgttagccaggatggtttcaatgtcctgaccttgtcatccgtccgcctcagcctcgcaaaatgctggtattacaggcatgagccactccgcctggcgacaatcctatgcttttttaaaaaggtagttcatcttttggctgggcatggtggctcatgtctgtaatcccagcactttgggaggctgaggcaggaggatcacttgaggtcaagagtttgagaccagcctgaccaacatggtgaaaccctgtctctactaaaggtacaaaaattagctgggtgtggtggtgcacacctgtaatcccagccacttgggagactgaggcaggagaatcacgtgaacatgggaggcggaggttgcggtgagctgagatcacgccattgtacgccagcttgggcaacagagcaagactccagctcaaaaaaaaaaaaaaaagggaaacattaatgaaaaggtaattcatcttttgaaaaaaaaagtagagtgaacatactgaacatcacagattttcatctacatttaagatgctagctttaggctgggcgaggtggctcatgcctgtaatcccagcactttgggaggccaaggtgggtggatcacctgagatcaggaattcgagaccagcttgaccaatatggtaaaaccctatctctactaaaaatacaaaaattagctggcatggtggcgtgcacctgtagtcccagctacttaggaggctgagacaggagaattgtttgaacctgggaggcggaggttgcagtgagctgagattgggtcactgcactccagcctgggcaagagagtgaaacgctgcctcacaaaaaaaaaaaaaaaaaaaaaaaaagatgctacctttagtgtcactgcttctgtgaagccttccaaaaattgcctttttttcaattactttctccttttgacctccattctctctacctctgttatatgatattgtgcattatatttgctgtggtttgtttatatctctctcagcaggctgaatgtgttttgaaggtggagttcatgtcttattcgtatccccagggtgtggtgtgcagttggtggttaagtctgaggaatgaatgaatggcccaaatcaccgaagatctttcagaggtggcagtggggtttctttttttcttttcgagatggagtcttactctgtcatccaggctggagtgcagtggcacaatctcagctcaccgcaacctctgccacccaggttcaagtgattctcctgcctcagcctcccgagtagctgggattgcaggcacgcaccaccacgtctggctaatttttttatttttggtagagatggggtttcaccatgttggccaggctagtcttgaactcctgacctcaagtgaactacctgcctcagcctcccaaagtgctgggattacaggcgtgagccactgtgcccactggcagtgggtttctgatgataggatagtttcatgaaagttagcttaaagtacaaaaaactttttttttttctttttttgagacagtctcatgctctgtcctccaggctggagttcagtgatcttggcttactgcaacctctgcctcctgggttcacgccattctcctgcctcagcctcctgagtggctgggactacaggtgtgcaccaccacgcctggctaattttttgtatttttagtagagacagggtttcaccatgttagccaggatggcctcgatctcctgacctcgtgatctgcccgcctcggcctcccaaagtgctgggattacaggcatgagccaccgtgcccagtgaaaaagctttgatcctttgtcttcaattgcacctatgaaaaggaagtttcgtataaaagctgatataaatggctaataaagcagagaaatagcttaaaatttgactgtagacatttgctatgtatgattaatatgtatcagtttacagttaattttaggaaaacttaaattttataaattgccaagaaatcacccatgaaaaactaattttcacttagcggtttaattttttaacattaggatttttaagtttcgctagtcttatcatctgggacactggaattttgtcttgttggaattgctgattaaacaaaataattcttcaaaagtgcttagcacaatgttaggtaaatagtaagcactaagtaaacattggctttattattattaggtggtcctatactatgattcctcctatttatatcacgtgtgtcttgctgcatatttaaggacgctcccatctatatgtttggactagtgcaatagtaaagctgccagctcaggtgaagaaaaccatttaaaaatttaaagttaagcacatgatggaaaattcttgaatatgtggtgagttaggtataaaaaatatagggggattgtattgttgaatacaaaaaagccattagactattttaagaatgctctcttctgtcattagggcttggttatgaatagtatatcacatgcatgaaaggaggtggtggctagtttcatttccctaaaacatgtttcaatggtaaattagaggcagctgtggtttactgacgcataaacccagtgaggtctatgataactagtatatatttacagtttgactcatggtgcctgtcaggctttaatcataggggaagaagtgatagtacttagacttcactgtttaatcttccgttcatttgttttccaagtttgtttcagtctgtgggcaggttcccttttgattgcaacatgcagtccctatttctgcagtttatcttcatttgccattttgagagggctatgaaagtcctatgataagctccttgttctccaaatccatgcatataagtctcatcgagttggatgcattctaaagacattttgaaatcacatcaacactttcagatcagcaagttatttcttaataaattactgtcttaatgttagatgctattttaaaaacacgaaagagagcagtttccaaatatgtgttactacttccagggaattgtaaactggagtgtttaattaaaagaaggccctaaatttttattatgctgtcactggatatttgaataactagctgtaaatgagttctagttgtacaaaagtgattttctaaatccagttgtccctatttcaaaatatagttctagttcctgggtgaaactgaaaatgaaatggccatgtctttataactaaaacaaattagagggttgcagcaataaaatgaacccacagaggggaaaaaaaccctttgaatcaggtttttattttcttctcctgaactgattgggtaatttactcaactaattttgtctagtcattaggaagttaatactccattctataatttccttccactcaagtgagcaatactggtgcatataatttggattaagaacattcctctactcttacaaatatttggatatatgccttgaatatgcttcctcatttaggccacagaaatttattcaaagacaaatcaatcaaagataataacattaactactatttattaagcatctccttcatgacaagactttttcccatattgagatataattgacaattgaaaattgtacatatttaaagtgtacaacatgatgatttgatatgcatatatatccatgcatatatatccatatccatatccatgcatatatatggatatatatgcatatatatgcatatcaaatcatgtcgtacactttaaatatgtacatatttcaattatgcatatatatgcatatatccatatcaaatcatatatatataatatgcatatatatcatatacatatccatcacctcacatagttaccattttcttttgttctctctctctttcttccttcctttctttcccttcttttttattttttggtggtgagaacacttaagatccaccctcttagcaaatttcaagtatataatatagtgttgctaattgtagtcacatcgttgtagaatacatctccagaattcattcatttggataactgaaactctgtaacccttttccaatatctccccattcctctatccctccagctcatggcaaccaacattccactctctgctgttctaagtttgactactttagtttttacatataagtgaaatcaacacagtatttgtttttctgtgtctcgcttagtttacttagcttaatgttcttcaggttcattcatgttgtaaatgacaggatttccttttgttttgaaggctgcataatattctgttgtatatgtataccatattttcttcatccattcatctgttgatggacatttaggttgttttcatatcttggctatcatgaataatgctgcaatgaacgtaagagtagagatatctcttagaaatcctgattttccttttttttttcagacagtcttgtcacccaggctgaagtgcagtggcatgatctcggctcactgcaacctccgcttcttgggttcaagtgattctcctgcctcaacctctggagtaactgggattataggcatatgtcaccatgcccggctaattttcttatttttaatagagatggggtttcatcatgttggccaggctggtctggaactcctgacctcaggtgatctgcccgcctcggcctcccacagtgctgggattacaggtgtgagccaccgtgcctggcctatttgatcatcttttacagcttagggaattaaggtttagatgtggcacaggacagaaacatactttgaagataggtctgtttgacttcaaaacctgtgctctttgccaggtgcagtggctcacgcctgtaatcacagcactttgcaaggccaaggcaggaggatcacttgaggtcaggagtttgagaccagcctggccaatatggcaaaaccctgtttctattaaaaatgcaaatattagccagtcatggtggtgtgctcctgtaatcccagctacttgggaggctgaggcacgagaatcacctgaatcccggaggtggaggttgcagtgagctgagatcgtgccactgcactccagcctgggtgacagagtgatagtctatctcaaaaaaaaaaaaaaaaacaaaaaacaaaaaacccccacaaaacccacaaaaccaaaccaaaaaacctgtgctccttactgtgctctcctgcctctcagtgcgagataaacagagtgggcaaaatagcctatgatgtcatcatccgcaaggcctgttgctactgtgtgatgcctgctccctagatgacctcctgggggggtgaagcgagaggaaatctggcaccaagctggttgaggggcagagcgagaatgtctgggcttcccccacccagcttggaatgtgagtgatgcaaatcatctcatcgaaggctcaactgcagccaggagactcctccagtgatgatgagagtgtacaaatgaagtgcaggagcgggggagccttcacacacctccagcccttcctgcttcttgaaatactcatatcctctggcagagactagctacagaaatccatgtccacttactcacagcctgaaagaaacccacacagtggaccaggaaggttgttgcatggtaattagagctactattgaatttctattgtgcatcttctcaattaggcacaattaccacatataagaaatgaggaaattaagactcagaggaattaggtgaattgcccaaggttattacatagcttatacctggccaaccagggtttaaacattgttctatatcctaatccaagacccatgttcctctcactactcaggtttatttctttcgcacagggatattacaaagtcattatatttcctgattatatttttgctgctgctgtatgaccatctcgtttcttgtcactgactttatccaaaagcaagaacatggtatggaattttgggggaagcagttgaaatgaagtgttggaatttcagagcttgcattactggattatgtgtggattgttgtttgtactgcctctttcttcctcctgctacctcatataggtgcttgatatctgattattacagtctttttaggggttcttgaacatactcacttgtagaaaagtgctggttaaaatcataacaggcagacatttgggttcttatagccttgcaataaatggaaggaagtaacttttgggcttatgaaaatgtatactgcaaggtttttctttctttctttctttctttctttctttctttctttctttctttctttctttctttttcttccttccttccttcttccttccttcctttcttcctttcttccttccttccttcctttcttcctttcttcccttctttctttctttcttgagacagggtctcgctccatcacccaggctggagtgctcactgcaaggatcctcctgcctcagcctcccaagtagctaggactacaggcatagccaccatgcctggctaacttttcttattttttgttttatgtagagacagtatcttgctgtgttgcctaggctggtctcaaactcctggcttcaagggatgcccccaccttggtcttccaaaattctgagattataggcacgacccaccatgcccagtggttttcttaaagttctctgcaaggtgtagatagtttcatgagtaagatgattagtcagtacagtagcaacattaggtaattggttttgccatttcgagcttgtagcaaattatccattcttatatgacaaagcctatgggacaactggaggacttgaactgtttctcttcagtgcccgtaaagaagggactgaagcttcataaatctagtccttcactctcctagctctgatcctgtcctttctgtaagtaatgatcatattgccttcagtaggtgtttgtcaagtctgtattttgttttagagacaggagctcgctttgctgcccaggctggactcgaactcctgggctcactttatcctcctgcctcagcctctctgagtagctgggactacaagcactgccatggagaccaatttgtcaagcattttaataccatctcatcactgtaatgatcaacacatgtgatctaaaaatcttttacatggcagtggaaagggcttgagccatctccgtattaaaacccaggtggtatcctcatcctttaatcttgaaatgttgaaagagttgattagctgtccttgctagctatctctaggaaggatagctaataactgttttgcttttgcttttgtgtgtgtgtgtgtatatatatttatatgtatatatgtgtgtatatatatacaaaagcaaaagcaagacagtatttgaaatttgaagacattgattctcataaccagtctatttcaggattaaatcacataaccaccaatctctgccaacccactttccagtaaccaccccacctccaatttcctgtaaatagcaaacactctgtagtatttcatctacagggagcactgttgagtagctggagtagtaacagtatttgcttatttttttacttgagaaggctttttgtttgttttgagattggtgtgtgttgggggggtctcactatgttgcccaagctggatttgaacctctgagctcaaacctcctgcctcagcctcttgagtaactgggactacagatgcgtcaccacgtctggctacttgagaagttttacaatttttatgttttaaaagcaggaaaagaaaaaaatctaggacttgtctctgtcataacatcatccataaaaagtgattttaagatgaagatttctcctagagagatacaagctggtggatctagcattcagctctcactttcattcaatatagttgtcattttagacccaagctttccctagagatagtgattccaccaggggaagcaatatgtgaagttattgcaagaaactttttgtgtgaaattgtgactgctgccagagatgtcatatgttttagttaactttcttcccaggaaccaagaaaatttcccaagccccagataaatacagctggaatgctattcagaagtcagtagcatggggctgaagagagagactgaattttacacactccatttgtttctggttgagataaaccctctgttctattttgcttacggtaaaaatccaattcactttgaaagttgtaaagcccaaagaactcaaacaaatttacaagaaacaaacaaccccatcaacaagtggccgaaggatatgaacagacacgtctcagaagaaggcatttatggagccaacagacacatgaaaaaatgctcatcatcactggccatcagagaaatgcaaatcaaaaccacaatgagataccatctcacaccagttagaatggcgatcattaataagtcaggaaacaataggtgctggagaggatgtggagaaataggaacacttttacactgttggtgggactgtaaactagttcgaccattgtggaagacagtgtggcgattcctcagggatctagaactagaaattccatttgacccagccatcccattactgggtatatacccaaatgactataaatcatgctgctataaagacacatgcacactcatgtttattgcagcactactcacaatagcaaagacttggaaccaacccaaatgtccatcaatgatagactggattaagaaaatgtggcacatatacaccatggaatactatgcagccataaaaaaggatgagttaatgtcgtttatagggacacggatgaagttggaaaccatcattctcagcaaactatcgcaaggacaaacaaccaaacaccgtgtgttctcactcataggtgggaattgaacaatgagaacacttgggcacaggaagggaaacatcacacaccggggcctgttgtggggtggggggaggggggagggatagcattaggagatatacctaatgtaaatgacgagttaatgggggcagcacaccaacatggcacatgtatgcatatgtaacaaacctgcacgttgtgcacatgtaccctaaaacttaaagtataataaaaaaatattttaaaaaaagttgtaaagccttatgccattggaaaaaaatgattaagatttctgtcactgcgattacaatttataccataataaatttacctaagggcgtgatggcctctactggattccttccagagttctgcaaggaataaaagcatgcaactgacaatctataggacattctggttctgcctggttcttctcatcccatcagccttagaaactatctgcccccatgccattgattagcaactccgcatgtgtgcagtgcaacagtaattaatgttccccatgttgacgctcaggaactacaataccatgaagtgcccttcagaattatcaaggagaaattaaattatgctcaatacagtcttagagcaatttctctcgtgatttaaagcacctctacaaggaggggctggagatggctgctgctggcttgtgcaagctgattgttaaatggtaaggaattttgcaagccagatgttaaacctttgaaatgggccatggagggagtatttgcatcacagaaattggtgtctgctaaaaataaagcctccttccctccaacaaactggtttatcagcaccattgtctatatctttgaaactgcatcattcaattaatacctattagttagaacagcatatctcactcttgctggtcagacatttactgatgagtcttgctaggttgaaaagccagttcatacctggattagtttcctgtggctactgtaacaaatcaccacaaacttggtaatgtaaagcaatctaaatgtattcttgcctagtcctagaggccagaagtctaaatcactgggctgaaatccaggtgttggcaaggatgggcttcctccagaggctctgggagagaagctgctcattgccttttccagcttttggtagctgctggcatttcttggcttgtgcctttgtccctagaatcttcaaggcaagcatgtttcaaatgtctgtcttctctatctttgctattttcaccttgccttttcgtgtgtgtgtgtgcacacgtgtgtgcgtgtgtgggtgtggcgtgaaatcttcctgtgtcttatgaggtcattcgtgattgcattttttagggtccacccaaatagtccagacaagctccccattttaagagtcttaacttactcttatctacaaagacccccccttttctttcccaataaagataatttttacgggttccaggaaaataacctggtatctttgggagggccatttttcagcctaccacaatatccaccttagtagccccttgtgtatacagataccgtgtaccgtgtaacctctttaacaaactacagtcttttttttttttttttttttgagacggagtcttgctctgttgcccaggctggagtgccacaacctccacctcctgggttcaagcaattctcctgcctcagcctcccgagtagctgggactacaggcgcatgccaccacacccagctaattttttgtatttttagtagagacggggtttctcagtgttagccaggacagtcttgatcttctgaccttgtgatccactcccctcaacctcccaaagtgctgggattacgggcgagagccaccacacccagccacaaactacagtcttaatgataaagagcaaagagcaaagtcttcattctaatgatagtggcagctctttcttattgcctacttatttcctatgcaccaggcaaagtgcttactgtatcatctcattattactccttcccaaaccaataaatacatgctcaaatgtcataaatgctctttttggaacacaggtatcaaaactgatatgtcatgatatacattccctgcttccctccacctcaaagccattccctggggctgctcataaagttgttccaggggctcctatttatgtagcctacttttcctatccttgtttcatagtttccaaccctgtcctttagttacccttagcgagcttatcttaacaccaacacaagccttgtttaaagggaatgtggaaagtatatctattggctgggaatgacttctctggtatgcaaagtccctagccgagtgaattgaaggctctgggccaaggtcagttcctgggtaaaaccataactggcaatatcatccctcgaaaggtggtttggagggggctgtgaaccacgcctgtcggtgattagcctgtaattatctatcctgtttctggttaacctgatttccaggggttctctcctgatctacttgcttagctcactatttaatttctacaacttacactagaggaagggaaagataagggaactaatatttggtgattgcccactctgtgttaggctctccgccgtgggagttttacatattggactaaggatgacataaaatccaagaacattttctggggttattctttgtagctgcagttaataatctggtagaactgttttagagatgtgatatagtaagttgatcaggtttgggtagcacatccatatttctgttaaaatttccagttgcgcataaaagctggttgaatctggactatatggtagccagtgttttacaaaggaattcaggtcacatttgcttagttttagaaatgctctataggccctgtgtgatttttttttcgtgcaagcagaaaatgaattcctagaaactggacaaagtcagcagtagcaggttaagggcacagttgggaaaaatggtcttgacttcattactctggctgaaaggtacctaatctttcagagcctcagttccttccttccttccttccttccttctttatctctctgtctctctcctctctctctctttctccccccccccctttttttttttaagagatggagtcttgctatgttgcccaggctagagtgcagtgactattcataggtgcgaccatagtgaactccagctttgaactcctgggctgaagcaatcctcctgccttagcctcccaagtagctgggactacaggtgtacatcactgtgcctggtggttcattccttccttccttacttccttcattccttccttcctttctcttttttttttttttttttttttgaggcaaagtttcactgttgttgcccaggctggagtgcaatggtgcaatgtcagctcactgcaacctccgcctcctgggttcaagcaattatcctgcctcagcctcccaagtagctgggactacaggcacttgacaccacacccagcaaatttttatatttttagtagagacggggtttcaccatgttggccaggctggtcttgaactcctgacctcaggtgatatacccaccttggcctcccgaactgctgggattataggcatgagccactgtgcctggcaggtagtttctttatctgtaaaattgtgataataatttttacttttcagggtttttggaaggattaaaaatgaattgaggtatataaaatgcctagcatatgctaagcattcaataagtggtagctatcattgtcaatattagcagctttgctatagagtgaatgtttgtgtcctcccaaattcatatattgaaatcttacaccccacagtgataggatagtggggtctttgggaggtcattagttcacctcataggtgaagctcttatgattgagattagtgcccttataaaagagaccctagagagctagcttgccccttcttccatgtaaggtgatagtgagaggttggtatctgcaacctgaaagagggccctcaccagaactcaaccactggcaccctcatgttggacttccagcctccagaactgtgagaaataaatttccattgtttataagcaacccagtttgtggcattctgttatagcagcctgaatggactaagacgagctcaaaatgaacaaatacactagcagtgaatttcagacaaagcaccatcttgctgtagtcacttaaataatgcaagtaattagtggcttccattcttcttttttccacttccgcagtgcattggcaataccaatacctttttctcctctgggaaggattccctggccaggtccctgccctttccctccttgggagcctcaagaccttcaattgcttaagagcaaggaggatatcttctttttgcatctttatttcctatcataattcctagaacttgaaaggggcactaaccattcttattgaattggagtaaagttctaacttttaaaaatgaaaacaaaatatgtgattcaatatttattcgactccaatcttccctcatacgaaaggagatcaacagtatggctctgctttttgtctttcttcttaaaccttgattactttggcttttggttggctctcaggacagagaaaggcaatgctcgatttttgtgactttagacccccttccccccgcaaaagactaattactgacataatggattttgttttttatttcgtcattctgtgactcagactagggaggctttttagctaattgaatggagagtgactttagcctactatcaaaactacaaggtaacatttgagggcattgaactaaatcctttatgtgcataatgttatttcatctttcctacagccttatgaagtaggtgttattaatatgtctatgttatatttaaggatactgaggatcagagagtaactggaccagggtgtcatactaggattaggattgagcctgcgtctatgagactttgaagtctggcttttgagtaccatactatactatatctagacttttttttttgtttgtttttaaagagatggggtgttactctgtcacccaggctggagtgcagtggtgcaatcatgcacagctcattgcagcttcgacctccccaggctcaagtgattctcccacctcagccctcttgagtagctgggactacaggtgtatgccaccacacacctggctaatttttgtactttttgtagagatggggttttgccatgttgcctgggctggtcttgaactcctgagttcaagcaatctgcccacctgggcttcccaaagtgctgggattacagttgtgagccacagcacctggcccagactcaaatgtttttttaaactgaattaagaaaatgattccaagaaagaaaaggtaattcagtctttcactaaatgctaattgagcacctgctagaattctgtggcggtgctagattactctcttaaaaaaaaaaaaaaaaaaaaaaaaaaagaaagaaagaggccaggtgtggtggctcacacctgtaatcccagcactttggaaggctgaggcaggtggatcacctgaagtcaggagtttgagaccagcctgaccaacatgatgaaaccctgtctctactaaaaatacaaaatcagctgggtgtggtggcacatgcctgtaatcccagttactcgggaggctgaggcaagagaatcgcttgaacctgggaggcagagattgcagtcagctgagatcacatcattgcactccagcatggtcaacaagagtgaatctcttgtctcaaaagaaaaaaaaaaaggaaaatggcagagcagggtatagatgagggtgagtgaagcaatggacctaaggtgcactgttcaaggaggcactcactctcaggtgaccttgcacttgaatgacctgcaatccccgaagccgaagctgtgtgcctcacttgcctcaccctggtcccagccctgccttttgcccttggggcgttcagtgtttagcaaggatcccatatcagtatgggtcagacccgaagagagaaaccacacagtgatttgaacagggagttttaatatagggaattattaaccagtagtctattgtttagaaaccaacaaggacacagagggagagaatacgacaagccaagccatggagttttgaccttcaggacaaagtgaggactttgtttttcccttacggctgtgcctgagagagcatgacttcccctatttattagcaacattagaccgcagcatttcctttcagatcaccccaagcatttaggctatttcaggaatctaaataacatctcagtcaaactaacattccgagagagaaatgttttaatatatcttttcccagagtagcctttaggtctcggagtgggtgcaaacaggctgggtgatggtcgatatatttgaagattcatgggaatccagaagttttggcagaggtacatatgaatctcaaggaaaaattaaatataatttgatataatgcaaactgcacagtagaatttgaatgcaggacaaatcacaacagctgtttgtcatctcactgaaacagcagtaacaggattgcttaaacaaattccgttcctttctagaatgttcagagtatttaatatttgcataatgattaatctcctgctccagaggaaattcccaaaggaagagacaactcagaagcactttaaattgcaacaccacggcaccacggcaaagagataagagggagcatgccaaatccctagttttggggctactctctcaggagaattgtaaataatggtggtcaccttgctgaatattaaaccaagaacaggatggctaagaggacacattcccaaacactgggacaaagcatactaactgggccaaaggtacaccaccaattaagggattacatcatgcccgtattatggggtggtagatcttaaatatttcaagttttattctgttctttgaaaaggctaaattcttattcttggtgccgtacaaacccacccaaacctatccccacccacccatccaaggaaagttctgaatatatatatattttttcatacagggtcagttgtttatttgctgtgatttgggggcctctgagaagcttttggctgcagaaagggcagcagacttgaagtgtacccctaggcttcagtaggagtttgcctggatcaatgggctttaacctggctgtactttagaatcacctggggaactttacaataccctggcccgtaacaaaaactcccagcctcgtatggtggctaatgcctttgggaggctgaggcactttgggaggctgaggcgagagagttgcttgagcccgagtttgagaccagcttgggcaatgtagtgagacccccatctctataaaaagaaaaaaacaagaaaaccccacaaattattaaacactaaacactctctccttcctctcccttttttgcacttttgggtttcaggctgtttttcagaaggctcttaaagtctggcctctgaatgtgataaagacatcaattggccaggcatggtgactcacacctgtaatcccagcagcactttgagaggccaaggcgggcagatgacttgaggtcaggaattcgagaccagcctgggcaacatggtgaaacccccatctctactaaaaatacaaaaattagctgggtgtggtggtgggtgcctgtaatcccagctactcgggaggctgaggcaggagaatcgcttgaactcaggaggcagaggtctcagtgagccgacatggtgctcctgccctccaccctggctgacagagcaagactttatctcaaaaaataaataaatgaaaataaaaaaaatctatcagtatcatttagtcacagcttgtcaaataactttctgcctctgctctgaaagggtattttataaaagaagttaaaaattttatatggatattgacattctcattgctgaggggttagtatagtcatttgtaatgactaaacatattattcagttataatgactaaacatatctcatgactctgttctgaaacctagtactaaatacatagttaatgaataatattcattaaccatggccgtcgtaaatattcatctaatgcctgtcttcatttgagggttagtaacatgttaaggatatttgtggagagaatgaaagtgataaattctatctatatttactcttatttaaaaaaagcaaattcattttttagaatactctttgataaaatcctttaacaaaaggaaatttccttttaaaaaagtcttctgtctttgagttaatactcttacacaaagacagtttactaatgttttgcttgttaaatggccagttgatggacagtgtaaacaatccaattcaacgaagagtaatacaaagcagtgttctaaaacgttaaactgatgccttcctaatagtactttggagttatttttctaatgaaaagaggtagcagtaattcactgccaccctttcctggtcttcttgatcaacaacccatcttaaaggttgttggatggagttggtatatagtctgtgaatagaatggagcagggactggtaacctttttcttcaaagggccaaatagtaaatattttaggctttactactcaactctggtattgcgatactaaagcagccctagaaaatatgtaaatgaatgggtgtgactgtgttccaaaaaactttattttcaaaaacaggcggcagactgagtttggcttgcgggccataactcacccacttctggaatacagcaaaccccatagggtggtaaattggctctgaagttgcaatggaagtacaatctaggattaggaagaagccaatgggtgccagggttctctatgagcaggtggctccactatgatgggaaaagtcatgagaaagaattaataataatgagtggtaatagcaatggctaatgtttactgataatttgctatataacttgggttaaatacatgttttatctcatataatctttacaataaccttgaggtaggtattaacctactcctattttgtagatgagaaaattggggcatggagaggttacatacaattcccaaagtcacacagttagtaagtgtcatggctgagatgtgaattcagatagactgactttagagactgctcctctaaggatgcattactacatccccccagaggacagagccacatccaaagtcatcacagctgggatggaatagaagggtctctatatagacactgtatagattctagggtttctgttctggttctaggggttcaccatgctgcagatgggccaggaattgtgccctgggatatgtactgggggagacagttctccataggtctctcatatttcttcatgttttcaagcagaagcattgatagcattttccaaacatgtttgcatattggaaagcagccttggaagacagaggtagtatctccctctggaacagagagggtttgcttgctgcatagtataataaagatgatgcctctttttggggcaaagttgagcaagtttatttgtagctcattataaattattggagttattcggccatgatggaatccattgtgtgtgctactgggctactctgttaccctcttggaccttggggggcaagaactaatatgaacataaatctcacattgcttgctgtgctgagtgaaacaaagtcctttgcctttggcccaggagtctcatgtcttctgccagtatcctgaatctgtggcaggctaacttgttttgtgcaagcagggtaaaatgtcagttcttgacatacacaggaggcacagtagatcctaatggctggtctgaggaggaaagctgttcactcttggcttggttttgtgtctttttaaattatggatgaatgaggcctgtgctgaagccggggagaggcaaacctctacaagcacccgtagctcttgattacataactggcagagtgctatggtcttctgagaagttttaaaactgaccatatggagttaaagatgtacaattgattggttggaatgattttcaatgaaccatagctgtaacataaatattacattccagctgtctaatgtagtggttcccagagctgctcattagatcacatggtaacattaaaataacaacgataaaacaacagattcctgagcaccgcctcatatgtgataaatcagaatatctgggggagaggctcagaaatcaatattttacagatttcccagattatttagatgcaggcagtccctgcactgttctaatgataaagattgaattctatcacagacaagtcctgcttctctgtacctaaattttttcatttgttacacaaaaagctactctagagctgtgctgttcaatatggtggcaactagtcacaggtggctatttgaaatacaatttatcaaaattaaatttaaaattcatttcctcagttccattagccacatttcaaatatttaataaccacatgtgactactggctacagtatcatatagcacagatgaagaacatgcccatcatcatagaaaattccattgaatagagctgctctagaatatcttattacaccagaaaggaaggatgctatcaaagatgactgaggttgtaccaaaaagactagtagctagcataaataagcttccattggccaaagatgggataatttgagcactaattagaataataactgcaatggatttaaatacatcaaatatatttaaactcgtggttcataatcatactaaaataatatttattggtgacttttggaggatgccagggaatgaagtcactatctgaaaactggaaaataaagggttatcaagcatttaatcagtactgttcataaaggaaagcctggataaatgcttgagatggacagagttgcctatcagaaagctcattagcaggtcctacagaatgggagcactgcttgccctttgccatgcccagttcaataacatacccttgtactgatttttcttcctctcttttgtcatttcccatatcctgcacttctattctctgggatccttaaataaattactgcctgcaaatctctatctcaggctctgcttttgggggtgaggaactctggctaggacagcattctacttcaaattcttgaaagggaatccaaccccacctgggtatagatttggttgcttggttcagacttctattcctcgtccaatctcttgtgagaggctgtttcttccagaggtatagtcggaacttcttaaagttgaagaagtagaagggagagagagttatggggtcaaaactgaatgcaaacctgcattggaaaaagattccccaggtgattttatgtatattaaagtcaaagaactctactttagagggtgtaataattatctggctcaggaacattttaaaaatagacaagatgttgagtccaaaggtcaacgggaagcacgtttgggggaagaggaacacacattgttacatggggggttggaagaggaaaagcaagattgaatgtatgtgaaacctttaaatccacagaggaaaatggataatatgcaacatatggtgcatggtataatagcctaatacacagaatgtacactatgtgtacctaggttattgtattctgtaccataaacctcaaaaaatgttcgagcaggaaggtatccagccctccaaatcaatagaaagctgcctccacatccctgtagatatggaacagcttcttactgaatgactgttaaatactgaacccaaggctggggctggggctggggtgtgtgtgtccgtgagggaggcagaaccaattttggcaattcaccacttcccacccagcactttgggcttctctgttcccatccccagacttctaacattgtccgcctcagtacacggcctcttcctcccatgcaaaaactctcagtcacaggcaggatgtactgggagctgtttaacaactggctctccagaaaaaaaacagaaagctctgatttgcagcattttccaatttctaaggcataaacactcccatcgcggctgattgtaaattactgaacacagagttgggaggtggtataaactggcccctgctcaccactgggaataagtggaagaaagcaaggggggaaataaatggtggaaagacactgtagaggggtttaagaccttcccagaagtgagggaaaggaaatcaacgtagtgatgacctggagtcattcctttaacttcagttactatgattcggaaacattggttatctgcctcttcacgtcaaatgggactctgcagaggcttgccttgcttctttggctccgtgtggcatatttggccatcttattcaatctatggcctcttagcttcaatgttcctgagaatgtccttatattgtggctttttttttttttttttttttttttagatggagtttcgctctttgttgcccaggctggagtgcaatggcacaaactcagctcaccacaacctccacctcccaggttcaagtgattctcctgcttcagcctcccgagtagctgggattacaggcatgcgccaccatgcctggctaattttgtatttttaatggagacagggtttctccacgttggtcaggctggtctcaaactcctgacctcaggtgatccgcccgcctcagcctcccaaagtgctgggattacaggcgtgagccaccatgtctggcctacattgtggctttaaaagagtcagaaactcagctggagaaaaggttttaggacagcaagagtgccttgtattgtgttgtgatagaaacctcttccataaacattatctaggccctggaatgcccacacccacctttcatgggcatgtcacaccccttcttccctgcctgaatgctcctgacccccatctggcctcctcaggtgttagacaccctgcttcgctggccacaattcaagccctcacctggtttccttggacttcatctgagagctacctgtctttcctgagagagctccagctggcacagaaccccttcccttggggatactggcaaatacatatccaacttgccataggcactggcaggaagctcagacctgtcctcctgcccacaagcactgccttgaaggctcatgctggctctctgagcgcctgatccagtggcctgggtcctctggtcacctcccaagctgcagaccattgatttcgtttgcagctctgggccagcggaaccccccgttctcatccttcccaacaaagcacacacttgaatttcccataactgctctggttgctcactttttgctttttcttggaaagcatccaggacgggaatctagcttagtacaaagagcctaaattaatgcttcttagcctgcacaaaaaaataattttttgttatcttctctttgttgtctaatctgatccaaggtgacttgcaggaaagaaatgcttccactagcaagttaaaagtgttcatttttgcaatcctaatagctgtttgaaatataacagcttgtttagtcctctccccagatgaatgtaccttcatctttagatttatgatttggtttttatctcttctgaaaatagagacagatgtactggaagttcccttatctctgcctctcagaactggggcctcttttctgagttttacttgtcttctagacacccaaagcagccactagttaggtttattcttcttaattctcattttctctccatatgttttcttctctgagcccataaacacatcaccactcttctttacaaaggcagggccccttacatgatttagaacattctacatactgacagagccctccaggtggctcagctaactcaccacagcttttatgtctttccaggttagggaaggcattagggccagaggtcagcatgcccttcctgccaacagacagccttgctccaccccactgagtgttctgtttggagtgaaggccaaaggtctctggactaaaaaaaaatgcctttaattcaagcccaagttataaaagaaagaattccagcttctgctgtcaggcctgcgaggctggccaagctggagcatccttgacctttcttttttccttcagccgtccaatgaatttgtgtccaattcgtcctccaaccctccacagacagttgcattctatgatgcctctggtgatttggaaggcggccgagctaggcacaaaaataggagcgcctgaggcgagagattcttccaaggttcttggttgtcagaaagatgaacatcaccacatggttctaaaagaagagatgaaagggattaacattgtaagcagttgtgagattagactctccaagtcactaggctccagatgaagcaggaggcatagcagagaaaatcctgtgctggtatcggtaaaattatgagcaaggttttagaggattcatcagaggaaggctaagttgaatgggcactaatgagctgatgactcaaatctaggaaggaataagatcataacaaccaaagctctgcatgaaggtgggtgctgtataattgtcacatctactagagacaggcactggtccccaagatgagactggctggccccttacccagtgaacaagttatcaaatacttaactaaaataagaactgtgaatatgcccagaaggattctttgcgcatgcacttaaatatgttactctccctatcttttattaaggcccttgtttggagaagggactgaactagatgtgcgcatgtcttaaaaatgcttacgaatcttgagcctggtataacgtaaacactcagaaaacactttattgtttacagtatagtaggactcatcccgtcgtggggagctatggcagtggccttgaaaagagtgggtattagtacacaaatgttcagaatgtcccacagtactacatagtgcccagttcatggatgagctgccactctgctgggacaggcttcatctgtttatttcaaatgtataaatgttgggtgttctcttggtcttaaaaggggttagatgtagcacagggcatttatattgtcatgaaatcagtctgagagtgttggatgggggcattaatatatgaaatcagggaaatagcttttccctcatcctcttcatctccaagaatatctttctgagatattctctattgttctgcccagtgcagttaggtcttacttagtttgccttgtaaggtcatttcagattttaatcgctctccccataggaagtttttcctgctgttctgcctgagttgccttctgcttagttttagtccattatgtctgtaaagagagggagggttttatggggcaaaaggcccaatcatcgtgggaagaatgaatcattccaagaacagtgagatgggctggaaagagaaggcagcgaaggggcaggaagttgtgggtggaatgggttactgagaacagcaccaaaacagtctgtcttctctctccattactcccactagggggtgcccagcatcccagaataatcactattgttaggaagttgaagtttgatgtgtcatctcctaatagaagggcactggtttctccctgagggttttctatatctctgccctgagttgagaagagatctctgtgtgtgtatgtgtatgtgtattgtgtgtgcatatttgtttgtgtgtatgtgcttgtgtatgtgtgggttagaatcagtaagtgcacaaatgcctcttaagcattcatttagagattctcaattcatggaaatccttagggatacactgagttttccaggacccagctgacttgatcttgaagtcagtggctggagtagttgtgggccagaaacatcctcctcagcccaggagaagtggcagctgatgtattttaattactgggagtcaagaagttgtagggataagaaatgagttcagctgagcgatcagctggaggtcagggatggaggaaagacccagggtgtgtgagattctgaagtagagtggtgaacaggtgtgggatggatgtcagggagaggtgagggtatctggagggtttccaaacagccaggccttcaggatggccacagcaaaacttccagttctgaatggttttgtggaaagaacatggcacctggatcttggaagacatgaactgaaatttcagttcaagcattctatagccatgagacctgggggaattggggcaagttatttcacatctttgatcttcaattctctcatcttcaaaaggagactaatgatactagggttaagtgagaatttaaaaaataatgcatataatgcactacataaatagaatcttcttcctttccctttctcctacttggaaatggctgagagcaaagatgcagttcttgcatcccatgaccacagagttctaggactgcagccctgggcaagaggttccaccttggctgctggagttttctgcaacgaagaacttcagtgagtgttcagggcatgcctgcagaaccctggtccttctgtttggaccagtgctccaaatctgtaggcctttgggccgtaatttagaagctatttctaaatttttgaaggtcttctgtctagtcctgaggcctttagtctcagagaattaaattgtcttacccagggtcggtcatacagactgccaaagcctggcctggcatccaggtgcaatgttcatctgtgttaccagttcctccatgctaacctgacaatgactcacaattccttatagcacagtgttccaaagtctgagccacagaccacctgtactagtagcagccggtgggcttgataaaaatgcagattcctggctccctgacagtcccgtgctatcagattctgtaaagtttaaaagtaatgatttataaatttcccagacccgggttatacttttatatggaaacataatgcctgaatctgacagagcgctttttcatggaggaaagttgggactcttgggcagacttcctgttgctttcgtactctacaggtgttcctgaccctggtatgtatacagccatctccgccctacctacttacttccttcccccagaacttcctaaagtggttaggaacaattgttgtgaaggtcacagcagaccatttctgtgaatgcgagatgtgttggtgcaatttgaaaaggtcaatttgattgacgcctgagccacagtgataacccaaggcagcagccctgtcactgctagctcccaacagtggtggcatctgcagcctcgagcaaagagattgtttaaactgatggaggggaagctttagttcttatttctgggagattgagtggcaccaggagaaaggctgatcactagttgcaacttcctctgtatttacaatagcgtttgctgctagtttagctgtgtttagactaaaggtgggggcaaaaattacccttcctctaaagctatgaaccctgacctctcagtctagagagagatggactctggatatgtggacaggctctgcgagattcttcctgacaagggctgtatgagccggctttcagaaggaacttattcatgacggtggatcactattcagagagacacactctttctcaaagaaatgacaggggcagcagggaccacattaagttttgatagggtcctgcagctgttggggcaaaagggtctgccttggcctctgggggtctctgcactgcagaactgcagtggatgtacagggattgccgggggttgcagaaggattttgcgatatgcattcatgtcagcttcaaagtgcccaaaatgagcgtgaaaatgctgtcagaaaggcagttattgctacctgaagtccctgttggaacaaagtgcaaattaaatactggtaaaagaaaacaaagcagatcattgttgtgtagcaaatgtcactgtcctgtgtacctatctggcctactggctgactccaggaggtgggaggtgcgactgcatggagccacgttcggcctcctaccttcaaagctggttacatctctgaatggggagctggtgagaaagagctctccttgataaaacatcatttttgcccttcccaatctattctttccttttctgttttctaggaagaagaggatttatctgactcaactggagatggctcccttcccttatttattgttgcatcctgaagcttcccccatgctgggctcagtgtgaacaaacagcgcgggagaatgcaaccactgcagaggtacaagttcacagaggcagagccgcccctcgactgggccagaggcaaagacaaaccccaaactctttcttgtcattcattgaattttgctgaacctggaaaggaaataaattccaaaggcaggaagtgacccagagaccataacaatatgtgaaaagcttagccggtgcttccgcccctttgtttcaaactattctaatctgtgtcccaggaagcctagcccatggccagatggagatctgtttgcagatgcctcctggcatctgccactcccggctggtgacatttgcacatttcagaaggcaaacctgtcccaacatcttcaaacttccagagaggtgtagcaccaggaaagtccttgggtctctggctgtcagcaccaaccagctgatttgcttcatctgcagctgaactgctgctggactccagcctagaacactagtgcacaccgggtctgttcttgaagatttgcagattctgaaatcaaaatgccctgtgttgccagaaaaggctggctcccttgcctgcttcataatcccttctcaccaggctttcctaaagaaactcaatgagtcaggaaggaagaaaacatgtctgagggagatctggaggtgggccgttctctatcattgcttctgaaaattcccttctgttttgcaatgtgggtaatgtttagggatttgcttttagtttttctctgtttcttcctctgtcagctctcactttgagagacccttcatttaccactcatgaaattagctctgcaatcgcaggaggctctctgatggggaattagtcactgttgcaaaaaagtttagactttactttcatccccaggagcagggcaagaaattgttcccaccctgctctcagaaggaaccatcactcaactgctctgctctgctctggctctggggcctgtacttttcctaggcttttaatttttactgcgtaccttccatcagccttcttactgaaggctgtatgccagctgatgtctatgcacagcaaggtggcttctgggacacctgcttcaaacaggtatccagctaactgctccccaccaaaccccaccaggtaattggaaaggaacttggagttgagtgaatacctgtttcaaaatgttaagtagatcaaagtgtaaagaatccaatatatttgttgacaactgatttatagaaaaccccagcaagaaagaagggagaggttcagcctcaggctggtgaaaatgagatcgtgggtagggcaccactgtacagcattctggcatcagacctctgtcctaaggtgcgaagtcactctgtgctactatctgaaattgtgttctgtttattatgaaagaggttttcaaaagtgttttgataagcttggatttatctctggaaaggcaatatggtctccattacaagacaggagcttaatatcagagacaggttgtatcaatgtatgtagctgctagtaaatagtagataaaagaagcttcagaaaggtcgggggagggagtcttttcttgttaggaaggaacaatcttgcaggggatgtgagagattttctctttctcctttcctctgcctatggaaaatcaaacaggagaaagctagaaatatgagacagagagaagtaatttctccaactattgacactggccaaacaagataaatagttcatattctgatgatgatgacaacagttatgatgagaagatattgacccagaggaagaaaacaaaggcttttgatttcaagttgtgtgtaagccccaaagaattgttgtcagagtcacttttatgatctatgggacttttggctacaattataagaatttagcgtgagtgaaataaatataattggtcagaaaaatcagtattagattaagacacgattgaaaatggttaaccattagtaagaagtataccaaattacacgtatttttgtgcttctttcagtcttgatctaattatctgttaaaaagtaacatagttaagaactgtattctggtttaaatataacacaaagcaaaatattttattgtgctctcttaggcatatgtttgagatacctggccactggaggtcatctcgtctactatattcaccgcagataaagaatgaaaagagaatacacaaccttgtgattgctagcagtgaaagctcagagttatgacataacagtaagtgttatattctacataaccttaggtttaacagaggtagttactagatacttaaagaacatgcttttattttgcacaagagaaaatggaattaaaaatgggaaaagaatagagtcatgactcccaaactgtgtcctaggcacccaagactttgcagcaaacttagaggggggctgtggcatagtttaaatatcaaggaagtatagtggcacttgacatctgttggatatcaactgaactattagctcaaggtagttcattgttccaacattagattgcgctacatttcttccaaaaatgtcctgtctttgggaagctgagttttcagcagttgttgtaaaatgcaagtacccagagaaaatcagtgtggaataggaggtgaaggtgcttgtgtccacatgggttccaagatttgggaagatatttggtgcccaattggcatacacatccctttttcttttttttggatggagtctcactctgttgccaggttggagtagagtggcgcgatctcagctcactgcaacctccacctcctgggttcaagcaattctcctgcctcagcctcccaagtagctgggactacgggtgcacgccaccatgcccagctaatttttgtatttttagtagagacggggtttcactatgttggccaggatggtctcaatctcttgaccttgggcacacacatccttttaaaagtaactgagtatttaagaatgaaataaatttttttctttcgatttatgtgtataatttttttcaaacaactaagttgttgggacttaactactggataaatggaattttgggtaggtatttctttttgcctagggactctgtgaaaaaattacagggatacaaaatgctgtgacatgagacagtttgggaactctgaattagagcaatacaaaggtagattttaatggttcaggctcattggtcagaattagaaagtggttagatcctcctctccccacaccagccaggacactgctcccaggatttttccctgttcccatatgaaataagcaatcttagtctaaatttttaaattaatacaaccatttggtagactattaaaagttatatgacacaaagcttctcaaaatatctccaatgcaggacttttttttttctttttaattttttaatctgtcatggactacatgatggttaattttatgcaccaacttatctggactacagtgcccagatatttggtcaaatgttattctggatatttctgtgaaggtggtttttggatgagattcatgtttaaatcagtagactttgagtaaagctgattatgattcataatgtggatgggcctcatctaatcagttgaaggccttaagagaacagagactgacctcctctgagcaagaaggaattctatcagtagtctgcctttgaactctgcatctcttccctgaatctccagcctgctggtctaccccatccgatttctttggattttggttccacaattacatgagccaattccttaaaataaatccctatctatacatatacacacacacacatatcctgttggctctgtttctctggagaatcctaatacagactgatgctttaaaaaaatgtgataaaaatgaacttctaggaaaagaatcatatgcttaaatatttcagaaatgtcaaattgttataaagtttctaaatgcttgcttccattttctatatttagctttagcttgtctatgattggtaataaaaggtttgtggaacacactttaagtagcactgatctcataaaaatggaaatatatgcatatacctatctatatttatatctatgtacatacatttatttacttttaacttgaaactaattttaaattgatagaaaagttgcaaaactagtacagagtattcccatatattgccttcctcaagttccccagttttaatatctgtataactatagtataattttcaaaactaagaaacttaacgttagtataatactattaactaaactaaaatcctgtattaatctgttctcacattgctataaagaactacctgagactaggtataaaggaaagaggtttaattgattcacagttctgcatgctatataggaagcatggctggggaggcctcaggaaacttaacaatcatgtcagaaggtgaaggggaagcaggcacatcttacatggctggagaagggggggaagaaagagtggagggggaggtgctacacacttttaaacaaacagatcttgtgagaactcactcactattatgagaatggcaagggggaagtctgtccccatgatctaatcaccctcccacaagacccctcctccaacatcgggaattacaatttgacatgagatttgggtgaggactcaaatccaaaccatatcattccacccctgtcaatcccaaatctcatgtctttctcagatttcaaaacacaatcatcccttctcaacagtcccccctaaatcttaactcatttcagcattaagtcaaaagtccacagcccaaagtctcatctgaggcaaggcaagtcccttttgcccatgagcctgtaaaattaaaaagaaaaagttagttacttccaagatacaatgggagtataggcattgggtaaatacacccactctaaaagtagaactcagccggaacaaaggggctacaggtcccatgcaagtccaaaacccagcagggcagttattaaagctccaaaatgatctcttttgactccatgtctcatatctaggccacattgatgcaaggggtgagcttccaaggccttgggcagctctgcctctgaggctctgcaggatacagcccctttgtctgacttcctgggctggcattgagtgcctgtgggttttccaggcacatggtgcaagctgttggtagatctaccattctgggatctggaggacagttaccctcttttcacagttccagtaggcagtgccccagtggggactctgtgttggggctccaaccctacatttccctcctgaactgctctagtagagattcttcatgagggctctgcccctgtgacatacttttgcctggacatccaggtctttccgtgcatcctctgaaatctaggcagaggcttccgagcctcaactcttaccctctctgcacctgcaggcttaataccacatggaagctgcctaggcttatggcttgtaccctctggagcagtggcctgagacatatcttgggcccttttagccatggctagagctggagtggctgagacacatggagcagtgtcctgagattgctcagggtttgagcaactttgttcaaccaaggttactcaaacttttctgggccaggtccagaaaaccattcttccctcctagacctctgggcctgttatgggaggggctgccacaaaggtctctgaaatgccttctaggcatttttcccattgttttggctgttaacattcggctcctttttacttatgcaagtttctgcagctggcttgaattcctacatagaaaaatgggtttttcttttctaccacatggctgggctgcaaattttccaaacttttatgctctgcttccctttgaaatataaattccaccaacctctttgctaatgtgtaacaaaagtgacctttgctccatttcccagtaagttcctcatctgcatctgaaaccacctcagcctggactttattgttcatatcgctatcaacgtttcagtcacaacaattcaacaagtctctaggaagttccaaactttccctgatcttctggtcttcgtctgagccctccaaactgtttcaacctctgcccattacccagttccaaagtcacttccacattttcaggtatctttataacaatatcccactctttttctgtattagtccattcttgcattgctataaagaactacctgagtctgggtaaagaagcttaattgactcacagttctgcaggctgtacaggaagcatcgctgtggaggccttgagaaacttttaatcatggcagaaggtgaaggggaagcaggcacatcttacatggctggagaagggggaagacagagcaaagtgggggtgctacgtacttttaaacaaccagatcttgtgagcactcattcactatcatgagaacagcaagggggaggtctgtctccattgatccagttacctgccaccaagcccctcctccaacactggggattacaatccaatgtgagatttgggtgaggacacaaatccaaatcatatcagaccctattcagatttcaccagatatatcttaaatagtgaagtcacagctctaggatgtgcaaatttggtaggcactgggctagaaaattgttgcagaatgagttgaaccactgctttgttttatttgtagataagctagctgaaaactagaaatgtttgtcagtgattgtgaactgttctatagaagaaaataaaaatcatcaacctcaattaaaaacatctcacacatattgattgagccaataccatagctactaagcatgccttttattactgccagaaataacaaattcttttgtatctggacacattactcccttaatgacagaccgtatagaaaagtgatgcttggacatgtatctgaaatgtcatgcatttttggccaagccactctttctcatctcttctgtgcagtttgagcttccacaggttgaacccagctctggctttttgggccctttctgtagtgactatgcagatttctatcatggtacctgtaacactttgttgctataactggtgtggatgcctgctaaactatgaggaactcgtgggcctggctctgtcttagttgccctggtatttcagtgcctggcataatgccttaggcatagcaggcaggaacacatgctcaatgaagaaatgaatgaataaatttaacatatgataagttcacatttttttttcctacttgatctcattgggaaaagagcctataactttaaattattccagtgaataagacaatgttgggtgtgtattaaagaggaaaatctttcaagggctttgtgtttgagaaacagactttgaatgccagttgtgacttaacagctgaatgaagactatcacttttacaaatagcatacatgtatgggtgctgactcactttattcagtagacacaatgtactccttaggtaatttgatccatctcagtaaaatctgccttctacccagactgaatggttgtggttcgttatcattattattcagcattgctacagtttgtgttttcaaagtactgtgttccccatttttaatgagctaggcagatgataggtaatgaaaggggttttagctagtctcacatgtagctggtgttcaatcaatttttgatgactgcttaatcactgaggttaattggggacgggctggtgtaaactcatgggaagaaaggctctccaacttttccatggacggaggaggtgtgggagtggagagaggagaagctgggaaagactatgaagatggaagagggaaggaagtaggaattccttctgataggagtggagcaggcttctgagtctctgacccacttcagcaaacctcagggccctctggggcacatcatgttcatttgccctgtgaaggagtagattctttggggttggagctactacttcttaagaacaagttgtttagggactacttttataagttttgtggtcatgttttagcattctactaatgcttttcatatcactgattctaaagctgaaaaaaaaaaaaaaaaccatgccaaaacaaatttataggaattcaggatatcaaagctgaataatgatttattctcataggaggtattgcaattagggacaagaaaactgttgatcctaagggtccctagtggcaggacagactgaatatacagttgagacatggagagagggataatttaacttctcttccttggaaaatccatctcctccttgaagccctgctcagtgtcttgctctggccctgtcaactgagagatgagaaatgttttgagtttggggactgggagtgagtgttgtcggcttaaaaaagaataacgtattagatttgtgttaagtgctccgtaaacccttcctaccccctttaaaaaatggtcagatgatatttgtatattttggtattattgggcaatgaccacaaatatttgtctggaacacaacttggagagaagaaaagttgcgaagacaaaaatataagcccttgccagccattgggttggctggggaagtgtggaaaagctcagggaaatgtcctgccatacactctaattcctacgtcatcatgggcctggcaggcccagctagcctggggccatacatgaaggccagtggagaggtaaattcagcaggctggagctcccagcaaagcagcaaagctgatttgtctcatcctaggtagaagcttaaatccagttgccatagagtattttgaggattaaatgagctaatgtctgcaaaagcaacctacacagagcctggcacccagaagatactcaaacaaagtagattttcttccttgctgtgacttcacaagggattgtgggtgtctcaggacactgtgtctcagttaatggctttatgccatgtgggcattctacctttttgaagacactggaaacttggaccgaaaccaactccaaattcttcattctgggtgagatgagccccagctagagatgcagctcagtttcctcatttgcaaaatagaatggtgtggggaagttattttgtgtccttgaataaggaaacatggttcatatcatttcctcagagagtggctggtctggatttcaactcagaagaggtctgtgggaaatcacatggggctgctgcaatttctattttgggcagagaccttatctctgagatatccgagctgggatttctttagtgataccttaccaacttctcacaaatacttcactcggaaccctaaacctggggagcaccacggagtctttgaccccaactgcttcactctccatcagtatttgcataatgtcaacacagttctcaccatttgtgaccaccttttgaccaggcaattctacctgcctcatgtccctagccaaaaggctagtcccctttgtcatctattctttttcagttccttgcccatgtactgcactctcactctctcattatgttttcatgtttaatctctgctcctcaactggattctgtttgccagatttaaagtgtacacaaggctcccactggcgggtggggtgggggagtggagataactctaccccaagcataccttcccctcaagctttcatattctcttctcccctttacagagacttctagagagaacatctatacttgttgactctttttacttcctgctcactccttaggtcactgccaggctggctcctacctcatgagctcgacaaacagcttgtgccagggtcactcaccttccttcacatctcagcagtggtcaacactgttgactgtccctcctcctcgaaacactgtatttttttgtcttcagtgacgcaaggctcttttgtttaccttcatcttctctgactgctcattttctatctcttttgcagtcttatcctatgctccccgggtcaatacatattaaaatactcaaggcccagtcctagatagtcttgtctttttttgtttgtttgttttgatatggagtctggctctgtcacccaggctggagtgcaggctcactgcaatctctgcctcctgggttcaagcgattctcctgcctcatcctcctgagtagctgggattacaggtgcatgccaccacgcctggctaatttttatatttttagtagagatggggtttcaccatgttggctaggctgttctcaaactcctgacctcaagtgatctgcccacctcagcctcccaaagtgctgggattataggtgtgagccactgcacttggccgtcttcttttcttattctatacttcgttcatggcaaaaatgtttctccagcccaggtctcttctttgagctttagatccatgtatccaatttcctacctaatactttcatctggaagtttcacatgcatctaaaacacaacatagccaaaaccaaactcttgattaatccaaaaccttttgctgttccctatgtcacccgcattgttaagcaggccagaacttggagtcaccatgacctttccctctgccttacccttcacattcaattttgcttcctaaacctctttgaatctgtacttttttccctacttccactcccactatcctagtctaagctaccttcacctcttcctggataaccttaaaagcctctttattggtctatctgccactgttttgacctccacctcccacaatgtatgctgagtgagttcttcatctgattttcatgtcttccctgagatgtttaaaatgtttgcatgccctcccatgattttaggatgcaacattccttaacatgaccataggccctgtacctagccagctttagatcaaaccatcctctgctttgctctctttactccaaccactgtggccttctttcacttcttttttttttttttttgagatggagtctcgctctgtcacccaggctggagtgcagtggtgcgatctctgctcactgcaagctccgcctcccgggttcacgccattctcccgcctcagcctctgcagtaactgggactacaggcgcctgccaccacgcccagctaattttttgtatttttagtagagacagggtttcactgtgttaaccaggatggtctcaatctcctgaccttgtgatccacctgcctcagcctcccaaagtgctgggattacaggcgtgagccaccgcgctcggcctctttcagttctttttacctgccacgcttcctctcaccaactgctctttgtccagaatgcacttacttctgtaagtttcaccctttcttcaaatctcagctcagttatggcttcctcagggctgtctttcttgacctctctgaccagggcaactctctaccatatggccctgggtacttctccttcaggtgctgatcacaactgtcattttatgtttcttggtgtcattttttggttgaaatatatttcccactgaatatgactccattagggcaggaactgtgcctggtttccggggcttagaaccagtacagtgcctagtgcatagtaagtgctcagtaaatgcatttgttgaatgaatgaacaaataaatacatcaataagtacagacgtttgttttctgtattcctttggctccttcttcttcttcttcaccctaccctttgtccaggccttgggacttcaaatcatggatttttttttttttcttgagtcagagtctttctctatcgcccaggctggagtgcagtggtgcgatctcagctcactgcgacctccgcctcccaggttcaagcgattctcctgcctcagcctcccgagtagctgggactacaggcacccgccaccatgcccggctaattttttgtatttttagtagagatggggtttcaccatgttagccaggatggtcttgatctcctgacctcgtaatctgcccgccttagcctcccaaagtgctgggattacaggcgtgagccaccgcacctggccaaatcatggatttggtttatatgtccagtgccaccactgggcctgcttcctattctgggtaatgaaatgtatgagatgctgagtagcttttggacacttcctttgtaatatattttgctctcctgcaataattttgttattatcagggttctattcaggagtacaggcttaggtaataagacagtgccacctgaggaagggtgctccttgacttagaacaataagataatgaaattggaggtaacttttggtaatcatttagtctagtttctcaagcaaggcagagattctttatgtaccacttctgacagatgataataatgtttattgagcatagtccagttattgtcttaaggatattgatacagatgaatccttttaatccttagcgaccatatggacaaatacagttactatcatgccctttttatagctgacgaaatagtggaatgcctcatctaagaccatgcctcgtctaagtcagtagcatagccaaggtgcaagcccaggcagtttggcagagccagagattttcactgctatgctatgctatgctgtgctgtgctgtgctgtgctgtgctgtgctgtgctgtgctgtgctgtgctgtgctatgctatgctatgctatgctatgctatgctatgctatgatatgccacttctgtagttagccaacggttatgtaaacacttccagggatgggaacccactcgatggtgagctgagtacttaggctaaaattgtctcctataacttcaagccgttttccctagtttcagcctctaaaactatatgaaatagcctgctccaatgtccataggacagttattaaaataggacagttattaaaatactttcaaattctaagagtagtttttctgttcataaaaataacatatgtgaaaatttggaaaatccagaaaagtataaagaagataagaacccttgataaactgggagaaaataagtattaactgccaagagtctattagctttttgttataatttttaacattcatatttcattaatggcccatataaaatctgtggcctaccaaaacacctagttctctgtcagatgaccttccatcaagccagattttgtctctatataaaattctctctctctgtctttttgtttgagacagagtcttacaggctgagtggtctttaaatcatggatttggtttatacatcctgatacaaagacagagtcttatagacagggtcttacagtcttacaggctggagtgcagtggtgcaatcttggctcactgcaaccttcatcccccaggttcatgcaattctcctgcctcctgagtaactgggactacaggcgtgcaccactatgcctggctaatttttgtatttttaatagagatggggttttgcaatgttggccaggctggtctcgaactctttgcctcaagtgatctgccttcctcggcctcccaaagtgctggatttacaggtgtgcaccactgtgaccaaccataaaattcttaatgtaaaattttacacttatcccttttaaattatatttatttgtttgttttgattcttctgtcttactgaaaacttttctaatccagattctgctttctaatgttagccttccagcttccaagatactatgtgatcttgataacagggcttttcaaacctttcccccaggcattgctaaaatgctaagccctgtgacacatactaggaacctccctgtaggttcacatgggtctattcgtcagccattaatttggccactgaagaaaatacaaatctgtataactgcattttcactgagcacatatatatttttttcaccttttctatgatgatttcatgacttaatgaaatatgtcaccaaaattgggtatgtttcatctatggaatttctcaactttactggtatagtaagtctttttaaaaataggatatcgttttcttagttagcttacactaactctgaataatcacttcttaatttctaagtgttcacaaatcattatctaaatattaatacttcattctagaactttcctggaaatcataccaatctgttacttcaactcttcactgcagttgaaatagctatgtgcagacatactggccctgactcacatttaatggggctgaagaaatgatcccgtgggtattctttctccttcaggagatcagcttcctgtcaacatacaggaaactgaaaagctgcagtctaataatatagccactgacaggaagattgttgtttagattgcctttccagatttctcaattgaataatgctggtgaaggatgactgcttattttatttatgactttggatcaactacaaggatatctgactttacatagtagatgtgctgcttcaatgatgcatataaaccactttttttgtaagtcaaattccacctaaaatgtactaatctgggagtttacttttaaggccatcttgtggtgagacattttataaagtgaagaattctttactgatttatctgtttgcttggattttaaagatcagggttgcttaaagcaaggtgaaattatactatttctttatttttagaaaaagtaggctagcattatcttttgtgaatgtcaccttgagcaaacaggactgggaagatcttggccaggcagcctgcaaatgagtaaaaaccagagcctccacgctaagccacattctcacctcgcaattctctgatgcactcctgccgatgaaggactgcttccgtgattgatattttttcatttttcaatatcctcaatcaatagctgaaaaagaattctatttactcatcttctctgagagtcctcctctcactcagctgtcagaggcagggcaggtggctccctggtgaggcttcagttatactttatgtgttcttcccttccttggattggagctgtgtgaaggccagaacctcagcttgttcacctctgtatctccattaaactagcccgagccttctgtgaaatgggttctcactacacattcatagactcaatgctgactcccaaacttgagctggaaccaactgcaggtgatatgatgggctcactccatctccaccaaggggactgcaacagtgtggagtgtgtgtgtcttagtctgttggtgctgctataacaaaataccatagactggatggcttataaacaactgaaacttatctgtcacagttctggaggctgggaagtccaagcccttccttggtgccaggagagtcggtgtctggtgagggttcacctttggttcatagatggcgctttttcactgtgtcctcacatggtggaagggggatggcagctctctcaggcctcttttctttttttttttgcttttttgagacggagtctcactctgtcaccaggctggagtgcagtggcgccatctcagctcactgcaacctccgcctcccgggttcaagcgattctcctgcctcagcctcccgagtagctgggattataggtgcccaccaccacgcccaactaatttttttgtatttttagtagagacagggtttcaccatgttggccaggatggtctcgatctcttgacctcttgatctgcccgcctgagcctcccagaatgttgggattgtaggtgtgagccaccgcgcccagcctcaggcctcatttctaagaagactactcccattcataaaggctgccctcatgatctaattatcatgaaaatgcctcacctccaaatactatcacattggtgattacatcttaacatatgaattttcggaggacacaaacattcagatcatagcagattggttttctggttcctaagattcccctccccccagaacttccacaacattctttgactctgaggctcactggcccttaacgaagatttcctttgagctatttgtgtgtatgtgtgtgtgtgtgctgtatattttatttatatacataaatagcctgcctaagtttcatgtttaataagtctccaggtgaggtactgaatcttaactctaacttcaatccctcaccctaatcctaacccctaactctaatcctgaccctgatcctaaccctagctctgaaatcccagagtctgggaaagtttccctattcatattcaaactttaataagtgtctgcttttcattatgaatattaccatgatcctgacgtaattaagataaccagaaactaataattaagataaccagaaactaaggcagacacatattttgtgtatgttgtgttgttcagtgagaattatactgtttagaatgagtagcctttggcaatgaaagagtcagaatattaaaatactttcagtataaatttcagtgtttagtacgcaactgagtgtcttaaggcaatgacaatctataaagaggagttcagctaaccttatcaattaattggagtagtcaattgatcaacactaacaccacaccatttgcaaataaagtgtgtttactttaaggcttgttctcttcctaaaggtttccagactctcatgatcctgatttcataggataattttatggacagcttaaaaaccaaataaatgaatctttagtataatcacaatcacttaaaactcccctctgcataataccccagctacataatttgatgggcttagtgcaaaaggaaaatgtggtgccgtcattataaagaattcaagatggtgacagcagatattaaaccaagtgtggggcccttctaacaatgggatcttctgagcacagtttgcacatccatgaccttggccctgcttaattacaggtgagggagccgaggtccaggaaggcacaacaaattgccgccatcgcacagctgatgagtcctatagacacagctgaaaacctggttcctggacccctggcccactgctctctcctgtctcagacttttcccaccatctggagtcaccatggggagacagtgggggtacatccccagtgctgtgagctggacattctatccttaatacatttctttagctgtttcaaccctcagcctgatttctttcctaaacccacacctgagcttgtttgcatgcagcttcttctcattgtcagcctgttctcttccactggttttcttggagactctggggagaggatttgcaaggtgctggtggaaagagctaattagggacattatgcagattggattcctctccttggctctcagtagcaatatattttttcacactgagtttctcctctcttcccatatcccaacatacactaatccctaagggcaagcctaaatgtctctggtaaaacagcctagagacaggcttctgaataggttgaatattattaaagaaattgcattttgagaatttctcaaataaaaaattcattactttaatccctgggaaatcagtttcccaatctcctgcaccaccttaattcatccccatcttgaattaaccatgtctgttgtgtgccagaattccgtggacttgagaatttgataaagaattctatttccttccttctccctaaaggcttgaggaatttagacccttttattgtgctagagtccccaaagcagagacattgcattaacttcagaatgtggcagagactgtccctttgagtagaaaatgttgctgctgtgagcttgctgtctatgctggcccagcctcatatctagcctacaggctggattttgagcttattaataaaattcgaggagggccagagaaacccttgattcaatgaaaataagagtagtgagttttaaaacaaaaaacggggaaaaatggaaagaaattcacatagtcccccacagcaaatgaagaaacaatgtcagatagatttgaacagaatcttataaagtcatttacagtccttctccttccccctcaaacttttagaatggactcaaagcccaagcccaagcccaagtcatcgacacaatattggtttcatactgtcaacaggcaacattcctgagagttctttgttctgacagtaagcactctggagacacacccagcaaatgaaagccacagtagagggtagatgaaataaagatacaaaggcatagatagacttcaataatgatataaaacaagctgcttaggaccaaatgcaaaatacagatgcacttgctatggcaaagaggagccgaatgacaggatcatgtcagttaaccaaggagggcttcctgcgagaggcattgttctaaacacagttttgaaggtaatctgagagaagggacctgcctagggaaaaagaaggagggcaatccctctgggattatctgttcaacaaactctgctttttctcttaatgattctgtttcatctgtcacacatatttttgctgtggtctaaataattcagaccactctgtctgcgtagatgtgatctctcaagaatccttgtttggctgtgcaggtgtttatagtttcactaaaaagtgtctcatttttttaaacatagagtgtgaatgtataatgtgcagatttaattctgggtaaaaatgccaagatgtggactacgctgcctccttctagtaattactcatttctgacaaaaaagtaggaggcttaatttacctctagggcaatttaaaaacactattgccagttaattcactcccaaccccgtttcccagacaggtttgtttttcctttcttctctcaatccttgttttaaaagttgtatgtcttttctgattcatggctgtgtaggcatttagtcaaagttagtctggataaagttaacactttcctctaaagacaaatatgttttgtctttctgggaatatgatacttagagaagagctgtagattacattctataaatgtggacaaattacatatgcattctatgcatgtctctatcagtaccttccccacgggtaagcgaaaaactttctgtatctattaaagcaggaatttagatcccattcatgggattataaatcgttaatcttcatggatccgatggacaaaatggtgggtgggggaacctcttgttgcttcatagaaccggatggctccacatcattttactaagaggacttaaaagttagtttcaaacagctgtcagaatgattcccccctttcttaaggcactcattagaaaataaaaccagatataattaacaaacaaacaaacctatctgcctgctgttctaacttgttataataagtgttatttctacttacaaacactatcctgtcagcatcatgctgtttctttaataagacttctgcactggggggaaaaaaggtttgcattaaacttaagtcttgacttgtctctattctattcttgctcatctgcattcagatccaatttgcttcgaggttgaaaggaactaaagtgtctaaaccatctccaagagagagaggagggacctttctgctcttacagttggatgaaggatggggctgccctgaggcttgcacagacacccttatttccttgctgttgggcctagatgacccctgtagccagcagagtaggcaaaaaccccttctgcttcctggcgttaattttccaggtgaatgacgatgttttcatatgcttgataagttccagaggctcatgtgagtggacagatctagagaggacttcggctccagagctcatctgtggtttggtaagagtggcaaactgaatgacaataattggagagttgctgaggtggcaaatacagcagcaaagataatgctatgtgatcgaaatgttaggggcttatggtttttcttctttggattcttaaaattagtttttttaattctggaaaacttcaaacatatacaaaacaagacaaaataaaaataatgaactctccccagatgcggtgcctcacgcctgtaatcccagcactttgggaggctgaggcaggtggatcacctgaggtcaggagttcaagaccagcctggccaacatgatgaaacccgatctgtactaaaaatacaaatattggcctggcatggtggtgcatgcctgtaatcccagcttactcaggaggctgaggcatgagaatcgcttgaacccgggaggcaaaggtagcagtgagccaagatcgcgccactgcactccagcctgggcgatagagcgagactccatctcaaaaacaaaacacaaccaaactatcatgccatcactcattttccgtaattattttctgacatcttgttaacctatatccctactaatttctccctcctgtattatttttgaagcaaattcaagacatcatatcatttaatctgtaaatattttagtttgtttttctaaaaattaaacacttctttttaaaaatgtaacaatatcacaaatacgcttaaaagtagttaataattaatttcttaatataatcaaatatactgtatttaaattttcagttgtctcataaacaaatttttaaaatagtttcatcatgattcaagtaaagtcctacaatatgactatttgatatgtttattaagtctttctttgccccttttcaaaataaactgtttattttggaataatcatagatttacagaaaagttgcagacacagtacagagagttcctgtgtacttttcacccagtcccccttatattagcatcttacataattactgcatacttgtcaaaactgaggtaatcattggtacattactattaactaacctataggctttattcagatttcactagtttttcccttgatgccactttttttccaattcaggagaccacaatacatttattaatagtcattatgattccttagactcctctgatttgtgcattagtcagtcttgtttttcatgagcttgacaattttgaagagttctggtcagatattttgtagaaagtctctcaatttggatttgtctgatgttctcttatgattagactaaggttatgggttttggggaagaataccactgattcttcgcatagaataaagtttccttctcatggccttgtatctgggggtacagagtacatatcaacatgactttaagtctctttaatccacctctctatctctatctctttctctttcttttttcctagtgcaagttactttctgagtcactcggggttttttggttgataaaagaaaaacttagctgggcacagtggctcttgcctgtaatcctagcacactgggaggccaaggcaggtggatcccttaagccaggagtttgagaccagcctgggcaacatggcaaaaccccatcgctactaaaaatacaaaaattaactgtgtgtgatggcacatgccagtaatcccagctactcgggacgctgaggcaggagaattgcttgaacctgggaggcagaggttgcagtgagctgtaatcgcgccactgcactccagcctgggcgacagtgagacttcgtctcaaaaaaaaaaaaaaaaaaaaccaagaaaaacttcaaccaagttaaatttaaaggagtttaattgagcaatgaacaattcgcgaatcgggcagcctcctgagccagggtaggctcaggggcgcagcgcagccacgtggtggaacaagatttatgaacagaaaaaggaaagtgatgtacagaaaatggaagtgaggtatggaaacagctgcattggttacagctcggcatttgccttatttgtacatggttgaactgttagctacattggattggccaaaacttggtgactggcacaagtgtaggctatggtctggttacacctccacttgttatagttcacaatgtacagaaaaacctttaggctgaacttaaaatatgtaagcagagagctttaggctgaacttgatttaacatggttttattttgtttttaacaaatagaggccatgatgactgtttaggctgagtaatggaggcctctgctccaagggcaggctgcttttcaaacagttgccatctcagtaatttttatccatttgcatctcacaacatcacaagacaggtttacataaaagtccaggttaccctgcaggctgcgtggtaacctttgattttaggttgatactggagagaaggtccgagaagaagccatccttaacaggaaatacattaaaaaaattctttgaaactggttcctgtgtcattgaaaggcttgggtaagaacacacacatggctgggcatggtggcccatgcctgtaatcccagcactttgggaggccgaggtcagcagatcacctgaggtcaggagttcgaggtcagcctgaccaacatggcaaaaccccgtctctactaaaaattcaaaaattagccacacctggtggtgggcacctataatcccagctactcgggaggctgaggcaggagaatcactggaacctgggaggtggaggctgcagtgagccgagattgtgccattgcattccagtctaggcaacagagcaagactctgtctcaaaaaataaaaaataaataaaaaggacatatatccatatcccctgtagaggtatgtattattgatattagaaagagaatacactgtcttagtccatttttgtgttagctgtgactgggtaatttgttaaaaaaaaaaaaaagaggtttatttggctcatgattctggtggccaaaaagtccaaggtggggcagctgcatctggtgaggttctcatgctgctttgactcatagcagacaatgaaaggggagcaggcatgtgcaaagagatcacatggcaagagaggaagcaagaggggaaaactgaagaagccagactcttttttaacagcctgtcctggaggaaactaatccattcacacaagaatgagaactcattcacccctgtggaagggcattaatctattcataagggatccaccccccatgacccacgactccctctaggttccacctcacaacattgccacattggggatcaaacttcaccatgagtttcagcagggacaaagcacatccaaaccataacatacaccaagacttcaggaaattcttataaatggacactggggatgattaaaatcttctgacattggctctgactaaccagagtcctcaagttttcacatggcaggataatagcacaagcaaaggaagaaaaaaaaaaaacacaattgtctccctcatgaccacagtgctttactttttcccgtgtgtctttgcctgtattacctaatgtcattgttgaagtacttgccttagtaggaagtatcacctttgctctgataaggaaactgagaaggctgagagaggtcctatagctttgtcagatggccagttatggctggaactggggttaggatacaggtgtccttcctttgcatgctgttgtcaggtaagattcaggcagatgccatccaggatcaacctttgaaggctttttgatatcaaaatatcaaacatctcaggatgaatgattaaaattagaatttaatggtatagccccaagcttctcatagtggacagctcaaatgttgatttggaagacttgtgctctaaatctggcttagtgttgctataccaatagataccttcaatagcaatcctcttttgttttgactactggggttcaggcagcagctctgatcctctcagcacatggtcttggtcaggaggatgaataactggccatgtcttattacaatttgttcctggaggtgctccttggcttccagcctccccagagcagggtcacacttggagcccacatagcccagcattctggagcagaatggtacttctgaatccagcccttggtagctctcatcataaatgtggaagcacatttgtaattgcaaaatatgcaaggcaaggggatggagagagaaaaaagagtgattcaccaaggctctcctgcaagaaaaatccagcattgaaacataccttgacatctcagatacaatgtctacttctggtaatgaagatgctgacaccagagtgctactgtgatggggtcctcttattaacagagccatgattgtaatatgggtgaaaagctcaggctaatgagggtgactttgaatatacccttggttttacaagaaggatctattgctctttccccttgcttggtccatgggcaggcagcggagtttaatgatgcttcacacacagtgtgcctccaccgtggtaaggcatttcaaggaaactctagttgggcttttgcattgttggaccattaatatttttaatggtgacaataaaagctggaagaactcaaatctcagcaagggttttcaagaggcagtataataatgaggcaagctgagccctgggtggtagggcctccaggttcttgctctgcccctggctggctctatatccttgatcttgccacttaaccctgctttctgagttccagaggaatgtgcaggtgaaactctccttgccctgccttgtgggtaagctttgagaaacaacagattgggagtgtagaaggtggggggagtttgaaagaaagagaaaaggggaaaacaggttacattttgaacacagaaattacttaataataagcagtgacagaatgcctacacagtggagttttgtagtcagagtgaagatttatttggcatttaaaattcgtttttttcagtgagcacaggctatttgagggagttgagagaaaggagaaaagggaaagaaatttaaaatgtcaagaataatctatgtagaggtttctaccaaaaattctactgatttacaactcttcctacttacaggaaacagatctttctattaggattattcacaccatggctgttttctacactgttgaatagcgcgaggtttcttcacccaccccatttccccaacaattgtctaaagctcaaaaagcaaagccatttagattgttggccctctgaggccttagaacaatgaatgacctaattttttccacaagtcctgttgctgagcctgtgtgtctcacctttttagctggcttatcttggggaccttatgaaactgtgtgcctaagaataacctagtgttttaaaaacaaatagactaagtcctgtgtgagcctctcatgaagggcatttctaattccctcttggaagcttgagcttggattggtcatcggtattttagggttatctgctgagtttagttttccccctaccctgttttgtcaggatcttgccttccctgaccctcctcatagttccagatgacatctgggtcatggcaaaatgtggacactctggtgaagccctgaatctggccagagaatgtggctctgcattcagcccagggtactgaaggttcctggctgggtgaggagaatcatgaatctcatgggagccagcagggttaaagttgcttctgcctctcacagaccaaactcagatcttgctgggctaaggggttaatacatctgaagtggcttaacaactacccccgctcagtatttcttgtccatttgttcttgaggatgctatctctgacgaatcctgactcgatctcctgggagagacaatgtgaggactgtagatacttacttggtcacacttctgtcatccgatgacggcctgtgtctgttcccattcctcaccttagtagacatctttgctcctagtcctttccagggtttatacccattgacagggcactttccttggtggttaaacattctagaagattcgttggtgacatcttggtcctgttttgaacaggtcttacacaaattccgtcttggttatacacttactatggacgtggcttggaatggaaagagcactggatggggagtcaggagatgggattctagtctccgctctgccactcactttatgacccaggaaatgctctttcagttccaagggtattatttttcttccttgtaaattgaggggttagtctactgctaagaggatctctaaaggcctatgcaaaaagaagtagaacattgatctggtgaaaaaggtgaacaacttgtagcgttctgcaagtatgctgtatgtttatgtgtataagtgccaacaggtctgagaaaaagaagatactgataaaagaaactgcttaactattctcatctctatgattgcatagaaatcagttatttgtaatggagttttgcctactcagtataaacaaggaaggaaaagtcttcctgtattggcctactgggtctaggcttctgaagaccaccagtggccattttatcacctgtaaatgttatcaagatagcatgtgagggctgcaaccatggggatttgtaagctgctggctattttttttttttttaacaatagtgatggtttaccaacatttattctttctgaaagttagctatacaaggctgttatttatttataagtgtaagataggaaaagagatggaaacagtgccttaaaccagatggagcatggacagatgctggccaagatatccttccactagtggcccttgcaggctaagcattcagcctccagggcaaaggcaggcaattatgttaaatcacgcaaaacagattggcagttcggtaaagcatgcaaaatggattgaaagtagcaagctacttaattgtcagtagtgatcccagacccaatggctgcagagataaagaacaaggattaactcttataatgtgccccactccttctaaaacacttttttgtggaaagcacaatacacacatttcagcttattaccattttccaattagtattaactcattagtacagcatgagtgagtttggaattttcagcccaacaatcatgcagtagcatgggggtcttcatacacctcctgtaatctcagcaaaatgtccaagattaccccctcctttgctttaattagaaaactggattgcaaatcagaataggaatataaaattgacttttgtctctcttactaattccgtcacctggaacaaggcacctagtctatttggaattcagtttctgcaacaccacctttttatgtttacatctgtaaagatgtccacactatattgttaggcagaagaagcaggtgataaataattcatttatgcattactccactttgctacagtaatcatgacccccccaggtctcagtggcttataataataatgtatttctctttcatatatatatatatatattcctcttttatacatatgttaatggctgcagtaatctgcatttcagctccttgtgtctgcttattctgggacccaagttgaggaagctgtctcctactcacagcagagggaaagagcaagagaactcagagaaacacacaatggctctttaaacttctggtctgtcgtggtgtatgtgatgtccactaaaagccattggccaaggcaagcagcatgttggccataatgatagagcagggatatatgttcttcccacagaaggcactccaagtcatttggcagctgaaggtttcattaattctcctgtaggagaggggagcaaatagttggcaatgataacatatcaaaatatatttacctgtcaatctagatatgcatagaaaacagtctgaaatgttatctatgaaaatattcttaggcaaaaagatttgaaaacatatgttcacacaaaatcttgtacatgaatgttcattgcagtgttactcatattagcccccaattggaaacaactcaaatgttcaacaaatgacaaatggataaatagaatgtggtgtgtccatacaatggcatgttgttcaggcataaaacggaatgaagaactgttacatgctacaatatggatgagccttgaaaacactgaaagaggtgaaaccctctttaaatgaaagagctaagtgaaagaggccagacacaaaagaccacatatagtatgactttatttttatgaaatgtccagaataggcaaatccacaaggacagaaaagtaggatgggtgcggtagctcatgcctttaatcccagcactttgggaggctgaggcaggcggatcacttgaggccaggagtttgagaccagcctggccaacatggtgaaaccctgtctctacttaaaaaaaaaaaaaaaaatagctgggcatggtggtgtgtgcctgtagtctcagctactctggagtctaaggcaggagaatcacttgaacctaggaggtggaggttgcagtgagccaagatcatgccactgcactgcagcctgggcaacagagtgagactctatctcaaaaaaaaaaaaaaaaaggaaaaaaaaaggtagattagtgtttgccagggactcaggggatgggatgggaagttattgctaataggtaggggggtttctttggagtgatgaaaaatttctggaactagataatggtgatagtcacacagccttgtgaatatactaaaacccccaaattgcacactttaaaacagtgaattttatggtatgtgacctatatctcaattaagaaaattctcagaagttgttggatatgggattgtagataattttcacttcttgtatatgttcttatgctgcctgcatttttatgatgagctagtattatcttcttattcagaggaaagaatgaagatattctaattgggaaagacacaacaatattagttatacaaaataaagttcccttgcacattcattaggatgcaatccatatgccttaatctcaagtacttgcaagttaaaattttgaaccatccttgagttaagcacttaaaaaatcatcgcttttctctataattaacctggagaagtgcaatagcaatgataaaaatatctgaaatcaggaaaatgtgaaaatgagatcagtaaagggtatttgtggttgacaccaatctatctcatagggaaaaatggttttccagagtcagagtcagaatcagtcagtagcacaacaacctccatattcttttttcttcccatggggaaaagtcaaaaccacagcttcatctcttagttctaccatcagaaaaattatgaacttaagtcttttggccaagggtcccctttcaattttgagtgaacatgagaactaatattctagtcaggaaacgtgtttttcagttctggattgtgggtggaagtaaaagacagagggatgggtgtaaggtggtccaggagaagtgagatgaagacccaggccagagtgtcaagttgacatcagagtgtgggatgtatttgtgtgggtagtagggactgatgagtctgagagggttagagttcagacatttagaccaaactgaaggctgcagacgcaacccaagcatctagcctacccacccagccgggattccttccttccaggatgcccctggattcaaagttgattggaggatcagtggtgagtgtcttttccatagttcttggtaagcaaattggtttttttttttttttttggtggagtcgggctctgttgcccaggctggagtgcagtggggtgatcttggctcactgcaacctgcacttcccgggtagctgggattacaggtgtatgccaccacacctggctaatttttgtatttttagtggagatggggcttcactatgttggccagggtggtcttcaactcctgacctcaagtgatcggtccccctcagcctcccaaagtgctgggattataggcgtgagccaccacgcaccagacctcagcaatgttaaaggaggtgagtaaacaataatgaaagagctgttagaagtccaacagctctataggcatgaaatatatcctactaaacaggcaaagcctctgcctgcaagagatttagagtaaaatatggcagatgtgagagaccaacatgcaatcagcagaaaattgatacttagaagagttgtacagaggtataggtgggtgcaagcacatatgtctagaaaggccacagttcaggttctttacaaatagcacatcgtaatgtaattgtcccacacattgcggttagtcacagttttgatctgaaaggtcaaatggaactaaaaaacaaaaacaaaaccaagcccgtgacctaacacaattctgttaaatgttctttgaccaggagcattcatacacgatgcagtgatgtagcctattactcacaatttattctttgaacaaggagagggcagagaacttgtcctcccttacaaccttggcaggaaaacactaagtcgtgctatgctcttcttaaagtgacttcctgaagaataaaaccaaatccaaaaacagcactgtggctcaggccatttttgtctggcattacccatataatattatgctaattctaatctgcaacacagattacattagcaagatgtagcaagaagcaatcaatgtttataaagtgtgttttctttttagccccacctgacactgtgccccagaggttgcataaacctgtaggtcgaacattagagatggtttaatatgctgccggaatgctgaagctctgcattatagtgctattgttaagcccagatattatgcaatggctcccataattttcccgtacctcataaagtgactttgtaaatatgcttaacatttttttgaccatcccaaagtgtatccagataataatgtgaatgcattccttgtttcacatctaaggtacaaatctttcgattttttttcttacagtttaattttcactgtggtaaagaacatataacatgaaatttaccaccttaaccattttcatgtgaagtctttagattttaaagctaatctgggaaagggcaactttcacagctgagggagtacatgctggttttattcaagcactttaaactgtgcctgaaacatagtaggctctcaacaaatgtatatttttaaatgactgaacgaataaaacacaattagggtatacagtgtaaaaattccctgcatactccaccctcacagtaggacaggttgtatgaaccaatcaccctttttctgacttctttggtaatgaatgactcatgaggcttaagtaaactgtgtgttttgtgaccacagatcagaattttgtgtgcatgaagctaattggcacaaaagtatcaaatctgtgatttctaagagcatttagtacctgccagatacacttgattaaatgggattgtgcttctttaatcatcagccactcctcaattcttgtgtaatcaaaccaacctcaaagtgtgggatgctgggactaatatggaggacagggaaggggacagggcagagtctgagaaggcgggctagcatcagagagcagagaggtagactgagcagaaggtctcagttaacatggaaacatctcagacagtagctttctgttagaactgcctgagaagctgtaaaaactaccttattcctgagcctttttccagatcaattaaattaaaatctcttgggtggtgggaagtagcggagtcaaaacacaggtattttaaatgctctatcaggcgattctgaagcgtgaccttgatcaagaaccctgttctgggttgttcagttagttctttatttgaatagagtgagatggattcaacctgtgaaaaccaattcagtggataacagtggtttccaaacttctctacacattggaaccatctggggagcttcaaaagccacctatgcctgggccccaccccagagactgcaattaagtgggtctggggtgtagcctgggctacagaattttaaaaacatccctagatgattctagtatatagacaggaaaggataaggtaaacatgatgcatgatggatgcactggataacaataagttaacttaagcataccatgagaatgaccctacggtctaagaagaatgtgtgttaggagttccgagctcaggaatccggaagtgaccaacctggcgattcattccttatatatgaggaacatctgaacccccaggccatacaggggattattgaggccctttgtttttggttaaatgaaggttgccaagtggaggttactaaggaaaaagtgctaagtgaaaacgcgacacaagctgcatgctttttacaaacagtagcagttctcctgttcagcctgctaccattggaccaccccgtatgtaagtcccctcaataaaccctctgtcttgttcactggctctaggtctaactcactggcctctcatacatggtactgtcccttttgaagtcagtaggggtcggggatgacacatggttagaaatgcaggatctttagctccatcctaggtttactaaaccagaacctgctttaaaaatccttgtggtggtaaaatacccataccaaagtttaccatcttaaccattttaagtatatagttcactattgttaagcacattcacattattgtgcaaccaatctccagaacacttttcatgttgcaaaagtgaaactctatacccactaaacaacatgtccctttccctgcagatcctggcaaccaccgttctactttgtctttataaatctgactattccaggtacctatgtaagtgaaataatacagtatttgtctttttgtggctggcttattccacttagcacaatatcctcaaggttcatccatgttgtaacatgtgtcagaatttctgtccttttaaagacggaattatattccattgtatgtatatacaacagtttgtttatcccttcacctattgatgtgcatttgggttgcttccacctcttggctattgtgaatagtgctgcaataaacatgggtattatatctctttaagaccctgctttcaatttttgtgtatacccagaaatggaattaaggaatcatatggtaattctatgtttaattttttgaggaactaccactctgttttcgatagcaactacactattttacattcccatcaatagtacacaagggttccaacttctctgcatgctcatcaacacttcttattttctgttaaaacaattttttaaaatagtagccgccctgcactttaaccagttctccaggtggtcatatttggttgaagttgggaagctgctttacagcccaggctggttttctggctggcacaatgcctccctcactgcacattctcccatatttaatagcactgattatggcattgccttcccaatgtttgtttggctttttatttttacataaataaccactatgacttgagcctgctcaatctccattctttgcacttgggctcagatctagtgggttgattttaatcacagctgagtgatgtgagtaatttgcccacacattgggaaagctgagttctgcttctgaggtccgagctggtccagtctctacaaagagacgataaaaaggaacagttcaagtagcacaaaataacgaaaaggaagcccaacctttacagttgcaaaacaattttaaaaggaatcaagactggaatgcctagcaacatttcttgaaaccccttccttctctccaaatctctccaatcaaatctctccaatcacagtgccctggagcctttcctacttctactcttccgtcttttctctccccttcctctccttcttggtacatctgcccaatctccctgcatagcaggccccctccttaggtctttaccttttcattctccaggactgcaacccaaagtcctggaagtgtccaggaaagctgcatactcccctgatggccagggaggcaccagcaggcagggaaagatagcatttactatgttggagaaaaggtggggactggaagcccttatctgctaatggctggcttgtgtatttgtcttctctgctgaactgtgagtttcttgtgaactccttgtcttaccccatgtgtatctttcaccatagtccagtttctgatccatggtatatgttcaggtgtgtgtgacagttaacttctcagtgacccatgaaactcagcttccagcatcacctaaggattatttgttcccttcttcccctgatgccatagaaataaagctttggccaggtgctgtggctcacgcctgtaatcctagcactttgggaggctgaggtgggtggatcgcttgagtctaggagtttgagaccagtctgggcaacatggtgaaacctcgtttctacaaaaaatacaaaaatcagccaggcatggtggcgcatgcctgtagtcccagctattcaggaagctgaggcgagaggagcgcttgagccctgggaggtggaggctgcagcgagccacgattgtgctactgcactccagcctgggtgacagagtgagaccccgtctcaaaaaaaaaaaaaaaaggaaaaaagaaagcttctcaagggccccagttgctcttgcagtctccagcatgtaggtgacattctcaccaggattccttgatgaggtgagaatattttgaaaatccagaaaccagcaggtccctttggaagtgatatttcactactgccttctcatccctaaaatcaatgcttgtttctggcccagagctgggtacagatcatctttcttatttgtaaacagtatatgctctaaatcagttcatcactatatacctctgctcctaatgacagatggcagcttttccttgtttttcctgctttaggacacagacattaatctgtggactaaacattatggaaagtgcactgaccgtcctccatagcacatgtgtgaccttgtcctgtggtcctcaggaagctgggccctaggaaataactttaacattcaccagcagaggaagctgtcaatattgcactgtttgcttaacttgtaacattgatcttctgtggctctgggcataacataataaggaaaataccacaacttactacagcaagtcaatgggctgataagataaacgctgttatgtttcaaaattgtgccaagtttatgttgataaagtgactttcttctgggaatctaaaaaacagtgcctatggttctaatcctgtatgactttaactttgtcttatatttacataagacaggaaattggcccaagatgacctcattcatctttataactcttctcctgaaggaatttatagtgagggtagtgttattattttttcactacagaggtgtagagagcttaagctttcagtcaaactaacaaattcagtattggttctagaaccaagagaaaaggaataggtctgcggctacggctacattaataataacaacaaacaaactttaaaaactgctattgtatggtaagaatgaggacatttttaaaatcaaagacagttgagtctcagactaaatctattcagtgctattggttagaattgacttgtcagttccatagaacaactttgtcattcagcctaaccatcactttgatggattttttttttttaaactttgaagaatgtttggttcatctactaaattgcatgtgatccagcagcatgtggaccatttcaattaaggtagtgtttctaatagcccttgagaaaaagaatgactctaaattcttgttcttgggtgtttattaatagaaaaggcccaaatatccccaactcctccattccacattcattgactgtgaattttgaggtggtccataattctgttaggaattttatttagctattagtacaggagacctggaaaactagtacttatacctgatagaagttcattttccctcacatgcaaaagaagtatagggaattgacgcagttcagaagcagaacacgaagatactgttcctgccaggtgaaagcaaattgcttatggtgttttagacttattggtatagagaaaaaaacagttgtaagcataactgcatactagatggccagagtggtatctccagtagagacaacgttaagaacagtagcagcaattgaagttactgattaagattttgataatccataaaatccatctgttcactgcacattttaagcaggtgagttaaatggagatgtaatagaaatcaccacttctgcagttttcattttttaaaattttatttctttaattgacaaaagttatatatatttatggtatacaacatgatgttttgatgtataaaattatggaatgaggtaaatcaagctaattagcatatgcattatctcatatattatctttttctgtggcaagaacacttaaaatccactctcgtagcaattttcaagtatacaatatattgttattaacttgagtcaccatgatgtacaatagatcgcttgaatttatgcttcctatctaactgaaattttgtatcctttgaccaacatctccccagtccccccaacccccagcccccggtaaccaccattctactctgcttctgtgagttcaacatttttaggctccacgtatatataggtaagaccattcagtatttttttttaaatgcctggcttattttactgaacataatgtcttccaggttcatccatgtttttgcaaatgccaggatttccttctttttaaaggctgagtggtatttcattgtgtatatatactacattttctttatccattcatctgcacatagacacttaggttgattctatatactggctattgtgaataaggctacaatgagcatgggagtccagatatctctttgacatactgatttcatttcctttggatatatactcagtagtgggaatgctgggtcatatggtggtttgcttttgattttgaggaacctcaatactattttctataatggctctactgatttacatttccaacagtagtacccaaggattcccttttctccacatcattaccaacacttcttatcttttatctttttgataatatccattctaacgtgtgaggtgatatcttactgtggttttaatttgcatttctctgatgttgaacatttttaaatatacctgttggccatttgtatatcttcttttgggaaatatctattcaggtcctttgaccatttaaaaatcaggttatttgtgttcttactattgagttgagttccatatgtattttgaatattaaccctttatgagatgtatggtttgtaaatattttctcccattccataggttgtctctttactctgttgattgtttcctttgcaatatagaagctttttaatttgatgtaatctcacttgtctatgttttcttttgtcgtctgtgcttttacaggtcatatccaaaaagtctttgcccagaccaatgccaatgagcttttctcttatattttcttctagtagttttaaagtttcaagtcttacatttaagtctttaattccttttgagttgagttttatatatggtgtgagataagggtccagtttcattcttctgcatgttgatgtccagttttctcaacactatttattgaaaagactgtcctttcctcattatgtgttcttggcatctttgtcaaaagtcaattgactacaaaaatgtggatttatttctgggctctctattctgtttcattggtctatgtgtctgtttttatgccagtaccatgctgttttgagttttataactttgcagtcaattttgaagtcaggcaacatgatgccttcagcgttgtttatttttctcaaaatttctttcactatttggaatcttttatggtttcctacaaattttaccttttttttctatttctgggaaaatgtcattggatttttgacagggattgcattgaatttgtaggtcacttcaggtagtatggacattttaataatgtcaattcttctaatccataaacatggaatatctttccatttatttttgtcttcttcaatttttttcatcggtgcttcatagatttcagtgtgtatatctttcatctccttggttaaattcattcctaagtattttatatatttttgtagctatcataaatgagattaaaatttttttggagagtttgttgttagtatatagaaatgttagtgatttttgtatttgatttagtatcctgcaactttgctaaattcatttattagttctaacagtttttttggtcaagtctttagggctgcagttttctttgataaggtcactaatatctagaattctcctaaaagtgtaatgttgcttttggtttactattttgttcggaaggggcagtcccagtagtgcttactttgggccaggaagccaatttgaggattctgctattacctgggtttatccattcaaactataaattaggaaatgggggaaataaccagagactggattcacagaaactctgtacccatcatgagatggacttagactcaaactctctatcactggattcccacaaataaggccctgttctgagtaggggaaacagtgatattctaggttcccagggattagtacaagttcaaagccatgttcaataatttgtgaaaggtataaatatttttccttctctagtacacagttaccttggtggatggatgctggtccttttggggaaggggtagaggaagattttcataggttcttgtgatgtccttcctcaaaggtcctccctttcattcactgaattgagagtgtgggtattgggagataggtcctgactctctagtgataatggaagtcaagtataatgatttaattctagattcactaggcctagaattttttcaattatacaggtcagctatgtcttttgcaggctgctcatctagttcatttttaggcatactgtgatcaattagctaccaccaaaagatccctgcaagtcaagttattttgctattacaataatcatagctactaggtttctggcagttaaatcccgctatttggtgtctgcccctctgggaacccataaactccactgaaaacagggaactaattccaatagcagtatctcccaccttcctctccagagtacagaataaattcatcaaagcattattcaaggattcttgttctcgccgcatcagtgtttttcttgatgacttggaaaaggcagtgttctctaggcttactttgggtatatgtgagatgttgtataagatatatttattccaacattcttatcactataagcctctagtcttagcatttcaacttctttcagcaataggccacagtggagtccaggtttcagtcaaccagccaagttaacaaccggctcaagctatgtagaatgaatccagaacctctggttagtttatctatgtcagtaatttgtgctataaaattatgtttttggtagaaattcaatatattctccaggtttttgcaaatattaattagcaaaatctttcaattcttctggtgtatgaatcttttccttctagatttgaattttaaaattggcctttatgggcatgttggaatctggaactatttataaatgtggaggaaataaaaggtcataggtgtagggtatgaattcctgtaggaagtaactgtctcaggtgaggtcattgtaaggcaagcttgtccaacccgcggcctgcaggctgcatgcagaccgggatggctttgatgagtgtggcacaacacaaatttgtaaattttctaaaagtattatgagatttttttgtgtgattttttttttttgagattaagtctagctctgtcgcccaggctggagtgcagtggcacgatcttggctcactgcaacctctgcctcctgggttcaagagattctcctgcctcagcctcctgagtagctgggattacaggtgtgcaccaccacagccagctaatttttgtatttttagtagagacggggtttcgctatgttggccaggctggtctcaaactcctgacctcatgatccacctgcctcagcctgggattacaagcgtgctgggattacaagcgtgagccaccgcacctggcattttgtgattttttttttgaaagcttatcagctatcgttagtgttagtgtattttatgtgtggcccaagacaatgccgcttcttccaatgtggcccagagaagccaaaagattggacgcccgtgttgtaagatctttaaccaacatcttcagattggagaggaggggctccttcttttggtaagggaggcataatggtgtttgagtgtgctgaataatccagttcctcctaaatgctttcactccaattcttttggcccattccttcccagtccctttcatgtgtgagatctagcaaggaccatgaattcagcctctattgaaattcagtaactggccagatttgactctgcatttgctctttggccatgacagctgtttggccttaagagataaaaattctttaagaggagtcctataaactctaacaatcccttccctaacaatcccttgatctgtgagtttaaattctttggccttttacttttccttcttttctttgtttgagacagggtcttgctctgtcacccaggctggagtgtgatggcacgatctcagctcactgtaacctccacttcctggactcaagccatcctcccacctcaccctcttaagtattaatagctgggactacaggtgtgggccacagggtttttccattttgcccagactggtctcaaattcccggacttaagtgatctgcctgcctcggcctcccaaagtgttgggattacaggcgtgagccaccgcgcccagccgccttgttcttttttaaagctcactgatgccaataaagtcagctatcctaacccatacttcctgtattccttagccccacatagtggcatattgcagcaatcaaaagggacgccaaactttggcttcagaaggcattttactccaaatgatcacaggtagtcatttaagaagctgttttaccacctggtataattactagtgtccaatcacctaatggtacccaaacactcacttcaaacccaaccaggtcagatagccaatccaagtttttcatgtttttgaaaactgttgtttgcaatcatttctgctatagttttcttaattggtcagagttccttaattgcagccaatgaattaactctggttactttaagcatgaaggaatttattaagggataaattattaaagaaacattatgaaggctgaagaaatagactccaggtgaactttcaggaataaccccattgtgcatttcagcattctaaaatggatttccaagggagttacagcatctgctatgatcagggggccaacacagctgctagttccaatctgtgctagaaatatgggtgccccatgccctgccttttctccatattacttggttctgaatatgtctaatatgtgtgcatctgttcagtgaaatctccatcacctactggcacctcagcacaagaaatgctgggaagtacagtttttagaaatttgtttttgaaaaggcaagatcaacaaagtgggaaactttcaaaatgttaagaaggtgttcaagatatttttgggcatctggtagacagggtagagaatagaaaaggggagagcaatagtaagctatttcttgggttgggtggtagacccacaagtagtcattactttctagtcttttataatgaatgtatgtattagtctgggttctccagagaaacagaaccaataaaatatatatttataaggctggacgtggtggctcacgcctgtaatcccagcactttgggaggctgaggtgggcggatcacctgaggttgggagttcaagaccacactgactgacatggagaaaccccgtctctactaaaaaatacaaaattagccgggcatggtggtgcatgcctgtaagcccagctacttgggaggctgaggcaggagaattgcttgaacctggaaggcggacgttgcggtgagcagagatcgcaccattgcactccagcctgtgcaacaagagtgaaactccatctaaaaaaaaaaaatctctctctctctatatatatagatatatatatatatccatctatctaatgagagatttgatttattatcaggaattggctcatgtgactatggaggctgagatgtcccaagagctggatacccaggagaagcaaaggtatagttacagtttaagtctgaaggctggcaaaaaccagtgctccagcttgaagacatgtaaaaagaaagaattctttcttacactgtctttagtctgtttaagccttcagtggactggatgaggccccactcacactggggcgaggtgaatctgctttactcagtgtacatactcagatgttaatgccatccagaaacaccctcaacagacacaccaagaatatttaaccgatttttaaccaaaatatttaaccaaagacacaccaagatatttaaccaaatatctgggcactctgtggacaatcaagttgacacatagaattaaccatcacaatatgttaccttctctttaatatacatcagcatacgtttctttggtaggagatattaaaaagattttggggcaactacaaatgacagatgtccactacaaaccgtaatccctttacttaagatattgatttagttcaagtgtaaaagcctgtggaaagagtagttctttaagttactattagtcatttgtaccttggttggaaggaagaatgaatggattagtaaatggagagagataatttaatctaaatatttgaggaataggtggtggtgagagcaccacttaggaataaagggaggaagaatgggaggttgagagctttaagacagatttttgctagttcacattttgattggaacagctctaactcctaacacctgcgtgagattgtttcctttttatttttttcactttaaaggctattggaattttcagatgcctaatggattatttcagatttgtcatgtatctatcaatattccaattttcattttataatatatgtgacagaactctgagttaaaacccattctcccaacctctctctggttatctgggcattagttcacacagattgaaagcacaagttgggctatctgcttcattatctgctgctatttatttcaatcctggattgaagccaccagtgagcagaatttgcatagggaactttattcaaatctaaagtttatgaataatgcagaactctctgtgactcatcaaaagcaatgataaacaaaatgcaaacagttggccaccctctcagcaatccagacagtggtcccacccctcacaaactgtgaatgacaatatttgaaggtagcaatggaaatcagtagtgttggtttatctttagcatcacccatatgtttactggcacacggttaagtcagaaaaatgagcacaagcaaagagaaaaaggtgttctgtctactaaggtatttaaagtcagcggaaatggaaagaccattccttatcccagtccacagagtgttccttctgtgaactgtttgcagttaatagattggaaacaacaccagctttgtagttagatagtcctgggttcaaatcctgtatctgctactcatgagctgtatattgggcaagttacctatgtttttgtctttttagaaacttagtgtcttttttcttttttaaaatagtataacagcaaacctttacttatttttccctttttattgatacataatattttacatatttatggggtacatgtgatattttgttacacatatagaatgtttaatgatcaagtcggtatttgagtgtttatatattgagtatttatcatttctatgtgttgggaacaattctagttctctcttctagttactttgaaatatacattgttgttaactataatcactctgctctgctgttgaccaatagaacgtataccttttatctaactgtatgtttgtacccattacctacctcttttcattcctttccccactcattcacctttctcagcctctagtgtctataaatctactctctttttttttttttttgagatggagtcttgctctgtcgcccaggctggagtgcagtggtgcaatcttggctcgctgcaacctctgcctcctgggttcaaataattctcctgctgcagcctcccgagtagctgggactacaggcatgtgccaccatacctggctaatttttgtattttgggtagaggcggggtttcaccacgttggccaggctgatctcgaactcctgacctcaagtgatccacctgcctcagcctcccaaagtgctgggattacatgcgtgaaccactgtgcccggcctctatcattctactctctacctttacaatatcaactttttaagctcccacatatgaatgagaacatgcagtatttgtctttctgtgcctggcttgtttcatttaacacactgacctctagttccatctgtgtttttgcaaatgacaggatttcattctttttattgattaaatagtattccattttataaatatacaccacattttctttattcattcatccattgatgaacactttggttggttccacattttcgtaattgtgaatagtgctgtgataaacctgtgagtgcaggcatccctttgaaattctgatttcttttcctttacatagatacccagtagtaggattgctgggtcatatggtagttctatttttaattttttttttttaatgtgatgggttcttgctctgtctcccacgttggagtgcaatggcacaatcatggcccactccagccttgacatcctgggctcaagggatccaccctcctcagcctcccgaatagctgggactataggcacatgccaccatgcctggctaatttttaaaaactttgtgtagaggtgaggtctcactatattgtccaggctggtcttaaactcctgtgctcgagcaatcctcctgcctcggccccctcatgttaagattacatgtgtgagccaccacacccagctatttttagttttttgagaactctcaatactgttttccacagtggttgcattatactagtttacatccccatacaatgtataagagttcccttttctccacatcctcaccagcataagtttggtggactctggtcctgggcttttttgttgttgttgggggactttttattactgtttcaattttgttgcttgttattggtgtgttcaggttttctatttcttcctggttcaatctagataagttgtatgtatctaagaatttatctattttttctctgggttttacagtttcttaatgtatagttgtttgtaatagtctctaatgattctttttatttctgtagtatcagttgtaaagccttctttttcatttctgattttatttatttgggtctttcttttcttggttagttgagctagcagtgtattgattttgtcttttcaaaacaccaacttttcattttattaattctttgtattttttaagtcactgtttaatttagttctctgatctttgtttcttcatttctagtatctttttttttttttttttttttgagatggagtcttgctctgttaccctggccggagtgcagtggcgcgatcttggctcactgcaacctctgcctccagggttcaagtgattctcctgcctcagcctcctgagtagctgggattacaggcatgcaccaccatgcccggctaatttttgtatttttagtagagacagggtttcaccatgttggccaggctggtcttgaactcctgacctcaggtgatctgcccgcctcagcctcccaaagtgttgggaatacaggtgtgagccactgcacctggtccatatctagtcattttgattttgatttgttcttgcttttctacttccttgaggtacattgttaggttgtccatttatagtcttcctacttttttcatgcacgtgtttattgctatgaagttccctgttagcaaagcttttcctgtatctcatagattttggtatgttgtatttctatttttatttgtttcaagaaatttaaaattttccttcttaatttcttcatcaacccaatgatagtttaagagcatgatgttttatttccgtgcatttttacagtttccaacattccttttgtaattgatttctagtttattccattgcgttctgagaagatacttgatgtggttttaatattaaaaaatttgtggagatttgctttgttacctaacatgtggtcaatcctggagaatattccatgtactaatgagacgaatgagcattttgcagctgttgaataaaatgttctgttaatgtctgttaggtacatttggcctaaagtgcagtttaaatccaattttttttgttgattttctgtttagatgatctggtctaatgctggaagtggggtgctaatagtccccaactattattgtattggagtctatctctccctttagatctaattatatttgctttatagagctgagtgttccactgttggggcatatatatttagaattattatattcttttgctgaattgatccttttattattatataacaaacttgtctctttctgtaggtattttttttttcaccctgtcacctagactgaagttcagtggcacaatcatggcttattgcagcctccacctcctgggttcaagtggttctcccaccttggcctcccaaatagctaggactacaggggcacccatgcccagataatattttctattttttgtagctatagggttttgccatattgcccatgctggtcttgaactcctgggcccaagcaatctaccctcctcatcctcccaaagtgctgggattacaggtgtgagccactgtggccaggctttttgcagtttttgacttaaagtctgttttatctaacataggtatagctactcctgttcattttaaatttctgtttgcatagaatatctttttccatttcttcactttcagtctatatctctttacaggtgaaatgagtttcttgtaggcagcatatagttgggttattaaaattcatttagctggtctatatattttaagtgggaaatttaatttgtttacattcaggattattattgataggtgaggacttactcttatcattctgttgttttctggttgttttgtatatcttgtcttcctctcttctgttattgtttatcattgcagtttggtagttttttgtagttgttacatttgagtcctttcttttatttatgtgtctgctctaccaacaagttttacatttttctatgttttaatgatggtagatatcatgcttttgcctcaagatgtagaactcccttaagcatttcttgtagggccaatctctatgggtgatgaattctctcatttatttctccttatatttttgaaaagtagcattgctgagtatagtattcttggttgacaggtttttcccccccagccccccgcccaaccccctgcccactgctttcagcactttaaatatatcatccataccattttctgctgtcctgtaaggtttctgctgagaaatctgttgttactctgatggagatttccttatatgtggcttgatgcttttctctgtctgtttttagaattctctttgtctatgacttttcatagtttgactgtaatatgccttggggaagaattttttgggttaaatttatttgggaacctttgaacctcttgtatgcaggtgtccagttgtcttgcaagtcttgagaagttttaggctattatatcattaaataagttttatatgtttttgcctacttccttttctgaaactccaaaactttgaatagttgctttatgatttcctatttgtcacataggctttctttctttacttctttctttctttctttaatctgactgagctattttttaaaaatttcagcttgagctagtctattgtcaaagctctcaattatattttttatttcattcaatgaattcttcagttccaggatttttgtgtgattcatttttgtgatatctatctttttttgaatttctcattcagatcatgtattgtttttctgatttctttgtattacttatctgtattctcttgtgtctcactgaatttctttaatatcattatgttaaattatttttcaggtgtttacgatttgctttttgttggattctgttgctggagaattattgtgtttctttggaagtgtcaagtttctttcttatgttttttttttggtctttacattgatatctgtgcatctagtgtaacagtcacttcttccaattttatggattagcttctggagggaaagacttttttctgtaggtgtgtctatggtgttggttgggtacggtgttttggctttgattatgggtgggcgcagtagtgtagtcttcctatgatttgtcagctataatcagtgtcaatgatgtctgtaagttgcacagtagcttaggctatggttgttaatggaggctgtggtcaggttttgctagggacaaggatgccaggagggctggtcctcaggcaccagtggtggtggtgggctgggtgtgttggtccttgggtttccaggtagtgtatgcaggcaccagttgtagtgggtccaggcaagctgattcttgggccttcaggtggctttcttgggtgccagcagtggtatcagtgggttcattaggtgatcaagtcctcaggcccctaggttgtgtgtgtggcatcagcagtggcagtagcagtgcaaagttaacccttaggcccccaagcatcacatgcgggtgcgagcagcattggcagtgagctaagcagaccccaggcccccagatggctcatatagaagggtgctgctgctgctgctgctggtggtggtggcaggctgggtaggccagtccctagtcctctaggagacatgtatgggcagcggtggcaggtggggtgtgcttgtcttcaggctccctgatggtgaacgtgaatgtcagtggcagcacgaagggtaggatgatccccagatccctaggcccctggatgatgtgactgggcactgacaggagtggcagtgggctgaacaggcctgtttttagagctcccagtggtgtgtgtgggcaccactgtggtgggccagttgggcccagtaacttgtcatctttcaactttggtctttttttagtaaaaaggcatagtagcatacttatttttaacactcagggttcttagttgtaagcaatagtacctgactgtggctgattgaacagataaagagctaattaaaaagattattgcctgtacaaagtagttgggagaggcaggcttgaggctaagcttctggggtcaaggcctgacactatgctgcagaagtgacccaataaagaagctgatgatcttgctttccctcagagcatgaaatggctgctaggacctcaaactctactgcagctctgccagcactgatacttctggaccaggaactgatcttacaacaactggttccccagaaaactagatgagcctgttaccacccttgtcagcaaatgagtcccaggcatcacgcccttcctctggctaattacttctaattaacttctaggttgggtacatcttagtggcagatcctgggcttcatgcctgtgttccaactaccaaggtctctagggaagcaaattttctgactttactctgaggacacaaaactcacaagatgggaaattccccgaacatagtaagatgcacaaaaggtgtgaggcagccagaaaatataacatatgttatctctccaagaattgtaaagactaagtgttatgtcaagtatttggcatgcctatgagttcaatatttttttgtttccttttctttttttctttatcagaaatatccattttatcatcaggttaaccccccagcctggcttttgcttaggtaggatttataaatagtgtggaatagagcctttcacccaggatgaggacacatggaagggtctccactttgtactgccaatccctggatggacctgacctgttggcttctgaccctagtccaccctaacccatgaaacctgttcattctttcctgtaatatttgaccttttgattcctacaccattggcttgctcatgaccacagcaacccactgacatccccctttccattttgtcttaatctcttggcacttagacttttagtttataatgaaacctgatagctgtttgattctttcctagctctgacttatgaacagcttacacagcattctcttattttgcataattattgaaggagagctactaagaaatatttggttgtatctatttctttttctttttagatttataaaataaattttctatctgtaatgaaagtgaagtgaagaaggtctgaagaggagataaagacaaagggaacagttaccaaatgttttccctattacttaccccagtgttctactcctcttcctaagaaatattcattgagactttatacagaaagggaaaaatcccccaaaccaaagccaaaacaaaacttgattgaagcagtaagtatctttcttactgacattttttccccccatactcttttaagacagcttctgctttctctttcatgaaaactaccctcactaagttgccaaaatttatttccaacttaaacaaaagggagcattcgcaacattatcagcctggtatctaactgctgggactctggactgagtgaatgccacgaggagctggggagaaagcagaatgatcatgttctaccatcatggctcagggagccaggaatgatctgtccatgattatttgttcaaattatcctaatatctctcagcttcacttggcaatctgggaaatgttctgctcagttggctggaaatgtcttcggaattctttaggcctgtctgtatcctggaacatgtgagttagaaaagtatacacaaatagatatgaaagatggttcttgttcagagttgtttcagtgcagtgactgactcttgggttaatggcaattgaagcaaagtcctattttatatcatggatctcctagagagagccaggaagttccaccataaaatgttgcaaagagtcaccagacatttcttgctcaactgaatgtctcaaaataaggcattattagaaaaagctggaggacatcagatcaaaacagctatcacatctttaagaaatgtaacttagagtgtggccccatccatttgcaacagtgggagaacacgacctagagtcaggccactttgaatcccagctctcctacttttagaagagcattttggatgagatattggttccactattatataatttctttgttttacaaaagcaaagggcacagttaaagtacaaatatattataccagcatccctttctagcatctacattaactaagattcattagcttctcggccataaaggtcctgaaagaatggaatagagagtggtaattctacagagggaaccgttgggaaatgcctagagtataataccatggaaatggcaattctagttggggtgcttaggttgtggtctcctgttgaccatgggacagcaggaggtcactggcatagccaaaatcatgccagggtactcaaagagaaatggaaggaagctctcaggcagacttcatctacggttaaattttgcctacacttggccctgctgagcatacttaggtaagcagcaggggaagcagcagtggcagatcagagaaagtattctgtggataggaatgggaatgaacagccagcatgttcctagctagttgatttcatgctgaaggtatccatgttcacagccctgttgaagaaggagatcccagacttgctgccaagtttcatcatggggcagtaaggaccttattctttcaggttcagtggttttggcccagctgcaggaataacttgtgcatggattggcaatagaaacaattggaaagctactggataaggaccaggtggatgcaaacctctctgcccctttaatatgtgtctggttgttggagggttggtctggttaattctggcaaatctgtctgtggggcttctaaacccagcttctgggagctcaaggaacctgcctgttcgccttgccctgggtctgttacaggttttatttatttatttatttacttacttacttattgtgagacaggttatgagactggctaatttttgtatttttggtagaggtagggtttccttatgtttccctggtcttgaactcctgggcttaagcaatccacctgcctcggcctcccaaagtggtgggattacaggcatgagccatcgctcctggccggttacaggttttaagaacaagttctaagaacagtctaagattttttggaacttcaatgctgtgttgagagcataggtgaaatatttccgttaatacactgtcataaaatagactggaaaaacaggaatgagctcttttattcaccaggttcaggaggggacacaggtcctgagaagggctgtgattttcccaagataacctgaaaaagttttccatagaagtggaaacttccaaaaaggaatgaaaaattaactatgggcatggttattacctctcatcatcaggcagagtttacgcagtaaactattgtcattaaaagggaacaaatatcttccacatgcttcagagtttaacccactgtacaaagaccatattgctaagacacaattttacataaattctggcagaaagccattttttttccagtttaatgcagccctagatttcatggaaataaagttttgtttgggagggatagtgatagctatttatgcacagctaattcttgggccctgaaatatagctctgtacttcctgtctttctaggctgaccatgactcactgaataagaatccttcaattattttgaaaacagctggctaactgcaatttttcttctgtccttccatttctgccattcatcagtgtcactttcaggcttgaaactggcttctctactagggtctctctttccgggcagcgcttggaggtacagccacagggcatgtccttgccctgtaatggtgcagttgttcctccccacgttgaagggagagccctcattccccatctcagatgaggcctccaagaaaaatgaaccaggtcaagactgcatctgggttgtggctgtgttttattggctaatcttttggctttttttcctttagataaagttgatcgttgctcatctttaattttcagtttttattttctcagcaagggtccattttgagcatcttctcttttaaccaagaaaggatagttctcttgcaaatcagatatctcattgttgacaaaaaggaccagatccttcctttttctccctcctcaaatgtctccctttcccagcataaacaagctgctttcatataaagacttgattggcactcaggagacatttgtttacttattcagtaaacacttatcgggggtttgccttaaggaaagggactgctatggtttgaatgatactgtcccctccaaaattcatgttgatcttcaatgtgacagtatgaagagttgtgacctttaggaggtgactgctctcatgaatgggattaaatgcccttataaaaggactcgatgcaaggatttcaatactctctcctccctttgtccctttcaccatgtgaagacactgttccttttttctggaggatgcaccaagatgccatcttggaagcatagaactcccctcaccagacaacagagccagctggtaccttgatcccagtcttcagagctgggagaaatacatttttgtcctttataaattactcagtctgtggtattctgttatagcagcgcaaatgaactaagaaggtgaccaactgcccactttacctgggactgccctggctttaggactgaaagttctacatcccaggaaacccctcagtttggggcaaactcaggcaattggtcactccaaccctaaatcaaacacagtctaggagctgggtgtgtaactgaccatgagcttcttaggcactgtgtgaccttctgtggttccacgttcttttctcacagaggaaagcataccatggtggaaagggcacttaattggaacctggaaccatgggctctggtctcagcttggccattaaagaggcaggggcttaagggcagatcactgagcctcagtttcctcctcgaagagtacaaacgttgggtttggtgttctttgactactttatcacccagagtctaaaggcgatgtagtaaaccaattcacactaattaatattcctaggtaagtgtgagtaggtcattagatatgttgacatttgctgatgatgctaatatttacaaagtcctcattctataccagacatatccattgtttaatttcatcttcacaacttttgatgtagatgcttcctttactttcatctacagatgggggactcaggccaagaaaggttacataatttgccccaaatcacagagaagcttatggatcaaagatcagaacctaggaggtctgacttccaaatccaaacttgaactgctgcgcccactggctagagataagtcaacagttgaaatgaacaggctaattgtttccccctcaaagcactggaaaaaggaaacagcagctatttggaatgagatttttgcatcctggtctgctaaagatcatggtcctgaaaaacagagcatggtatctgagaaattagtgttcttagtttatagaagggcccctccctgttctataggactagctaaagggtggtagaaccagattgagcgttagagcattctccatcccctacacctctctttccattttgggtaacttgaggacattctccacactccctgcaagatctgtaaagtactttaggtgctgttagcaaggttcagagggtcactaccagctgatcccactgcttctcactgttggcctgaaaaacaattccatttagatctggattgcctaaaagtttgtgtgtgtgtgtaaagggtgtagaaggattactactagacacgattcttctctttttttagaaagaataatttgaaatacaaacaaaataaggctgtggggtcttattcccagcagctggcagactttcacttaattaaactaccgtgattgctttattcatatattttgcttgcccccattctcttcctctctgactccttataaaaacaatactatttcatgaagggagaaattaaatgctgttagtctttaagaccaacactaattaacagcatttatttttactgtgattgcctacgtgaaagtatgcaaaagtaaatttatattctgagaatgtggttgctttggtctgaagcggtaaagggaattaactgttcctgggaactcatcattctttgcttgaaattctccagagagcagtgaaacaccagtgccaggggcagaatatagaaacaagggccgaatgctgtggccaattgagctgccagccaccagtatgatcattctcaaatccaggtctgacctactttctctcctgttgcaaaacctgagatggatctcctgcctgctgggtcaaggtgaagctcctcagcctggcatttaaaacattttgcagtctggctccctctctctccagccttatctccctgtactcaccactgcatgccaatgctccgattgtagccctgcccctcatcattctttttacatctctgtggctttttggaaatgactcccttttgttttaaggccttccacacccaccacacccgtgctacctggtgagtcttgtcatcctttaaattgaaggttggagcttgccttttctgtgcagcctgtctgaactcccccggcaaagttagtttctccctcccctgtgctcccacactactttgcatatttttatcagagcatttatcacaatgtattgtaatgttattggcatggctgtctccttcattaaactgtgtcctatttattcttgttatccacttccaatttcagggtctggcacaatcctgtcacatagaaatacttaatagatgcttattgaatgactgaattatggctgttattatatgtcaattaatatttactgtgtgtttactatgtgcaaagcctcatgtgtgctgtgtttgcctgtgtattgagaaagggagagacatatgtaatgtgggtcacagtcctaaagaaacataaaattctgtgtgagacaaaaaattaaaaagcaaagcagaaggacctaaacattatacctagatacaggtatagtcaaccctccacatctgtgggttccacaaccatgggattccacatccgtggattcaatcaactgttggtccaaaatatttggggaaaaaatggttggttgcatctgtactgaacatgtacagactttttccttgtccttattccctaaacaatacaggatagcaattatttacatagcatttacattgtattagctattataaggaatctagagatgattcaaagtatacgagaagaggtgtgtaggttatatgcaaatactactgttatcgggaaggggtcctgattcagacgccaagagagggttcttggacctcgtgcaaaaaagaattcagggcgaatccatagagtaaagtgaaaacaagtttattaagaaagtaaaggaataaaagaatggctactccaaagacagaacagtggcttgggctgctcgcttattatacttatagttatttcttgattatatgctaaacaatggatggattattcatgagttttccgggaaaggggtgggcagttcccagaactgagggttcctgccctttttagatcatatagggtaacttctggacattgccagggcatctgtaaattgtcatggagctggtggaagtgtcttttagcatgctaatgtattataattagcatataatgaacagtgaggacaaccagaagtcactttcatcaccatcttggttttggtgggttttggccagcttctttaccgcaatctattttcctgttttagcagtaaggtgtttgtgacgtgtgtcttgtgccgacatcctatctcatcctgtgccttagaatgtctaacctactgggcatgcagcccagtaggtctcagccttattttacccagcccctattcaagatggagtagctctggttcaaacacctctgacactgctgtattttataaaaggaacttgagcatccatggattttggtatgggcagggggtcctggaaccaattccccatgaaaactgagagacaactgtgtatagttatgaaagcatggaagaggggagagtcatttgaattggggttggggcaggagggcagcatcacaaaataggtggcatagggtttgatggatatagaaatagtggaggggagagggaatctagattgaggaaacagtaggaacaaaggcatgaagataaaggcgtagtaatttccatggaacaaaagggctggagagttctggtctcaccataactagggagattgcatacttttaaaaaatctgaaataaatcccattaatatcaataagtacattttccctagttgcctatatttgcatcctctaagcaggagtggtgattaatcatctccaaattgctcaaggatatgaaacagggtgctcataagtctttagcagcaggaaatgcctgttgcaaataaactatttacaatttactttgtgagcatcatttctgttgggactgtgcagcagataacaacagtaggtgttagcccagtcttaacagaaacacaaagaaaatgtttgtgacaaccatttcctatatctatatatataaaaaatacattttttttttgagacggtggattcttgctctgtcactcaggctggagtgcagtggtgtgatctcggcttactgcaacctccgcctcccgggttcaagcaattctcctgcctcagccttccaagtagctgggactacaggcgtgtgccaccacacccagctaatttttgtatttttagtagagatggggtttcaccacattggccaggctggtctcgaactcctgaccttgtaattggcctgccttggcctcccaaagtgctgggattacaggtgtgagccactgctcccagtgtgacattttttttttcttttagagacagagtctcactctgttgcccaggctggaatgcaatggcacaatcatagctccctgcagacttgaactactgggctcaggagatcctcccaccacagcctcccaaatagctgggactataagcacatattgccataaccagctaaataaagtttttttttttttttttttttttttgtagagaactgtccttgccacattgcccaggctggtcttgaactcctggtctgaaggaatcctcccacttcagtctcccaaagtgctgggattacagacgtaagccaccatgcccagcccagttttaggcttttaacatatacccagaaagcacaaagttgattaataatttacactacagttatatttttaaaattaaaagaaacaaccctaaaatgtggcccttagtatttcttttctttctttttttttaatttttgagacagagtcttgctctatcgctcaggctggagtgcagtggcatgatctcagctcaccgcaacctctgccccaccggggtcaagtgattcttttgcttcagcctcccaagtagctgggattacaggtgcacgccaccacgcctggctaatttttgtatttttagtagagacggggtttcaccatgttggtcaggctgctctggaactcctgacctcaagtaatccacctgcgtggactcccaaagcgctgggattacaggcgtgagccaccatgcctggctcagtatttctttatgaaaataaaatattaaaaaatcaaatataaatgctataaatgaaccaaccaggaattgtacatggtcagtttctaatttcaggatggaaggcgttgaatttgctgtcatttatgttaaaaacttgtaaactttaactcatggatccaccattattaacaatattcataaagtccccagtgtggcttgtataaagtatggcttgtataatgtgaggcttgtcaaagcactattacataggcattgttgctacattatgggtgcaatcattttattttatcttattttatttatttatttgttttttattattctttaagttctagagtacatgtgcacaacgtgcaggtttgttacatatgtatacatgtgccatattgatgtgctgcacccattaacttgtcatttacattaggtatatctcctaatgctatccctccccctctccccccaccccacgacaggccccagtgtgtgatgttccccttcctgtgtccaagtgttctcattgttcagttcccacctatgagtgagaacatgtggtgtttggtttttggtccttgcgatagtttgctgagaatgatggtttccagcttcatccatgtccctacaaaggacattaactcatccttttttatggctgcatagtattccatggtggatatgtgccacattttcttaatccagtctatcattgatggacatttgggttggttccaagtctttgctattgtgagtagtgctgcaataaacatacatgtgcatatgtctttatagcattatgatttataatcctttgggtatatacccagtaatgggattgctgggtcaaatggaatttctagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatgggcagtgatgatgagcattttttcatgtgtcttttggctgcataaatgtcttcttttgagaagtgtcccttcatatccttcacccacttattgatggggttgtttttttcttgtaaatttgtttgagttctttgtagattctggatattagccctttgtcagataagtagattgcaaaaattttctcccattctgcaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagctctaacgtttaagtctttaatccatcttgaattaattttttgtataaggtgtaaggaagggatccagtttcagctttctacatatggcaagccagttttcccagcaccatttgttaaatagggaatcctttcaccatttcttgtttttgtcacgtttgtcaaagatcagatagttgtagatatgtggtattatttctgaggactctgttctgttccattggtgagtatctctgttttggtaccagtaccatgcagttttggttactgtagccttgtagtatagtttgaaatcagatagcatgatgcctccagctttgttctttaggcttaggattgacttggcaatgcaggctcttttttggttccatatgaactttaatatagttttttccagttctgtgaagaaagtcattggtagcttgatggggatggcattgaatctataaattaccttgggcagtatggccattttcacgatattgattcttcctatccatgagcatggaatgttcttccatttgtttgtgtcctcttttatttcattgagcagtggtttgtagttctccttgaagaggtccttcacatcctttgtaagttggattcctaggtatttgattctccttgaagcaattgtgaatgggagttcactcatgatttggctctctgtttgtctgttattggtgtataagaatgcttgtgatttttgcacattgattttgtatcctgagactttgctgaaattgcttgtcagcttaaggagattttgagctgagacaatggggttttctagatatacagtcatgtcatctgcaaacagggacagtttgacttcctcttttcctaattgaataccctttatttctttctcctgcctaattgccctggccagaacttccaacactatgttgaataggagtggtgagagagggcatccctgtcttgtgccagttttcaaagggaatgcttccagtttttgcccattcagtatgatagtggctgtgggtttgtcataaatacccattatttttagatacgtcccatcaatacctaatttattgagagtttttagcatgaagggttgttgaattttgtcaaaggccttttctgcatctatggagataatcatgtgttttttgtctttggttctgtttatatgctggattacgtttattgatttgcgtatgctgaaccagccttgcatcccagggatgaagcccacttgatcatggtggataagctttccaatgtgctgctggattcagtttgccggtattttactgaggatttttgcatggatgctcatcagggatattggtctaaagttctctttttttgttgtatctctaccaggctttggtatcaggatgatgctggcttcataaaacgagttagggaggagtccctctttttctattgattgtaatagtttcagaaggaatggtagcagctcctccttgtacctctggtagaattcagctgtgaatccgtctggtcctggactttttttggttggtaagctattaattattgcctcaatctcagagcctgttattggtctattaagagattcaacttcttcctggtttagtcttgggagggtgtatgtgtcgaggaatttatccacttcttctagattttctagtttatttgcgtagaggcgtttatagtattctctgacggaagtttgtatttctttgggatcagtggtgatatcccccttatcattttttattgcatctatttgattcttctctcttttcttctttattagtcttgctagcagtctatcaattttgttgatcttttcagaaaaccagctcctggattcattgattttttgaagggtatttttgtgtctctatctcctttagttctcctctgatcttagatatttcttgccttctgctagcttttgaatgtgtttgctcttgcttctctagttcttttaattgtgatgttagggtgtccattttagatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagaggttttgagtgagtttcttaatcctgagttctagtttgattgcactgtggtctgagagacagtttgttataattactgttcttttacatttgctgaggagtgctttacttccaagtatgtggtcaattttggaataggtgcagtgtggtgctaagaagaatgtatattctgttgatttggggtggagagttctgtagatgtctattaggtctgcttggtgcagagctgaattcagttcctggatattcttgttaactttctgtctcactgatctgtctaatgttgacagtggggtgttaaagtctcccattattattgcgtgggagtctaagtctctttgtaggtctctaaggacttgctttgtgaatgtgggtgctcctgtattgggtgcatatatatttaggatagttagctcttcttgttgaattgatccctttacgcttatgtaatggccttgtctcttttggtcttttttgatttaaagtctggtttatcagagactaggattgcaacccctgcctttttttttgttttccatttgtttggtagatcttcctccatccctttattttgaggctatgtgtgcctctgtacatgagatgggtttcctgaatacagcacactgatgagtcttgactatttatccaatttgccagtctgtgtcttttaattggagcatgtagcccatttacatttaagcttaatattgttatgtgtgaatttgatcctgtcattacgttagctagttattttgctcattagttgatgcagtttcttcctagcattgatggtctttacaatttggcatgtttttgcagtagctggtaccggtttttcctttccatgtttagtgctacctctaggagctcttgtagggcaggcctggtggtgagaaaatctctcagcatttgcttgtctgtaaaggattttatttctccttcacttatgaagcttagtttggctggatatgaaattctgggttgaaaattcttttctttaagaacgttgaatattggccccactctcttgtggcttgtagggtttctggcgagagatcagctgttagtctgatgggcttccctttgtgggtaactcgacctttctgtctggctgcccttaacacttttttccttcatttcaactttggtgaatctgacaattatgtgtcttggagttgctcttctcgaggagtatctttgtggcattctctgtatttcctgaatttgaatgttggcctgccttggtaggttggggaagttctcctggataatatcctgcagagtgttttccaacttggttccattctccccatcactttcaggtacaccaatcagaggtagatttggtcttttctcatagtgccgtatttcttggaggctttgtgcgtttctttttattcttttttctctaaacttctcttcttgcttcatttcattcatttgatcttcaatcactgataccctttcttccagttgatcaaatcggctactgaagcttgtgcattcttcacatagttctcgtgccatggttttcagctccatcaggtcctttaagaacttctctgcattggttatcctagttggccattcgtctaatcttttttcaaggtttttaacttctttgcgatgggttcagacttcctcctttagctcggagaagtttgatcatctgaagccttcttctctcaactcgtcaaagtcattctccatccagctttgttccattgctggtgaggagctgcgttcctttggaggaggagaggcactctgatttttagaattttcattttttctgttctgttttttccccatctttgtggttttatctacctttggtctttgatgatggtgacgtacagatggggttttggtgtggatgtcctttctgtttgttagttttccttctaacagtcaggaccctcagctgcaagtctgttggagtttgctagaggtccactccagaccctgtttgcctgggtatcagcagcggaggctgcagaacagcgaatattgctgaacaacaaaggttgctgtctgatcgtttctctggaggtttcatctcagaggggttccctactgtgtgaggtgtcagtctgcccctactttggggtgcttcccagttaggctactcgggggtcagggacccatttgaggaggcagtctgtccattctcagatctcaaactccgtgctgggagaaccactactctcttcaaagctgtcagacagggacatttaagtctgcctaggtttctgctgccttttgtttggctatgccctgcccccagtggtggagtctacagaggcaggcaggccttcttgagctgcagtgggctccacccagttcgagcttcctggccgctttgtttacctactcaagcctcagcaatggcaggcacccctcccccagcctcgctgccaccttgcagttcgatctcagactgctgtgctagcaatgagtgaggctctgtgggtgtgggaccctctgggccaggcgtgggatataatctcctggtgtgccgtttgctaagaccattggaaaagctcagtattagtgtgggagtgacctgattttccaggtgccgtctttcacagctttgcttggctatgaaagggaattccctgaccccttgcacttcctgggtgaggcgatgccttgccctgcttcggcttacgctcggtgcactgcacccactgtcctgcacccactttccgacactccccagtgagatgaacccggtaccgcatttggaaatgcagaaatcacctgccttctgtgtcgctcaccctgggagctatagactggagctgttcctattcggccatcttggaactgtgcccccgataactgatcatttttagactcttctgtgttcatgccttcaaggacttgcagatgtcagaataaagataaccaactgacaatgatctcttgcatttcctccttacccttttcaaataaacattacctttaccttctttttaaaattctatcaatattggcagggcgtggtggctcacgcctgtaatcccagcactttgggaggccaagatgggtggatcacgaggtcaagagatcgagaccattctggccaacatggtggaaccccgtgtctactaaaagcacaaaaattagctgggcatggtggtgcgcacctgtagtctcagctactcaggaggctgaggcaggagaattgcttgaacccgggaggcggaggttgcagtgagcgaagatcacgccactgtactccagcctggtgacagtgtgaggcttagtctcaaaaaaaattatatcaatattaatgtcctgatttttattgatatataatagttgtacatattttgggggcacatgtgatattttgatatatgtatacaatgtgtaattatcaaatcagggtaattgggatatccatcacttcatttatctttgtttgtattgggaacattacaatttttttcttttagcttttttgagatatacaataaattattgttaactataatttccctcccatactattgaatgctatgacgtatttcttctatctaactatatttttgtacccttaaccaagttctcttgttcccctctcccctcttcctttctcagcctctcataaccacagttttactctctatctccatgagatccaggttttagctcccacatgtgaataagaacattgtctttctgtgcctggcttattcacataacataagatcctccagttccatccatgttggtgcaaatgacaagatctcattcttttttaacggctgaataacattccattgtgtatatacaccacattttctttatccattcatccactgatggacacaaaggttgattctatagctttgctattgtgaatagggctgcaataaacatgagtgtacagatgtttctttgatatactgatttactttttaaaaatatgtatccagcagtcgaattactgtatcatatgttctatttttagttttttgaggaaccttcataccattatccataatggccatactaatttacatttctacttacagtgtatgagcattcccctttctccacacacttgccagcctctgttttgtttttgtttttgtttttttgtttttgtctttttagtaatagccattctaatagatgatatctcactgtggttttgatttacatttccctgatgattaacgatgttgggcatttttttgtatacctcttggctatttgtatgtcttcttattttttacttaaaaattttttttccttttttttgtcttagttcattttatgttgcttataacaccatttgtatgtcttcttttgagaaatgattatttgggtcttttgaccattttaaaatcagagtatttgtttttgctttttgctattgatttgtttgagtaccttatgtattctggttattaaccttttataggagagattgtttgcaaatattttctccattctgtgggttgtcttttcactttgttgactgtttcctttgctgtggcagaagctttttagcttgatataatcccatttgtctctttttgctttagttgcctgtgcttttgaggtcttatgcaaaaaatctttgcccagaccaatgtcctggagcatttctccaatgttttcttctagtagttttatagtttcaggtcttatgttttaacctttaatccattttgagttgacttatttacatggtgaaagatggggatctagcttcattcttttgcatttgcctttcagttttcctagcaccatttattaaagacactgtcctttccccgagggatgttcttgccacctttgttgaaaatgagttggctgcaagtgtgtggatttattttggggtctctattctgtttcattggtctattccctcattttccctttttcagtttttcatagcccggtgaagtaaatagagcatgaaaaatgatcctcactttataggtgaaaaaatcaaaaggcagaagtgataaataaatcacttacactcacacaactggttgttgccatggagagagccagaactcttgccttctgacatcttggctgttgctgcactatggtgctcatgaataaatttacctcatatagagtgttgtagagatgggagcaagagtaatatgattgccatagagatcagtataagaaaggatgccaatttcatgatagaggggaatgactcggagaaagcctttagttcacctctaaggaccaggcccactagcatggatatatctgatgttcatgcagtggacatattcccactaaaatttgaatttaaaaatctccaggtgtttcataggtaaccaaatagcatcacatttccagggcagaagacaataacagcaatcatcaggaatgcctgtggaatgctcagtctggaccaggtgctgcattaagagctttgtacccatcatgtcctttaataactaccctgtgaggaaggtactaggactgttcttgttttacagctgaggaaatcgaagcttaagtggtttgtcaaggtcttaaaactaataaaccacagagctgagaatgaacccgagtagcctgtccccaaatcccatgtgtttccacgacattatttccagctcctgcgtatcaactgtaatgtctgtgaggcagaggaatgtggggtggacctgacccttaagattgagttcagtggttagactgcatctgagaaggcagattccagcggggcagcctcagtaaaaggagcctggcacccaccaaggcttttctcctgcggcctctcctgtagtgctctgtctcaacagacaaatctgttggtaaatggcagcagagtgtcaaggaacaaactatgattttcttacccctctttccctcttgttgttcagaagtttatttctgcttgttggttccttttcagaagtgattttctagatcttgatgtggtcgccagtagaattaggtttccatcttcctgaatttttaccatgttttctaactttagaagactcactgcttctgaagagacaaataaaatattccttagacatgggatgtgtagagccttctctcagtggagtgtgctttctgttcatcccacgtcctgcctcagttcctaaagcataggtgagaagcaaagccagcggttctcctgagaacccatcatttgttctctagtgacctgattcattccttgtgactctcaaaaatgctatgcagcagccctttgaaatgaaatgcttttctattgaactagaaaataatcacatcctcccatttactctttagggtacaaattgatctgacttgatttgtcagagagccagaactgcaggcaaatagacgccagagaaatcaaccaatcttttaagccagcagtaattgttcctcctgtcggctggctaaatgacttgtatctggaggagacgctcagaatgaatcagaatgcttgaggtgacagaaacacagagcattccaaagtgggctgtaacagagtgagtgtttcttcatgtcttacaagagtttggtttcatgttttttcccctttccctcttattctgtctcctggggctagtgttatctggcagagaccaagctgaagcatgtatataatagcaaggaatagtagtttgtgtggggatgaggggaggtgagtactagtatttaattctagaatatacttacctgtatctcagtcattaaacccaggaagtccctatagaataggtaccacccaagagggggtaaaatccctttgctggtgagctgtccatcatttttttttttttttgagacagagtctcactctgttgcctaggctggagtacaatggcacaatctcagctcactgcagcctccgcctcctgatgagaggtgacagcgtgctggcagtcctcagagccctcgcttgctcttggcacctcctctgcctgggctcccactttggcagcatttgaggagcctttcagcccaccactgcactgtgggagcccctttctgggctggccaaggctggagcccactccctcagcttgcggggaggtgtggagggagagacgcgaacgggaaccggggctgcgcacggcgcttgcgggccagctggagttccgggtgggcgtgggcttggagggtcccgcactcagagccctgctggccccaggcagtggggggcttagcacccgggccagcagctgcggagggtgtactgggtcccccagcagtgccagcccaccggcgctgtgctcgatttctcgccgagccttagctgccttcccgcagggcagggctcgggacctgcagcccgccatgcctgagccttcccctgcctccgtgggttcctgtgcagcccgagcctccccgacgaataccaccccctgttccatggcgcccagtcccatcgaccacccaagggctgaggagtatgagcgcatggcgcgggactggcaggcagctccacctgcagccccggtgcgggatccactgggtgaagtcagctgggatcctgagtctggtggggatgtggagagtctttatatctagctcagggattgtaaatacaccaatcagcaccctgtgttcagctcaaggtttgtgagtgcaccaatcgacactctgtatctagctgctctggtggggccttggagaacctgtgtgtccaaactctgtatctaactaatctgatggggacgtggagaaactttgtatctagctcagggattgtaaacgcaccaatcagcgccctgacaaaacaggccactaggctctaccaatcagcaggatgtgggtggggccagataagagaataaaagcaggctgcccgagccagcattggcaacccgctcgggtccccttccacgctgtggaagctttgttcttttgctttttgcaataactcttgctactgctcactctttgggtccacactgcttttatgagctgtaacacgcacggcgaagatgtgcagcttcactcctgagcccagcgagaccacgagcccactgggaggaaggaagaactccagacgcactaccttaagagctgtaacattcaccgccaaggtctgcagcttcactcctgagcccagcgagaccacgaactcaccagaaggaagaaactctggacacatctgaacatcagaagggagagagtccagacgcgccaccttaagagctgtaacactcaccgtgagggtccgcggcttcatttttgaagtcagtgagaccaagaacccaccaattccggacacactgggttcaagtgattctcgtgcctcagcctcccgagtaactgggattacacgcatgtcctaccccgcccagctaatttctgtatttttagtagagacaggctggtctcaaattcctgacctcaagtgatccgcctgcctcggcctcccaaagtggtgggattacaggcatgagccactgcgcccggcccctttgtttttaaattaaaaaaaaaattgaaatagtttgaacatacaggaaaactgcaaaatataatttacactcatgtacaaactacctagatttaagaggtactatcttgtcatattagcattggttctctttttttttcttccttcttccctctctccctcttttcttccctcctttccttcttttgaaacaaaatgttgcagtatagctaaatgtccattcttttatcacattgttttatttatttgtcttcctttccagagggagctgatatcataaggttagaatttatctttcttgttcattaaaattaccttatatatatgcagaaataatatgcagtgctctttgggggttggtttttaatattaacttatttggtgtattttatatgtgttcttttacatcttttttacatatgatgttttgttgggatttttccatgctgatactaataggtctagtacgattgttttaactgctgcattgaattgctttatatgactaaacccaactttatttaactttactgttatgaacatgttttttcctactacaaacaatgctgcaatacttgtgaggtctcttcaggcccaggggtaaggttttttttctacagggtatatatttaagagcggaattgctgggttacaaaattggcttttcttcaactttactagctgttatcgaattgttaaactgtgcacttaaaaatagtttatacaacatccccctaaaggatagaccaaaaaggaataagatgtaggaactgaatagcaaaaagatgtaacaaaaaaactagttcagtaaagcacattatgtttattttctgtaacctggtccatgatatttatggtggtatttcctttcttgaaataagacactaatgcaatctgtatcctaattgagataaaatagtgcctgaactaccatctctatactattccactataaatagacaaagcaagtagctgggtaagaactcctaagttatccctctgagccccagactttcattccataactttatcttcaaacttagttgcaatatgtgcccaggatgggaaagtagcttcattttgcaatcatctatgaaatctgaagaaaaccaggtcttgaaaaagtggaatgtaccaatcccctggaagatatcagagtatctggtgcaggtcacagaaacctctgaccatcataaatagaaactgaaaaaagatctttatttcatggtgtaaccagcctgtgagtacacgttcagacacactcatttttatgcttccatttacaggggttctaaaccctataggcttatgctaaacttccacccccttcccctcagttatttcaaggtagtccccaaggtgttggctcatcacatgtgctgagaaacaagtttgctcgtgtgatgccttggcttctttgtcaggggactgcaccctgagttggccctcagtgagaatgggactccattaggcacatccatattcttcccttcttaggaagccagagctatccgtatgtgtggcagggttgggatagggtgagaaagggagcaggaccttttctccagctctgcctctcaggctctaaagcagcacacatgtgcccagctttgctgccatagggttggagtcggggtggggaaaatgttactgcatcctcgccattgtaaccctatttcctgtctttcctcctaggcaccctgtctcagcactctcccaactttgtccccaggcagtgagtgcttcatggccagagagagataggactgaaccctcgtaccttcaaacatatctaaatctctggtgcagttcaggtgagacagcctgctaaatagagtcactaaagacacaaggaggccctttgggggacattcattattttcctcccatggcagatcagcaacaaaagcacatgaagacaccagccttgttttgactggagaacagatctgtgcatgtaaagaagaaatagcttgattggggttaaatcaaagctttgaacatttctttttttttttttgagacagagtctcactctgtcacccaagctggagtgtagtggcacaatcttggctcactgcaacctctgcctccctggctcaagtgattctcccgcctcagcctcccaagtagctgtgattaaaggcacacgccaccattcccggctgattttttggtattttagtagagatgaggtttcaccatgttgcccagggtggtctcgaactcctgagctcaggcaatctgcccaccttggcctcccaaaatgctgggattacaggtgtgagccaccgtgcccagccctctgaacatttcttaaaaatggaatcatggctggacgcggtggctcacgcctataatcccaacactttgggaggccaaggcaggaggattactgagcccaggagttcaagatcagcttgggcaatatagcgagacttcatctctacaaaataataataaaaaaaattagccaggcatggtggtgcacacttgcaatcctagctacttgggagtctgaggcaggagacttgcttgaacctgggaggtcaggactgtagtgagccatgattgtaccactgcactccagcctgggcaatatagtgacttcatcccaaaacagaaaacaaaaacacacaggatcacgtttgaagagatcttaggtgttatctagttcaccatcctgtctattttgattatctactgttttgttacaaaccaccctaaaatttagtgacttaatagtgattcattgttttgctttttttttaatatttgttttttttattttttatttttatttttttaaattttattattattatactttaagtttcagggtacatgtgcacaatgtgcaggttagttacatatgtatacatgtgccatgctggtgtgctgcacccattaactcatcatttagcattaggtatatctcctaaagctatccctccccactccccccaccccccaacagtcaccagagtgtgatgttccccttcctgtgtccatgtgttctcattgttcaattcccacctatgagtaagaatatgcagtgtttggttttttgttcttgcgatagtttactgagaatgatgttttccaatttcatccatgtccctacaaaggatatgaactcatcatatttatggctgcataatattccatggtgtatatgtgccacattttcttaatccagtctatcattgttggacagattcattgtttttcacagttctgtgggttggctgaatggcttctctgctgttttcacctggactgacttacgtggctgtgttgaattggagggtcccggatggcctcattcataggtgtcgcagatggcactgactggtggctggagtgccttggttctccttttagcctcttatcctctggaaggcttccttacatggtcagtctcagcgcagcacttaaagaggacggaaactacaaggcttctggaactcatacaaccacgtacttgtcacattcaattggtcaaaacaagtcagaaggctggcccagagtcaagatggagaaatagactccacctcttgatgggagttgttgcaaaatatcgtggccactcaatcctagctatagcatctctgatggttgttcaaattaaataaggctagtgaaggggttctttttctttcttgagtcaacttgtttcatatagaccacccacagtcttttccttttggatgaacacccctttggttcaaaataagcatcaaggactcacgcattcttattcattactgcggatatgaaacctgtaggggatgaataaggaaactgtgcctttaggacacatggatggaataacttattttgtctaagctacacttgagctagatgtgccttctggggaggcaaccttgttctggctaagctgggccagtgtagagctgaggggaaataaaacatatgagctgagtgcacctgtctctggcttagattttaagggagaaagagaaagggggcccttgaggtttctgtgctattcagctgcaggagaacagggaagttagttggagaggaagccctggtccagaataaagggtgcccagggctaaaaatctcaggaaattttgtgttgtcgtaagtatctggatggcatgcagatccaggggaagcaagaggatacaaacatacttttggtctagtgctctgttactcacagtgtgttcattgggtcaccaggagaatcttgggcccactgtgttttaataagatcaccaaataactcatctgctcattaaaatttgaggcacactgacttagagagccttcccccaatggggggactcatgtaaatctggtcttatttctaaaaaagaactaggtttggtaccactcaaggctttctgggaacagagaggatgcagctttactgtctgtaggtacctgtaaaccacggcccttttttctgagcaggggtttaaactttttttttaaaagcagttttagtgagatataattcacataccatgcaattcactatttgaaagtgcacaattcgatggttttaaaaaaatattcacagatatgtgtaaccactaccacagtcaactttagaacattttcatgatctcaagaagaaatcccatattctttagctatcacccccctccccactctcccatccctgatctccccagtttttgtagccattaatctactttctgtctccatgtatttccctattcaggactttcatgtgaatggaatcatatagtatgtggttcttaaccatttttctgggtaatggacacccattgaaactcctggaagccataaacctgctccccagaacacaaatgacaagtatagtcacccaaaatttcatgaatattctgaatgcttagtttagagagctgagcctagattaagaactcatgccctgtggccagtcaaagcaggtagttgtaagtgggtcctgatctaattggagcaacattgacagggatgggactgcacagggataggtcacacaaggtcatcatcactccaaggtggaaagtgactaaagcaaaggacaggcaccaagtgtttacagagctaaaggaactgtgtttataacacatagtttgccaaggagggggagatggtgaacagatgtgtcatttgcaattattcctaaagatgttaattatgcaaatgaatctctgattagggttctaaaaaaagaaccctatatattatggggtgttggatgtgtacaatcaagcatgcttgctgactgttcatcctggtaatcactgttggtgccagatttatcacctgtagctcttgttttcaacgtgagctggaaaggggttctatgggcattttccaactacagaatattaaagttggaaagtgatatctgagatcatggagtacagctctgtccttgttcagaggcagaaactgagatccagagaaattatgtgacttgtcactagcagagcaaggataagagcccatatcttttatatcattgattccctttcccttgccttattgcatcaaacaaggtgtaagtcaactctcaattttcccgtcaggttctacctgaaatctatgtggagcgagggccaagggaatgatgtgaacaaatatttcccttacctactcagcaagtgcatgtgagtgtgtgtgtttgtgggggaaggaacagggggagagtaagtgactaggataacacaaaggctatattttatttatttatttattttattttattttttgagatagagtctcactctgtcacccaggctaaagtgcaatggtgtgatctcagctcactgcaacctctgcctcccgggttcaagcgattctcctacctcagcctcctgagtagctgggattacgggtaccccaccaagcccagctaatttttttatttttagtagagacagagtttcaccatgttggccaggctggtcttgaactcttgacctcaggtgatcctcctgccttggcctcccaaagtgctgagattacaggtgtgagccgctgcgcctggccaaagcctatatttagaccatgctattcaatagagtagctactagtcatctgtggctatttaaattaaatttaataaaaattaaataaaatttaaaaatcagttcctccgttgcagtcacatttcaaatgtgcagtagctacttgtggctagtggccacatttccgtcactgtaaagtcctattggacagggatttctagaatttagagccagattttctgagtctgaatcccagtcccagcccttatagtaaaagcttgcctgggttatttaatgttcccaagcctcagtttcttcttctgtaaaatggtatctgcctcagtggtttgctatgaaaattatgaatgtaagtaagaaaacatgtatccaactcttagcaaaagaaccttatatttactaagcactaaataatgattatcagtaagtagcttagcttcatgcttagactgtgcaattggctgggcgcggtggctcatgcctgtaatcccagcgctttgggagggtgaggcgggtggatcacttgaggtcaggagtttgagaccagcctaggtcaacatggcaaaaccccatctctactaaaactgcaaaaattagctgggcgtggtggtgcacacctgtaatccctgctactctggaggctgaggcaggagaatctgttgaacctgggagacagaggttacagtgagccaagatcgtgccatcgcactccagcctgggtgacagggcaagactgtctcaaaaaaaaaaaaaaaaaaagaaagaaagaaagaaagaaaaaagaccattcagtctcttctaattggaatgatgcaacttgttctctggaagagtaagaagttacttgcccggggcactgggactccaggaaagctaagtcgtggttgggttacagtggaagaaggttggggccatggggaaggaggtgggaagagactggggtggagggaggatgatcagagtcctggagaccaagaagataaagtggcctgagttgtgagaagtgacagagagctgtgaagatcactctatctcacaagtttgtcaagagctggccagacaaatgcctgtgtggtgaagacctcagtctatcagtctgtgtggccctggagaacacctcaccgcctcaagtccattgtactaactgcttgtctgcttgtccaccagagggaggcaaggggaaggagagaaaggaatcttaaaagcccagctggttctttgttggcagctctggtcaaggtttgctgtgagggaagctgaagtttccgatgagatgagagtgcctttcacacaagctcctaggtctcagctgtgttttccttgaacccattacctcagtagagaggacccttccaaaaggctgtgtgttcttaagagagtcatacttcatggcctctcagaggggctaggacaattttcacatctggctaaaagctatgctagcccctagcaaccccaaagcccaggttcacagacacagaacacagagggtgcgagtggagagtggtggccatcacccaggtgatttagccacatggctggccgctccacagcatcgtttgctctgccaggtctcataaagcattgtgtgtagaactgggaggagatattaaaaaaaaaaatcattcattttgcccttaggaaatttttcaagtaattccagagctattgagccaagggccaaaaggagcctagtgtgatagaggggaaagaataccacaaatggaaatgtattttttttttaaatagagacagggtctcgctctgttgcccaggctggagtgcaatggcacaatcatagctcactgcagcctcgaactcctgggttcaactcatcctcctgcctcattctcctgagtatctaggattataggtatgtgccactgtacccagctaatttttttttttaatagagatggtggtgcgaggggtatccctatgttgctcaggctggtcttgaatttctggcctcaagcaatccttccgcctcagcctcccaaagtgctgggattacagacaagagccactgggctcggtctggaaatatattatattccttggtctgtcattaattagcagtgtgacttaggggcagttattgcaattctttggtctcctcattctcatcagggataaatttaagttgatggactaggtgattttaatgttctcctccatttctagaattctgagattgcaattcccatatgaggaagtgactatgccacagaggaagattctttcattagggttgtcagatttgtcaaatgaaattataagacaaccagtttaattggatttgaggaagacagtaatttttttagtgtaagtatatcccatgcaatattagggatatgcttacactacaagatgatttgttgtttatgtgagatccaaatttaactgagcattctgtattttttctggcaacccctgccttccaccaaacatgtctgccctacagacaatggaagttctggggagggcatttctgcctgtctctatcttctcactggcatgtcctgatagaaagagctgactaatctggttggccagaatttataacattccttggccacatttgactgacagggagaactctgtctaaggcaaagcacttggcttacccattgggctttactgcctggacacaggaaccatgtgctctttttcccctccctctgccttgggagagcccccagaacatggctacccacgggaaagaggtgggaacttctccctttgtcctgcccctgcggccctcattcattccaatggccaagtgaatggacttgcagttagctctgcacgcccattgatcataggcattccggagctcttaggtcccaaggtagagatttggaatgggagcagaggtcccacttgtcctaatgtttaatcttttattctgtaatctagcttatactagtgaacgctgaatttggaggcttgtaggatgtttgctggcctagtaataaactgacttttggttcccactgggctggtggatttccgtgttttcctgtttgacctagaagggaggagctttgataactaggtcccaagcctcttacattattgctttctctacaagtcagactcattggcccatcttgattcagcctcactgattgtaaaaaaagaaaagaaaaagtggtggcatgtgaaatcattagaatgactagaataggaggacgggatcaactataggtcatcttgggatgacgtcttacttacttttaggaatgatcttggaactttatgttgtaaataactgcctgctataagaaaaacgatggggagagccttagtcttgttatgcagcatttccagttacagagtttaacaatgagatgcttatcagaagatactgctggagatcttttgccagcggatgctatcatcatagttactgggattttcatagctcaggctggacctttgctacacacagcattgtaactccatgcctcctgtacttggctttcctaaactcagaactgattatgacacaacactgccaaaaagcttaccctttcctacagaagcaagtccagaccctgtagcacggcagaaaagcattcccaggctgatatgacatttcccgcattgccacttttctcccactaccggactcccagctcctgggcacactacatattcccaaataaccttttagtgatcacccaaatattctccttcatatctccaagactttgttcatgctggtccttttgtttctaatgccctaactcttgtctttctggcaaacattttcttttcttttttttgagacagagtttcgctcttgttgcccaggctggagtgcaatagcacgatctcagctcaccgcaaactccgcctcccggattcaagcaattctcctacctcagcctcccgagtaggtgggattacaggcatgtgccaccacacctggctaagttttgtatttttagtaaagatggggtttctccatgctggtcaggctggtcttgaactcccaacctcaggtgatccgcccacctcggcctcccaaagtgttgggagttacaggcgtgagcgaccgcgcccagccaaacattttcttttgagtattaattcaagtgtcagctctccaaagacttgttgaattcctctctccctggcagaattcctgtccccctcttctatgtgctcagactccaccatctcgcatggtgatgactaggccaggtatctatttctcccatgggcctaagagctccctgagggcaaacagcttgtctcattcatctttgcatcccctcttcaatgtcacaggcttctccttttcctctatcacagaccctggcacagcaggagcattcaataagtgatcgttgcataaatgaagacctcagaatatggtccagatatctcatatttaagttgttttaattaggtggtgtgtgtgaattgtcagataaaataaagcttcagggtggaaatgatcgaattgaaatattagtgtaggaacatactgcggctcataaaaaacaaatagatactgtaatttaagagtggaatattaaatctttatctcaaagcacaaatcagaatagtgccacagcatgaaacacttgtaataggctaacattagcatttagtattagcacgcagtaatccttccttctttggggtagagaatgcctttttggtatcaaacaacatctcatcaacatatgcattatgatttacgggagggattttttttccttgttatgtaaaattcatcggatcagcaaaatatctctgttggcaagtactttgtgagaggctgtgagactgatcacagggataaaaagtatttatttggtactttccctaaatgaaatctggagtgatagctcttctaacattttatttccttcaatatacattgggcataaattcagctctcaaagtctaaggaccttaaggggaaaaccacaaagctagaagcactctagtgaaggagcactgggcttggagtcaagattttagtccctattttgttactaaccagctatgtgatcccgaggaagtcccataacctctgagggcctcaggtttccccatctttatatcgagtgttgtactatatgatctctgaaggtgtttctctgctccatcactttgattccacatgctcgtctgcagagacagatttactgtgactttaatgaagctgaagcttcagggctctttacttgctcaactccttccaaaagccccgagagaggccccatcaatgtcttttacatggtcatatatttttgcaaagtttcaaaagtaagatattttttactgaaattggttaagacagctgtctctttccactccctcctcctcatcacaaatcttcaggtgcaggtaggcctgaaagtgacagcagacatttttggaatgaagttggggctatgtctattttggaaggcaaactgagttggggatgtgttggtttggggttggtgggtatatattttgtagtttatagctactctgtatacagttacactgttgctagccatcctagtataggtatggcttccaggaatatttctactgcccactgtgcaggcttccccagcactgtggcatgaaggtgcagggtattatgggagtaggtacttgtcctacaatacctggcactaggagcatgtggggagtggaagagaaacaagatttgaaatggatagagccagaagcaaatctgtggaaaattcttccaatcatcagacattcagttcacaatgatgactaaacaaaatggaaatattcttccgtaaggaatatatgcagtaatgcaacatacacaattataaacacactcttaattgtttatggtaattgctcagaatagaatccaccagaattcttgtgtttgtaaggacaaaaatctttaataatatgatgaacagtcagtctgtgtgtgctgtttcaggttttatgtatctcaaaatgtcttagtatatttgatgcatcttctcttgacaaattctgggaattttagatgaaatggcatgcaattttgacacaatgaaacagaaagtcccgaagaaacaagggttctagcgacagaactcctatgttcatcagtatggcagcaatagatgtagtataagggtaatttgatcctactattatgtagctcaatatatttgtattatgttatattcaaatacaatatattatatttacaattttaaaatgtgtcttttttcttttcttttcttttcttttttttttctttgagacatagtctcactctgtcacccaggctggagtgcagtggtgcgatctcggcttactgtaatctttgccgcctgggttcaagtgattcttctgcctcagcctcctgtgtagctgggattacaggtgcctgccaccatgcctggctaatctttgtagttttcacagagatggggtttcaccatattggccaggctggtcttgaactcctgacctcatgatccacctgcctcagcctcccaaagtgctgggattataggcgagagccactgtgcccggcctaaaatgtgttttacttgttcttgtttatgccttaatttcagatgaattttgtttttattttcagagtggttgatcatactgtaaaactcaaatgtgaagggaaggctggaacctactggaaactgaagatctaacgaaaagaaggaacttttaggaactagcagagacttcaaaatgttgagaactctcttttttcataagagaagataaaaactctgatggtcacactcataaagacaaaaaacaaataaaaaacaaacaaaaactcagaatcacaagagcaaagaaaatgtaggtaaaacaataacagaagaggtaaagaaatttatgtgaattgggacactctggggcacagaacagaagaggagaagaaacatgaaagtaatgctctgcacaaggatgtctgactgtccttgattccaagggcatttaaaattagccactggatgagaaccatgaaatgccatgactcttacagctcccatgaaagacattggatggaacttatcctaactggaccaaattctaaaaaattttacatgatattataatgagttgaaagttgaaaaaaaaaagctcttctagattaccaagaataaaacacaaatttctagctgactgaattaattctcatctctctatagaaagatcatagaaattttttttatcatgcaaagaaatagctaaaaatttacaaaaatatagacgtgcattaggcagctcatgaataaatgcgttttttccttttttcctccagaattttgtgatgtttatggtacttttcggcttttaaaattttgtatttaatcaggatttattacttcattgtaagtaaatattaaatttgtactccatctttgtttgtaattttgtatatttttcagtaaaaaggactccccagattatgtaagctttaggccccacaaaatctaggcctgttgctgtatcctttctagagcagtgtttctcaaacttcaatgtgcatttgaatctcctggggctcctgttaaaatatagcttctgagatgatgcatttctaacagactcccagggctgacactgcccatctggggaccacactttgagaatcaaatatctagaacaatggttcttacctggctgtgcattgggatcatttatagtgcttttggaaaatacattgtgtccaggtcccacccagttctcagtaggcttggaatggggtcctacactttttttttttaactccacagtttgggaaagaagccttttcatatattgttggtgggaatacaaattgatacagccatttttgagcttgatttggcaatatcttccttggagaaatcaaaagccagttggcaagccagtctggaaaaggcagtttactgattcccacccgagggtcacaaagcaggtatagaaggatgggctttggctgaaatatatgatgggtacaggtatattctctataatccagtatttccactgctgaaaacgtatcctagtaacattatacatatcaagcctacatataaagttggtcaattccatattatttgtagtaggggaaaactgaaagcagtctacatgcccatcaatagattattcaaattatggaacagttttccaatgacaaaacaatagctaatcttagttaagcaattattatgttatgtaaggtagacattgttctaccttatttataagtattaagttagtttttataactatcatatttccattttacaaatgacataatttatattattgacatgggaagatgtccaaggatataataagcaaaaagcaagtagcaaaacattatgtatattatgcattaccattataatatactaaaaagtaatgcacttgattctgatgcacactccccagtaggtaacaacttatctagtgtaaaaatgaaagaacattctgggccgggcacggtggctcatgcctgtaatcccagcactttgggaggcccaggtgggcggatcacaaggtcaggagatcgagaccatcctggctaacatggtgaaaccccgtctctactaaaaatacaaaaaaaaaattagctgggcgtggtggccggcgcctgtagtcgcagctactcgggaggctgaggcaggagaatggcgtgaacccgggaggcggagctttcagtgagcggagatagcgccattgcactccagcctgggcgacagagcgagactctgcctcaacaacaacaacaacaacaacaaaaaaaaaaaaaaaaaaaaaaaaagaacattctgttacctcaaacacgctgttttcatgcaatttagttaactggtagcactttcagaagaagacaaagtaaaaatggttaggtcaatttggtggcatagagtattctatcgatcagtggtcaaaagagtagtcattctgagtgatctctaacattagggttgatggaagagatgacccatagatgtccctacatctcatttctcttaggacacacacttgggagaaatcgtccagtgcactttgtccaggccttttacttgtaccaactactttgctttatgctgttttcactttagtggttctgccttctagtccacagaaaagttttttcttaacgtatttttttcccaacactttattatgggaattttcaaacatacagaaaagataaaagaaatttacagagaatactcgtgtctctatcagctagattctacagttaacattttactatagtagttttattgcatatctgtttatctccctgtgcatccatggatccaattcatctttaggatgcatttcaaagcaagttgctgacgtcagtacacttccctctcaatactttagtatgtggatcaataaccctagcttaagatttgttgattgtttttctttccttttgaagtaaaatttacacacaaggaaatgcacacatcttaagtggaccatttgatgagttttgagtaatgcccacattgtgtaactcaaacgtctatcaagaaagaacattaccatacctgagagtatcctcatgctcctcccctggggtactccctgcctctccacaccaatccccccaggtaacaactgttctgatatccccctcaccatatatacctgctctagaacatcatataaatggaatgatacaatatgtcttttgtataagctttattccactcagcataatgtttttgccattcacccatattattgatcatattagtaccttgctccttcttattactgagtagtattagatagtataaacatagcgtagtctattttcctattttgatggatatgtgggcttgttctgatttttgcttattatgaataaaacttctgagtattcttgtacaagtattttttggacatacattttcatttctcttggcaaaatacctaggaatggaattgctgggtcatagggtatacttttagttttgtaagaagctgtcagatctcttcccaaagtggttgtaacattttacactcctactaacagtgcatgggaagccagtttctctatatcctctccaacatttggtgctgtcaatcttttaaaattttagccatttttgtggttgtatagtgttatctcattgcagttttaatttgccgatccctgaatgtgtgtaggtgtgtatatgtattatataatatatatattattctttcacttattttgaagtaatttcaaagtttccagaataatatcaagaactcctgtactcccttcgccagattctccaattgtaacgttttattgcatatgctccattgcccattctctctctacttatagctgcattagtgtttttctgaacctttagagatgaaggtgaaaaaagatgcgatatcaccaccctcccgttctagtatgcattttccccaaataaagacattttcctacagaatcagcatatgatccttcatatcaggttatcaacagtggtataacactgtccagtccacagaccccatttgccaatgagcccccaaatctctgctttttctttgtgttccaggatattatccatgagcctgtgtttcatgtaattgtcatgtttcttcggattccttcaaactgctacagcttctgtgtctatccctgtcttccatgtgcttgacagctttgaagagtacaggtccttcattcagtagaatgaccaccaagccaggtccaccagatgtttcatcatggttttagtgaggttataaattctgggcagtaattctacagaagtgctgctttgtttttctcagtgcctcacacccagtggcacatatcatcaccactggtgatgctaacctcgattgctcaaccacattgtctgccagctcccgcctacttaaattcaacattttgccttttgcaatttatttgtgttttgtgggaacatattttcatttctgaaattagtcaatatcctgttccttatcaaacttccaactctggtcttagcatccattgactgaatcaagtgcctttgtgtaagtttccacatgatgagtgtctatttccatcattggttctatttttatgagctggtattttactataagaaatagcatattattttctatgcttaaaccactgcaagtttgaccctttcaagctggtttttgtgtccttttgacatattcccattgttcattgagcatttccttattttctggcataagaagatgttccaagtgcaacttgtatattacctgtttcagccctggaatcagacattttcctaaggatccttggtttctttgaataaaggatactatttagaagccaagatctggttaatccgtatgttaattgctactggggtatcattgctttaggcccattcagtggacagagctaggaaaaatacacatttttcatgtctgtctggctacatatgtatgtatttatacatctatatgattttgatatcaatctctatgtatgttatatatacatataataaaagcataagtccatactaataccctgtttcaatccagcccctcaggattattttctagatttcccccttttggtatttataaatacctatttcagtaatgagggtttggctccttttatgttcaatatagttacttatttacttaatctcccaactacattgctgtctcttctgcccaccacctccacatcttatctccttcctgacctaggtctcactggctcctgccctgcatccttggtttttgggctgcctgtccgtgcctcttcacagctctctaaccgcctcccctccttgtgattttagctactgtgctgacttttccacactgggaaggaaaatgaagggacaatgtagcaggtttcagtggtgaaacaaacaaacaaaaaattgaacaaacccaacccttcatttccatttgcagtagttctatttcccagctctcattcttgaattttttttttttttacaaagaaaagcactcagtgttttaaaaaaaacgaaaaacaagaaaaatgggaaagatcaagtgtagcgagttacaattttatttaagatccccaataaaaaggctttttaaaaaggttatcagaattataacctgttcctgctgtgcaatcagctcaaccccatcacaactctgcccagcaggagctaatgctacactctttcaagtgaacatgcttatggcctgcaaaggggttaattaacaataaggagttgtagcagaagtctccatctgcacaagtgttggctgtcctttgatgggcacagtgggcgaggatcccagccacccgcaccagtcctctgaccttggtgttcacaaggtctcagctgttgcaagcctgcaggcaccgatgtcaggttttcagcacaaactggagcttcatgggggctttctcatcagagcctttgcctattgcctttggggagaagcactgcaatcattagtttcaaattccttaaatcagagaaatgatcttgctttcggaaacaatctgatagcccttcctggaaactggggatggtagacacaccttgagagcaccaggcagctctttcatttcttgcttggcattgactcactcctctcactgcattccctgcactaaccagaagcacagattcttggcttagcatagatgagattgcacagaacgggggcacccttggggtctgcctttgtctctggtcacacactccccactcaccagggaatccacttaagcatctttgaaataagcctcatttgcaggtgtacggtggcccatgacctatgatagggaaggaaaatttgcctcaatacatgtgctagctctgattgtgagtggaagcctgggagagctgtgtgggaaaggactttgaagcctcatctgggcatgatagagaagagtgctgcaattgattagtggtatctgccatgagcatggaagggaggattgggacaatgtacaacacatttgccatccctatcctaggatttaactccgtcttccagcagaagattactaaggcagttttgcctgagatatttggtaatcatcttaatttcaaggctgtctggtgatatctcatgttcgttatacttatttatatcactaagattttggcacttgtgtgttccctgactaatgataagaaaagaaagtgagagaaatgaatatttattaagcacctactaattgtcagttattcttttaggagctttaaaaaatgtatctcatcaaatattcaaaataaacctataaaaatcagaatattactcctctttttaataaagaaatgaaggctcagagaagtaaaatatttgcttaaaccataatagaaaatttcaaatccaaggataatgctcattctgatatacttgggcagtgggtctcaatcctgggaagattaaaaaaatttttttaaagtataaatgactgcatctcatcatagataattacatcagaatctccaggaaagggaagcttaggcataagaatgatgttaaaaattccccagttgattcttacctgcagccaggtgcaagaaccacacaccaagggggtgtggagcaagataattcacctttatacaatgcctactctgagcctagctttttctttcccccgcctatattctatctgatttaatttttacacaattccttaaagcttcatttttcctatgagggaaagctgaggctcagaaaacctcagtatgtttctgaagatcatgcagtaaaactggaatttgaaggcaaatctgtatggtttcaaagcacttgctctttccacgtctccatgcttcttccattaggtttctgaacccaggctccatccttaaccttactgttgagcaattctggatcccacctggcttccaaatctgtcctgaacctgtcattctagcttgggctggaaccatcatttgtagtctcagcatttagtttcgtgggagaaaaaatgtaacaagtgcttccttaagctactaccatttatcctgtggaatttgggcagctcagcatgaggctgttttcagagctaggggtccggaacaaacggtgtgaccttgcctctgaagaatgtctatgtttagaccacaggagtttggagttttttctttggtccccaggcggttcaaagcagtacaaatgagttgtggggtccagagttcctgatcctgtgggttgtgggcacctgggttcctgctttggccatcatggtaccacactgactttagctcctatggtcagaatcgtgggtgtccatgagataactaagcaaactaacagaaccttagagttggaatggatctccaactcaatctagttgcaacccatgcctagggcaaaaatgcccactctagcatcattgtcagaaagggaattcaaactctatttaaatgcttcccaggaggctgaggtgggcagatcatgaggtcaagagatcgagaccatcctggccaaccaacatggtggaatcccatctctactaaaaatacaaaaattagctgggtgtagtggtgcatgcctgtagtcccagctactcgggaggctgaggcaggcgcatcgcttgaacccgggaggccaaggttgcggtgagccaagatcgcgccactgcactctagcccaggtgacagagcaagactccatctccaaaaaaaaaaaaaaaaaaaaaaaatgcttcccagggatgaaaatgcatgatctctgcattaattggcacattgctgggcagcccttgaagcacagaagctattttaaaattgagcttacatattgctccctataattttcaagttccttggttggttgattttcctcaatcttatcaaagactggtttctataaagccgatccattaccaaggcatttatgcaagtcagagtggcctaagcaaggctggtttcaggcaaaattattaacaaggtctccagtggactttattttcagtacccctaaccatgctgctttcctttagggacagctgcttctcactccctccaataaatcttgctgtcagaaaaagtttggaaactcagccactatcagctataaatgactaataaagcatgattacccccctccaagagcaattacactttattaaggaggacgccttgaaaggtttagcataaaggaacacatttgaaatgaatggtagtcatcaggcagtttgagggagggtagggaggggtaaggcaacataacttcccaatgcttctgacatcacctcatgtagggacatctggtcacatgtccccactttggggccgctgcctggtgggaggctgcttctgtcctaactgaacactggtggtctcatgcaaagttggagcagagcctaaggaggttagatccctgagttatttgaggtctaagtgcaataaaaaatggcttgtttgctaaaattagagccctgtaggatttcaatggccaccctgggtttgactgataatctgttttaattttcttctcaaagatgacacctccaacagggcagtctccactaggccattcccgctgccaaaacaggagtccgcgatcattggagggaagttttcctcagaacaaagagctatgtttgttagtgcagggcatagacattccttgaaaggctttttgttcaaaacagacaagatcccagcctgccttcctttaagagatgaaaatatcacagcctgcggtggttgagggcgccacagaaaccaaacttcttagccctgagttgcagggatggcatgtgtgttttatatattatttactgagaaacctgtccaaacactgcattttaggaactgctaagaagcactgatgaaaatgtgagcactggaggcacaaaagaacctttgaaactaggacacactttccttagagcctacttgcactctatgggtgaggcagtttgcatgtgccaccctctcctcattccaaatcaatttttcaacttggtttagactctgggaagcagtgaaattggggctttcaaatgagcctctcagtccagatgtgtccataatagaagccagtgggcagtggggcataattaacaatctctccttcactgagaccacagaatggcattaattttgccagctaggcttgatgtgaattggctagaatgtctgagtagatttccagctgctgctcatgtagctctggcttccagcagtatttgcattccaaataaaacgaggcctgaaatagatgtgtgatacatgttcaaagctatttttaatcaatgatcacttggttagccgtgaaagattatcagcaggtcacaatccattttgaattttgctgtgtcctgcagaactgatctaaacacgcagcgacttcagcttcccttgcaatccttgtgctttgtcagctctttgggtgaggggtaggaggggagttaggtgggctgtggcagcacagatgtgccacagtgacaagtactggagctggagggccatttactcagggtaaggctgtgtttaagttggccctgcttccccagagaaaccttgtggtgcaatcataagactgaaaactctgtcccctgaatgtccctcctgaaactcaccacgttactgtcccgcaagccagagaaatgtttgtttcttgtttgctaacccctgtctagctgtagggaagctgtgggcagtgtacatttcttcatagacagtgtcttactggaagcttgaaatttctgtggggactgttgccaatatcattctctagttgtgtgtgtgtgtgtttttaaataatagccccttacatttccttaccacacttactatttccaagcaaatctataatctcatttgcaaaaggtatttacatagtatgaatatttaaatacttataattgcatattaattttgtttaacagaatatgcaaatattattttcccctcctttatttctcccttttctttttctataatgtgtttttctttttgatccaagttttctgacatacttttgcacatgcattgccaactttatttcagttgcactaaagagtcttgatcctgagaaccattagctttaaggctttatctttctattgaaaaaataataacccactgtcttttgcccataatattaatttagccctcatttttatccttcccaaatattaatgtttagtttccaaaagctttctgccgtgatttatttacagcttagatgtggctttgtcttttctcaaagaagttctcataagcattcttttctgtggttaaattttataaggatcgatctgtcttttctgtcaagaatacttgattgctatgtaaatgaaacaagaaggtaggagccctgaggtgaacatggatctcagatacactgtaaaaacacaaaacaaaacaaaaaccacaggttgggcgaccaactgtctcagttgcttgggactgtcctggttttagtactgaaaatcccatatctggggaaacctcagtgtcaaaccaactggaatggttgattaccctagctcttggggtgacctccattggggtaacctccacaagaaagacagaagatgcaactgaccaagaggcaaagaggagatgcctccactttctctggttaaatcctaaggtgattaaacagcatctactacttacttccctggtttgtgcagggactagtttgctatcatttcttccattgttttttctaacctcacctctccttttattttattttcttcacaatttatccccatcatttagaaatcctgcctctgtgttttgaccacagccggcagaacagatccctagaggtaaacaaaggagagtttagtaagaaatttcaatttagggtagagggagttggagatgggaaactggggagggggtggggtaatgcatacactgaatacaggaaacctcagatctatgcttattttagtcaataacgtatgtgctacattccacattcttacaaacttttttttttttttttttgagacagagtctccctctgtcacccaggctggagtgcagtggcatgatctcggctcactgcaacttctgtctcccaggatcaaggaattctcgtgcctcagcctcttgagtagctgggattacaggcacccaccaccatgcctggctaattttggtatttttcatagagatggggttttgccatgttggccaggctggtctcgaattcctgacctcaagtgatccgcccgcctcggcttcgcaaagtgttgggattacaggcgtgagccactgttcccatcctgagtcctacttctgatgccgatcacaagccccaagttattttgcctgtgcttctcactgaatggctgtaaatatgggttcccacagctcactccttgggttagattaatttgctagagcaactcacagagctcagggaaacattcactttcactggtttatcataaagaatattacaaatgatacagatgaagagatgcatagagtgagatatggagaaaggctacagagaaattaattatggctagattgtgagatttgtgagaaagaaatgagtctggagaggacagttacatgtctctatgtgaatttttctttacaaaaattacaaatgtatggtatagatcttttctagaagcctattgtttttataataaaagtggttaaagcaaatttgaaaagtatggaaaagtataaaaacaaaaatataaggcagctaggtttcaaaaccaagtgccattccctgtgcagtttatataacaaccaccaccatagcagtgaactttgatttagtgctgactgtgggccaggcactattctagaggctttgtatttaataacccatgtagtcctcaggcaacctcatgaggtgggtggtctcatgtttcctatgttacagatgaacgaactgaggtgcataaaggatgggtttcttttccaaacacatggccgctaaggggatcaatagtgatccaaacccaggcaactgaacactacttcccatatcttataataatatactattgtattagactttcaaaacctactttgggcaccacattttctgtactaatatttggcactgaaatactcacaggtttagatggaagatgacatgcaaaatattaggggtgtttggtattaacttataaaatataggaattgttcttcagatttctcatcaatgaaaatgattatattgttctatatgtctctatctttggggaaaggaaacacttctagttattaattttcccagtcccatgggcagtttacacactggtaacaaatgccagcacagaacaagaccaactattgtttttaagtttttattttgaaataagcttagacttacagaggtgtaacaaaaacagtactgagagtttacatatacctttcatccaacttccctaatgttaacatcttacataaccatgatacaattatcaaaactcaaaaattgacattgatacagtactatgaactaaactgcagactttattcaaattttacgtttttccactaatgtccctttcctggtggaaagtctattgtctttgtctgtttgtgctgctagaataaaatagctgagaccaggtcatttataaacaacagaaatttatttctcacagttctggaggctgggaagtccaatatcaaggtgccggcagattccgtgtctggtgagggcctgtttctcattgatggtgacatctaggtgtccttacatggcagaaggaacagaaagggcaaaaggagacgaagcgtgtgtcctcacatggtggaatagtggaagagggtgaacccactccctgaagcccttatgtgagggccctaatcccatccatgagagctgcattcctgtcagtttacctcttaaagtccctacctcttaatacgatcacattggccattcagtttcaacatatgaattttgggggacacattcagagcctaatacctatccaggatctctcattgcacttagttttctccaaatgtgtgacgattcctcagcctttcctggtcttccaggatcttcatactttttgaacagtctgatcaggtattttgtagaatatccctcaatttggatttacctgatgtttcctcatggtaagattgagattttgcatttaagagagaaatactgcaggggttatgcacccttctcaatacatcgtatcagtgggtacatgattcaatatattttattactggtgatgttagcctttaccactcagttaaggtggcatctgctatgcttctccattgtatagtaactttttttcctttataaatagtaagtaatttgtggacaatattttgggactatgcaaatattctgttcctcttcaaactttcacccactaattttagcatttatcagtagaacttgcctgcagcagttattactggtgttcaaatggtgtttttctatttccttcattccttctatatttattcattggaattattctgtaagggagagttgtctcttctctctgtttatttatttattttgttatttacttatatcagtatggactcatggatatttatttgttgtataagctataaaccaatactatagttacgtattttgttatataagttcatctagttttgaccactgggagctcttttagattggctcttgtctccttttgacatacccacattttgtttttgggcacttccttatttctggcacccaaagatgctttagccaactatggttttgtttttcttttaaattattggacttcacttttagagcagttttaagtttccagcaaaagtgagcaagaagtacacagttccatacatgtcctcagttttccctatcattaacatctcgcattggtgtgatacatttgttaccattgatgggctgatattgatacattattattaaagtccatagttcgcattagggctcactctttgttttgtacagttctactggtcctgacaaatgcatgatgtcatgtatccactgttacagtattatacagaacagtttcactgccctaaaaatcccttgtgctcccccattactacaccctcccctaccccaaacctctagcaagcactgatgtttctaccgtgttttttttttttttactgtgattttaagttttgctttttccagaatatttatatagtcagaatcatacataggtaccctttacggactgtttttattttcacttggcaatatgcttttatgattcttccagcttttcgtggcttgatagttaatttctttttcttgatgaataatattccattgtccagatgtaccacagtttatttacacattcacctattgaaggacatcttggttgcttccaagtttgggtaattattaataaagctgctatagatgttcatgtgcaggtttttgtgttgagataagttttcaactcatgtgggtaaatatctaggagtacagttgttgactggtatggtaagactatgtttagttttgtaagaaactgccaaactctcttccaaagtggctgtaccattgtgcatttccaacagcaatgaatgagagtttctgttgcttcacatccttatcagcatttggtgatgttagtattttgaagtttagccattctagtagctgtgtagcaattatgctagttaactggtcaaatctaatagagatgctatctaaaatgtgttataaagaatgtgacttgagagttggatttccagaattggagaaagagccaaaggagaagtaatgttgaaaaagaggttgggggcaagtatcaccccaggatggcaagatctacctgaaaacacaaataaaacttgattttcaaatttaaggtcaagaccaaggaaaggaagtacaccagtattttttagtatctggacatttcttttcttaatatagttatgttggttcattttttttttggtttggtgaaattcttcaagtactcttttcaaaaaagataaatggatagtatattttctgagcccatgaatatctgggaatgccctcaagcagagaagacaagtctgtcagagtgatggaacattgtacttttctacccagtatcttgggtttttggttgaggatgattttctttccagacctctgtatttttagtgtaaatatcatttcagcgtgtacacatacgcagatctggttaattgtgataacctgtccacaaatacttatcaaaactgtgggcatacactctaaatagggccaatcatggtccttgaataaattacctggatggattgtgaactgtatggatgtagggttgggctgtccgtgacgatttttcctgtgatgtgaacagggtccatctatggcaagagagaatgaggttaacttaaacaaaataaaacaaacaaaagacagaaagaagtagatctgagagaggcagagaaaaagaggtgtaaacagatagagatgatagatagacagatagagagatagacagatagacagataaatagatggagggagagagaaagagaaagtgagaatgagcccttgtgaatagtttgagatccttaatccagctgtgcttgaagtgttacttttcgacttcccaatcatacaagccaatacatttcctttttttaaaaaaaattgtatgagtggtttttctatgctttacaactcaaaaaggatagaattggtattaggggtaggccatggctagagacagactctacaatgaagagttggttaagtgtggcgcaggatggtgagcactcctataccctgggcaggaaagttgccattccttgtcatgctgttctgaaacatgtggccaaatggtcacctgttatttctttggactcagatcatgtgcccactgaggctagagctttaggggaattgtcaagagttcaggatgtctgctttttgcatgtctttcaagaaaagaaaaagcttcggtatgaattgatccccctgaaagcaggaaggaaatagtttgtaacttcattaagagatgcctttctcccatttggatatgagcagtaatcttagactgagattgttcagataatcctgcacctcttggaactgcaaaagccaatatccctgccccaagctgaagttagtgttggcagaggctgggaggtgggagacacagtgggggatgtggttgggacacaggaggaatttcagaaatctggaagactgatcctttaagtccctccccactctcctgctctcctgtgaagaacttgctggtggtaaaggtaattcagtccatagtaaacagccagccaatgggattcagcctgggcatacagctagattagttctacctgaacatcttacttaagagtcatttagctgaaggctcagacctgttgcgaagggacagatatgcagaagagtctggtccataatcaaggacatgacaagacaagattttctggtgtgttcattcatagaagtaggctccaacagtagctgtctggagttttacaggtgcagaattgccagataaatgccaaccccaaggagcttggggttgttatgtttctaaggcaacaataacaaaagtaagagggatgctaaagggcaggacctctagaagggaccccctcctggcatttatttcaggctcagctttaaagaataacgaatttgggtggtctgcccacagagcaaatcctgggggcagtcagactggttccactgttaagatgcaaatccttgctatgccattctgcagagcatggtacatgcagtgatatatgtcatgtcaccctttctaaatggagttttaattggagatatcctgttttcccttctctactgtgtaatgaaagtataggggattattatgttaatcatttaaactgcaggttgttggaccaagaggtaccatatctggatgtgagagctgtgtgcatcactgagagatcctggaagtggagatgggttgctgactgtatgtgtttctgggttgtttcatttggagtaagtgtgatttgggatatacattagttggacaaacattaagtcgaggcacttttgaaattaaatatgcagagatgtgtgtgagtatgtgttaagcagacatggagggaaatgtattaatagttgacatttgctcttattgtccatccacccttttttctgtgaaggaactgcctctctcccatctcattagtttcttgttggactgttaatcacagtgtatcccctggctgtaggagcattgaatgagccaggcatgaccattaatggtccaacctcttattcatggtgatgggacatgttctgagtacaggtaaccagaagattttcatgagattaaaatctcatggatgcatgaatctatcttccatttgaaacacgaactaaaacaatgtgggctggaaatggtttctttggccgtgtttcttaggatagggaaagagtgtacacgtgttcattaaaacctattgaacatcacagcttagcccagcctacctcaaacacgctcagaacacttacattagctaaactacagttggcaaaatcatctggcaacacggtatggttgacccttgaacaacacgggtttgaactgcatgagtccacttacatatgaattttcttccacctctgccgcccctgagacaacaagaccagctcctcctcttcctcctcttcctcctcagcttattcaatgtgaagatgacaaggatgaagatatttatgatgatacacttccacttaatgaatagtaactgtatcttctcttccttatgatttcttagtaaaattttgtttcctatagattattgtaggaatacagcatatcatatatataacatacagaatgtatgttaattgattacttttgttattgtaggctattggtagttaagttttaggggagtcaaaagttatatgtggattttcaactgcacaggagtcagtgtctctaacccttgtgttgttcaagggtcaatgtactttaagtgggagagaatgagacaaatatagaaagaaaggcagagacaggatgaagcaagattggtggggaggaagagagagcaggagaatgacattatttgagcccctggatccagctgtacctaaacttacattggaagatttgtgagccaatatattcatttatttcccctaatgccagtttgaactgattttccttgtatttgcaactaaaagaatcataagagctaggtgtgaaatcttgaacgacaacgtttgccctcaaaattctgtacattttgcttaatttccttctgacatataataatagaaaggaaaattctgagagcagcctgactttcccttctttatatgcaatgtactattcctgtctggatgcttaaagagtttttttatactcatattaaatctcttccaagaatgcacttagctgcaggtattttacacacatacacacacacacaaaatctgaaatattgtaagctctttgaatctgcatacttgagacatttttcaattcatgatttttaaaacattatgtctttgattacggtttccattccatttgctttggtttcttttacctataattcataagttggatcttcatccattgaagaaggtatgaaaaataatattctgatagcttccaaaagcagtagctagccagtaaaggtcaactatccctcttctgggttgaaacagatctggcattcttattccagggagccagattgtttagagaaatgaatggtctttgtaccttttttcagatgggctgtctttctgttcaggcagaataacacaaggggttacaaactgcactcctagcacagttccattagtatggtggtttgcgaaaatgtctgagctttcagaatggtatgtttttattttttcccccttcatattcatagatgttttaagagaaattttagagggactgtgaaatgctatttaaagttagaagtcttctgttgacttaagagccagccagccaaagtatcatgtaatttgtgttttcaacattcacttaattaatcaactcacaatccagcattattgagcaccttttatgtgccagaccctatgcttactaggctataaagttgagtaagatgctattctaattcttaaggatctagcaatctagagggtagacagacgtgtgaaacattcaataacttggtgagcttatgatacacatagttctctgagagcaatttggggaaggcttcacagaggaggtgacagacatctgtatcacactttgtagaatcagcagtttaccaaatagatgaggaagtggcattggtgtgttattctatcattggtctctgtcctttcaatgggagtgtgattgggctcagtctgcatactgatgattcttttcaaaattttaccccactgctttcaaatttcaaagtgttttcttatgactgacagatccgtgtgccatgcacaatgtatgggattacatgggcagctttgtctttctctttgttagtttaacttctctttctctccacttaccggccatagggatgctgtgttcttacacatatttttttttttttttttttttgagacggactctcgctctgtcacccaggctagaatgcagtggcgtgatcttggctcactgcaacctctgcttcctgggtttaagcaattctcttgcctcagccttcccagtagctgggattacaggcatgcgccaccaggcccagctaattgttttttgtatttttagtagagacggggtttcacctgctggccaggctggtctcaaactcctgacctcatgatccacccgccttggcctcccaaagtgctgggattacaggcgtgagccaccgcacccagcttcttacacattttaattgtttatctattgcaacatatatttatgttaagtttgaagagaaataataacttatataagcagagaatgtgaaagtttaaggataatctagtctaatctcttaatctctactactattttatagctggcaaagtcacactgctgagtaggaactaagcaggaataatggtaatgatgatgaagattgaatagtaccagcaatttgtaagactttttcacaaacatcatggcatttaatgttcccccaaatcctcggagcttaatattattatgatgccctctttaccagtaaggaaattaaagtttagcaatgttaaagtatttgtttgaagatattatcttaaatctctggactttcagtccagcactttctctactactcaattaaacttcactcttttttgtttgtgcaattgaaatgtagttaaaaatactttccagactaggattatcttttaaaaaaatttatgagaaaatacatacatggtatttagcaccaatacttgatttcctatattcctcatagcctgtatcaaaagtatatcttcccataatacactgctttgtgttattgtctagtttgtgtttacatggtttgtcttgtctgagcaaaaactttttccctgctcaaaatctagtaaattttctctctcaccccttctttgcaacttcccttaagttcaccgcctgcctatggcagactgccagatttcatttgtcatgccggtggctgtggttatcagacattgcagcaggattttggcaaaaatctcataaatagtgtgcagcaatgtcagcggtctctgctgctaataccttccttctcttccttttaaaatcatgcttcgacgtcttgttttattggcggaccatttcacctttctcacatgtggcagagaagctcttctcatttagtagaagcagatcctgaacttttcatagtcaaaggtacttcccttcttcagtaatttcgtcttgttactccctaaatcccttgctcctttagtttccattaggaactcttaacggagatgtgcagtgttgaatactggtcataggcttcagatttagggtcctgtcttcaaatcctggccccatcactgtctggttgggtcatcttaggcaaacttctctgagcctcatctgtaaaatgagatcacgttgtacatacctacctggtagaattgagaagatggaattagaagagaaattaaattgcctaggatagtgctaggcacattataatggctactaggaaaaaaatgttaatttccacatgtactattcctgtaaataactcttccgctgaagtttctctttgctgccatgccaaccactcagttggaggtcacaaaatcaccaatgccctctcacttttgaaacattctaagtcagctattttgtttctttttacttaacttgtatatttcttgagcaccttgattcacctatatctctttttaaacatttttgctcattcttttcctgaagagtttttaggacctccaactctctggcattttagattggagcaaatattccctctgggccattcctctgacatttttagtcatgtcctagtttcatagtagtttgctaactccacatgtagtctgataaactaatttccaaaaaaagtgaattttcagtatgtttgtggaaaaattggtatctgtcactttacagtgatatgttctgatagttctattggctcattactcattttttctaagttcttagaaagagcattttaataaatatcgtgttatttattattttgtattatttatattaactcaaagcctgtgattgattacttttcatcttatctcctttagtcgagaggcaggcaagatcctcttccagtcctaatgcttgtttctatattagggaaatgtaccattttgcaaatatttattgaaaacaactataaacaaattctaggatttaggtacacaaataaggattcaggtaaataaaatattgtcgatcctttaaggaacacacaataagtaagttgtccctctctcatgtctttataagatattcatatctttttatttttatatcatgaaccttggcttcctacacaaatgagcatataggcctatctccttggaagaattctcaccacccaggattattctagggcctacattaaggtgaaaaaagaattagttggttcccaaaagaagtggtttgtcatttgtgtgtaatatttgcatgaccctgttttgaaaagatgtttcattttgagttaaaacgctgcggttacaaatgagagtggactaactgcttcatgtttagtgaccagcattactatagattccctattccagaaacatgcagccagaagtgagctgacagctaaatgaaacagagatgaggaaaagaagaatcccaaaaaatcttctaagacagtaatagcccccatctggaatttccttctcttttgcaggagctattgcagttaattagagcgtggcaggaccagagggagctctggtttgcatgatgagagttgatggatactctaaatctgcccatgttcggggagacctttgagttagggcacggaaaggcccctgtcaaaatagaaatgtttagtcatagaattttattgctgcaagagatcgtacagatcattataccacggaggctcccaagctttttcaagtataagaatctcttttcaacatcaacattttctggattctcacatagttgtactaacttataccatccatggattgaaaaggtgtataatgacaatatgctgctataaattcaaggatcattttatataaatttaagctttatgaattagaacagcaattacacatatttgaaagaaatagctattcctatattcctacatgagtgagacatgatacgtatggatttggaaatctcgtggatttggaggcccctagggatttgcaccttgggaaaccatggatctaatccaatctcatgttttaacagataaattaaatatggttcatggatattaagtgatcttccaagacacaaattgctggtggcagagtccaagtcattgacaccttttccactgtaccacagctgtcctaaactcttctgaaattattattcatctagatcagcagagagaattatcataaatgtactagctcagagaaaattatgatgtacttaccatacatgggaggacatccttttatatttaacaacaacaacaaaaaaaaccctttaagttaattagattgtgaatagaattcttgcataacttgtcccaattgacaattaaatatttcttgaggatttcaaggagtcagaggcctatgttaggtactttttaaacaatagagtaaacgtggaaaatactgtattaaatctctggttatagataataaccactacacacactcacacacatacatacacacacacacacacacacacacacacacaccagggaaatttttgaaaatcttaaaaattatgaacttttggcaatgaatgggcacaaaagtcagcaagaatggacatctataacttctgccaattcaagagaagcagttctggttgccaagttgagaaaagaaatgagaaaatcatctgccaaataatacattataatattggcagacatagaaggaggagtgtgtcaaagatattaaaaagctgtttagtgttagaatgactcgattcagctggggaaaaatgaaaataacaattgatacttattagatattttttaatatttagatacaagtgggtgtttcaagagtagccaggtcttcagccaggttttctctgagtgattcatatgaagttaaagttgctaaactgaatgctgatcaaattcatgatctccctggacaaaccatttctcccagtactgaattggtttagaaaacgtcagaggttcaacagattggccataggcctctcttgatctggatgaccttggagattccgggttgattttgattcccataaaaatctgggtcattttgaggtagatcctgggcagttcaatcatttctttcatgtggatattgtaatcatgtgcgttcattcagtcagctccaacagtgtcttaagaaggtcaaggctacttatctagatattatatgtccattctccctggatagcggatctattttatgataaaagtttgctattttcatcccaatcaaatgatccaaaaccatgaattttgaaaggaatcttggggtggggggatagtgccaaacatgcacaaatcctctgccatcaccagaagatgtaactcaacctgtgtggtctttgggggacagcacatctgagtcttagagaagcaaagagtagctataattggtgttgacagaaatgctgtgcaaacagacctcaattaattaaaaattaattctgtagcccttacagctaaatataataaaaatggggtccagggagtattgctttgcatctgagttcccctaccctctaattcccaagactctcaggagtctcagggaggaaacagtgtttaccatggagcagaaatcctttctcttcccgttacctctcccaatagtgctgcagtgctggcagccatcccgagaaggctctgaagagtgggctggttaacaggagcattttcactgcaggcagactcggttgccttggtgaagtccccgtgcatctgaagagtggctcatctgttcctgcctggggatcacttgtgctcatccaggcatggcccccaccagaaatctgggagaatggcgagctggtgccagctgaactgtgaacctctaagaataagtgaataaaacgattttatgcactacaattccaggaggactaattcttggagtaaaagtacttggagaagagttctgggtattaggggctgggacaggaaaggcagtggagaaggaggagggaaaaggggagagtagggccaagcagtgaggtgacttgggataagtggggtgagagattcttagcagttgccttgggtgggaaactttggagacagtcatctgaaaagagttttcatgatgtagcctttatatatgctgtgaaaaatcttgccctgctcctccaagaaaatcacactgaagacctacattctgctctgttgggtggtgggagtagtagccatatgtggctattgagctctggcatgtggctggccccagttgagatgcacagctagtgtaatatacacactggatttcaaagacttaggatgaaaaaaagaatgtaaaatatctgtctcactggcaattttttttacattgaatttgttgacaatttttttacattgaatatgttaaaatttttatatattggattaaagtatattaaagttaattttacctgcttctttttactttttcttttttttcaaaaaaagtaaggccaggtgcagcagctcactcctgtagtcccagcactctgaggggccaaggtgagaggatcacttgagcccaggagtttgagactagcctgggcaacatggtgaaaccctgtctttacaaaaaatacaacaattagctgggcgtggtggcacgtgcctataggcctagctacttttgaagctgaggtgggaggattgcttgagcccaggaagacaagtctgcaatgagctgagatcacaccactgcactccagcctaggtgacagagtaagccctgtctcaaaacaaaaacaaaaacaaaaacaaaaacaggttactagaaaacaaattacatatttttctggtattaatttttttattggatagaattgatcaacatcattcttcgcttctggagttagatttgtgtttgttttggattggtgttgatgatgacacagagttatacaagcaaacacccacacccatgtctatcaatggccaaaaaggaaggatcgggggagacgataaatctcagggcccagaaggagcctttgtctgcagcctttggtaaacatgtgtgtgtgcagaaacctgcagacattcagaaagagttgaaatccaggagaaatggtgcctgcccttaaatacatcaaaaggagacaagttccccggtaagaatagaatttgtgttaacagagaaatttcatgagacaaagattggatataaaaggaatgcccgagtgagaagtggagagaggatgtggccttctccttgaatgtaaacatcacaggtcttctctcagcaagaatgcctgggagggaggagaaagggggaagaggagagtggggaggggaatggaggagagggaaggaaccagacagaactgaatggagaaagcagaacaagacgcatggttcgtgtggtttctaacagatcttgtgaagcaacgatcactccatggcacagaaatcctctgtgacaccagtgcaagcaaagcagaacacagctttcgtgaatgctcagtagccgcagtgttgagtttatttatttgaaaattgctttggatggccctaatcctttgtcaaaacaggatgagaagaaaggagtatttgcataactgatgaggtaaaatggctccagggcttctcaaggtgtgtcatgtttcctgtggatgtgccctttagtgctcagctgtggccctggaggggtccccaccttcatgcctggtgtggtatgatgatacggcattacatataactccactatccagagcgcaattgggcccttcaattaaccacatagtatgttttatttcacaataaggcaagaaacgatgctcattccgaagagttagtagaaacacataaaacctgtcaacagagttcagcccatgcctgggatccgaacaaattcagttcaatttcttatcctataactcctgtatctttaggacaggaaagtgaaaatgaatgttctaaataatgacctgaggcattgcaagggtctgaagtgcctcacaaatcatcaaagaaagattaaattatgtcccttactcaccaaagccaaaaagtgaactaataatctattttagaaaccattgctccgggagctgaaactgaaaacatggtagtgtttaaccccggcttaactagaacatctaagtaaccaaaggccccacaattaaagctttacagttaattctgttgcagaatttctgccccgtagttctgctaaatccgggttcttgtgtcacgaccaggaaaagttaggctcgtagacacattgaaaggtgaggggaatggaatttattaggcaaaaagggaaaaagaaaacaactctcagcaaagtgagaggggttcctgctaacaggctcccacctcacagattgaataccaacccaccacacagaaactgaagaggaactcccccgtgcaaactacagtaacttccatggttccaccctgttctccctgtgcacaggcctgtcggagattctccaggaacccactcccttatctgcctcctgcatctatgaattcttttgcatattgataataggtatgaaaaagccttatatgttaggtattcttcgaggcaaagttgttaacaccaccagcctggcagaccagctgcactggcatcacctgggactagttggaagtgcaaattctcagcggaccctctccagttcccccaaatgtactaaatggaacagcattgtggcaacatctccaagggattcatttgcacactgaagtttgagaagcattggtgtagaggtggggaattaatcagtctcttggaaaggaaggaaccccctttccttgaacaggaccttttttggggatacactttcttcaatgcttactttgtgttctagggactgtgcaaagaaatttacatgacttacctcattttaatccttataatagtcctatggagtaagtatcaaaattaattccattttacagataagaaattgagatacaaacccattaagcaatttgcccaaactcatacatattaagcacttgaaccaggagtcaaatctaaactgctactctgggcaggaattatttggtctttcttcctcaggtttttttttttttcttttatttatttatttttttattgatcattcttgggtgtttctcacagagggggatttggcagggtcataggacaatagtggagggaaggtcagcagataaacaagtgaacaaaggtctctggttttcctaggcagaggaccctgcggccttccacagcgtttgtgtccctgggtacttgagattagggagtggtgatgactcttaacgagcatgctgccttcaagcatctgtttaacaaagcacatcttgcaccgcccttaatccatttaactctgagtggacccagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctttcccccctttctattccacaaagccgccattgtcatcctggtccgttctcaatgagctgttgggcacacctcccagacggggtggtggccaggcagaggggctcctcacttcccagtaggggcggccgggcagaggcgcccctcacctcccggacggggcggctggccgggcggggggctgacccccccacctccctcccggacggggcggctggccgggcgggggactgacccccccacctccctcccggacggggcggttggccgggcagaggggctcctcacttcccagtaggggcggccgggcagaggcgcccctcacctcctggacggggcggctggccgggcggggggctgacccccccacctccctcccggacggggcggctgccgggcggagacgctcctcacttcccagatggggtggctgccgggcggagaggctcctcacttctcagacggggcagctgccggcggagaggctcctcacttctcagacggggcagccgggcagagacactcctcacctcccagacggggtggcggccgggcagaggcgctcctcacatcccagacggggcggtggggcagaggcactccccacatcccagacaatgggcggccgggcagagatgctcctcacttcctagatgggatggcggccgggaagaggcgctcctcacttcccagatgggatggcggccgggcagagacgctcctcactttccagactgggcagccaggcagaggggcacctcacatcccagacgatgggcggccaggcagagacgctcctcacttcccagacggggtggcggccgggcagaggctgcaatctcggcactttgggaggccaaggcaggcggctgggaggtggaggttgtagcgagcccagatcacgccactgcactccagcctgggtgccattgagcactgagtgaaccagactccgtctgcaatcccggcacctcgggaggccgaggctggcagatcactcgcgtttaggagctggagatcagcccggccaacacagcgaaaccccgtctccaccaaaaaaatacgaaaaccagtcaggcgtggcggtgcgcgcctgcaattgcaggcactctgcaggctgaggcaggagaatcaggcagggaggttgcagtgagccgagatggcagcagtatagtccagcttcggctcggcatgagagggagaccgtggaaagagagggagagggagaccatggggagagggagaccatggggagagggagagggggagggggagggagagggagagttcctcaggttttaagccatctacaaggtgggcagatacagagttctgtgggtcttacccccatgagttttctctatcttctccagaaagcctggaattctctgcttgaaattcctgcagaatttagatggtgaaatgacttcccaaagtcactcagttaatggcagagtcctgagtggagtgtagactttctgacattttgtgtcatatgttgcaatcagaaaatactgaaaagtagaactgagaccataaaattgatttgaaattccatctttcagaaatactatctgtaagcttagaggtttactatttttctacagcttaattgaggtataattggacaaataaaaattgtatatatttagggtacacaacatgatgttttgatatatgtatacactgtgaaatcattaccactatcaaactaatgaacacatgtatcacctcataccttttacctttttcttgtgtgtggtgagaacacttaagatcaactcttttagtaaatttcaagtatacaatgccgttttattaactatggttaccatgctgtacactagatctttggaacttattcatggaggtttactcatatatgactcaagatagctcaactaaaggggacttgtttaaaagtggtgagaggagggagacggtaacacctcttcttctacccatcagagtctcaggtagcaccattctctgtttctttgttctcttcctctcctctctacagacaaggctctctccgcttactcctctgcttgcttgtggatgaaaagggccacgccacccctgatttgacagtatcctttaagttcacatctcaacaagcatgtgagcctggtgtttgtgtctcttatttccaattctccagaaagagaatgccagaatattaattggttcctcatatcaatcagccaaagtcaacttgttattaaaacagagccaagaaactgcctcttttggtagagattgtgggtggaaagtaattccaaataatggatcatgggttaggcaggcatggccaaatattttatatttaaaccataatgtttaaatataaaagatagatcacatattttataactatctttagcttaatattttgccaacatacttttttgtcaagataattatatctcatcattttttgtgacagtgtagtatccatcgtatgtacttgcctcagtttgctcaaccaattgctattgatggatattctttcgtccaggtatttgccagtacaatcaatgttgttacgaacaaccatcataaatatttgtgcctagccttaattattttttagggcaaattattatttttggaacttttattttaggtttgggggtacaggtgcaggtttgttatatagtaaacttgtgtcacaggagtttcttgtacagattatttcatcatccagctattaagcctagtacccaatagttattttttctgctcttctccctcctcacacccttcaccctcaagtagaccccagtgtctgttttcccttctttgtgttcgtgagttctcatcatttagctctcataaaaaagaacaggatcgtgtcttttgcaggaacatggatgaagttggagtctattacccttagcaaactagtgcagaaacagaaaaccaagtatcgcatgttctcacttataagtatggtaaattattaaaagcaaaattgttaggttaagaagtatgaacagttttaagactttagaaatatgtaccccaattttcttctggaaaaactgcacccgttcatattcccacgagccatgtggtaaagtgcctgcctttccacaccctcaccagcactggggattattctcttatcgttgccagtttgatagccaaaaactgagctcatttttcttttaatttgtgttcttactgaggtggaacaatttttcatatgtgcattggccttttgtatttcttattttgtgacacacttatttttaaaactcaactgtactttatacaagggaaacaaatgatttcaatagctgtgattagttgtctgcttgattcttgccctaactgcaccttgtgtcttcttttatttgattatcttcacctaaaaataaaccagcatcacgttgttttccttaggataacattactgactcacaaggtaatatgtaaaactaagcctttagtttattacatgctattgtcctatcaaccctttaggaaatgctctgggagagatgaattgatcttccaagccacgtgataaaacgtctgagatggaaatacccaggagggttgaaatggtgggattgaggtgaaggaagaatgtgagagatactgaattcatctactttcaaggcagttgaatcctgatctctaaggaaggggagagaaatctttatgaaaagttgactttttctttttaatccctgctttacagccgatacgtctcctactaaagttgatggatgggtaatattgagtctcctcacaattacttcccaagaccttgaaatgattcaggatagaagactcctaagatatcaggctgaggagaggaggctcattgagaatcacaggccaagacattttgaggaatgcaggatggagggcttggctgcattagtcagaaatgtccttatctgcagccgtcagtggcctctgtggtttgattcaacagggtttcccaagcttccctcatcgtaaaagttgccagatgcacggactaaaagtagacattctcaggccccatcccacactcactgattcagactctctaggcaagagtctgatgaatctatcatcaggaagtgtggaaaatgcaatttagagtctgaggcaaggcctctagtaagatatagcttttaggatggctgttcagtctgtgagagacccaccaaccaaactctctccccataggtagggccttaacattcatattgaatctatatcatccccacatccctggccttgaagggattcaggctgtatcagtcagtttctttctctgcaaattggaaatggtatttagagacagccagtctgtctcttaaactttgacatggaatctcaaaagtgtggacacccttactctgccatgtagttgaagaagcagtcaatggtgtacagggagaggagacagaagaatgaaattcagattcctcttttgcttgaagtagcttggtatgctttttaacaacttgaacccctaaaccaagacactctaatactttcaaaaatcacctatacattatgaaaatctttaaattgaagatcagttgaggttaacaggtcttatattttaaaatgcaaattcttctgtaaagattaaggctgtcaaacatttataatgtagtgtaaactacattaaccaagttactgcaaactgagggaatggagtgtttgctatttgtagggaaagggtggggaacaggtaatgaagatgattggagaggggcagcctaggttaagagtcacagtaggagtgttagagaccaacacagtagggcagcatgaaggctggatgtggtcattacacattttctctttgtaacaggaaatgtataggcctttccaaggcaggctggtctgtccaccatctgtgatgtagcatgggcatcagatgataattaggacctgtcagatcaagtttttattggtataaacaatacctggttagggttcctgaataaaagcttgaaaaacatgaatgggttatctgaagataactcagtgtgcccagtagagttgattcagtgttcactcaactagtcaattcactgcacaacgaattgtgtttagcctttcctcattacacaagggtgagacacattcttctgtggctgagagttggcagtgtttccctaactcctagggttgagtgcgtgtctactctgcgcgtcctggtctattgtctccttttgttcatgtttcaagggcttgcagactccattggaagttatctcagcactccattttaatcacaatttctagactttctaacagagttagtaagcttttaaaagctggttcctgaaatttctttggctttctgaacacttagtaaaaaatatcacattccagtcctttttgattccactgcctcttgtttttcccactatttacctatttattatttcacatgtaaagtatatgggacgggtgactattatcccccaggaaggcttgctgttgaagagggaaatccttggtctctctaagattgttcatgttgcagttctttaaaggaagccccaaccactgagaaggagctgaagccactgcacgtggaagatgctggcaaaccttttaggatctgatgcactcctacctttaaccctttattgccacactaatgattcattttgttgttttatgggattccattgctttgccagggaggtagcttcaaatttcactcaaaggtccccagaaagtaaaaaatgtaggattagtgtagactgtttgatgtaactaaaatttttatcttggtgatacatttagaaaagtagtgtctgtgggtgagtcctgaaagtccaatcctgaatccctggctgagttcacagaggaaaatgcattgcaaggaggacatatctgatctcttgaatccaatggactccaagactgcatttggcctgaaagtgactggctgtggcctactaatgctggttattcaatggtgggctgggaaggcatatgaagatgatgcttagaaaatccacgctttcttgacatggggaacaacataatatacctatttgcatatagaacaaactcctttttattatcttttaaataggtacttagggactttgcaaatataactccaacccttactaggtctgtgctttatttcttttatttatggctgggcaaacagaagagtaaagagatgcaatgacttgcccgagatcggcaagtaagtgaaacaggtagagctaataacctgattatctcttactgctcctcttgcccagccagcctacttcacacactgacttctgagacatctgccatccacagctcttcgggaaaaggaaatttcaagtgcaaatgacagaaaaggaaattgtttcaatccagtattctcttaacatttgatccaaacctgtgctgttggactggcagcacccacatgacttaatacaatcatgattaaactaacactgaagaaaaagtatatgtacagtatactaacactaatgcatatttggagagaaaactgcagattccagataaatctacattgatttccatcacaggagctacaatgactgctatttgtttccgtctgtccattctggaattaaattgagttcaagcagcttggaacagcttgatggcttctttctgccacagaaggtgccgggtgtcctgcatctagactctgacagcctattggtgaggataacaatacgcaactggtaaccctgagagctttcagctcttttcaggccctcctacagactaatatatatgttagggctggcagtgctgttagaaatgaaacagagcgaaggccgggcgtggtggctcacgcctgtaatcccagcactttgggagtccgaggcaggtggattatgaggtcaggagattgagaccatcttggctaacatggtgaaaccccatctctactaaaaatacaaaaaattagccgggtgtggtggcaggcgcctgtagtcccagctattcaggagaatggcgtgaacccaggaggtggagcttgcagtgaaccgagattgcgccactgcactccagcctgggcaatagagggagactccgtctcaaaaaataaaaaataaaaaaaaaaaagaaatgaaacaaagagcctgcactttggagacagatggtcttaggttcaaattctgccacttaataacattgtgactgagaactccatgaacattgtttttcaggtgacaattaaacagcatatgataggtgggtaataataatgataatagtaacaatgataattactagagcagctatcattaaatgagtgcttgctgtgctaagtgatctcaaagtcactgtactaagggaatcttttaacttttacaacaactctagtagatgggtactactaacacatgtatacttaaccaatgtcagttgctttattccttgactaagcaagtatttactgactactggttacatgcagacattgtactaagtgctggggattcaacgtcggataggttgtgatcccttcttgtaaggaattctcatattagggggatggggaagaagagaaagaaaacatagtatgacaagggctagccagagtatgatgggagaaaatgaggaggagaatataaaagggactgggaatcagagaaggctgaatcctcaagaatgtgtagccagaagggttactgaagtgctagaagtcatgggcttctgagttcaagaccagtgccctctacttcctggatgagtatcgtttctaagacaaggctcaaggcagcatcttcccaaggaaaggattacttttaaaagaataatagcaaaaacacaattcactgtgtaagatttcaaattcacaaaaacagagtagaatcatggaccccatccacccatcccctagatttgaaaatcaatctacattttgccacacaagctaggtgaaaggcacttttaataagatgattctgcagtgggctctactggtgattccaaaaggactggatagatccctccgtttctccttttccagaaacaggatcttcttcctcccctcctttgagaaggcatccttggttctaacagtagtaagttgtggggctgtcttccaacctctaacactgctggagggaaacaggtccacacacttgttggagtagcagcctccttgtaaactaaagagatcattattgttgctgtaatcagatttgcattttgcatgtatgggttttatttaaatgctggcttggtgaagaacaataacacagttatcacatggccagtgtagtatggatatctttaacaaatggattggacacaatgggcaccttagttaagatgctgaaccatattaagtaactgttgtcacattacttggcaatcatctggtgaatggtagacctgattgtaaaaatagattggaattttgtctgctttcctcctttttctccattagtcccagtccctggaaaggagtctgtttcaggcagtatgccctgagtggcaattttgaaggcaaggaaagttaaaaaaaaaaaaaaggagtgcttagacaagtaacccatggaatttaattcatggtgcatatttttggattacaaaagaattgatcgagcttatgaaacaagagtaagtaatttctggaaagaaaatctttttagcattcacttatgaggctgactgaggtttaccgaagttagaatagtgctgtttttgttaaagaggaagtgaatagatacagaggaaagcgttttggattgttaggagtagtattgggcaaggtacttcacacctctgagccccagtttccttacctgtatcatctgcaagatgctcttagtctctattatttttatttatttatttatttttgagacagggtctcactctgtcgctcaggctggagtacaatggcattatcatagctcactgcaaccttgaactcccaggctcaagccatccttccacctcagcctcccaagtagctgggatgacaggtatgggctaccatgtcggctaatttttttttttttttttttgagacggagtctcactctgtcaccaggttggagtgcactggcgtgatcttggctcactgcaacctccgactccctggttcaagtgattctcctgcctcggcctcctgagtagctgggtttacaggcacgcaccaccacactcagctaatttttgtatttttaggagagacggggtttcaccatgttggccaggatggtctcgatctcctgaccttgtgatccacccaccttggcctcccaaagtgctgggattacaggcgtgagccaccgtgcccaactaatttttgtattttttgtagagacagggtttcaccatgttgcccaggctggttttaactccaagtgatccacctactttggcttcctaaagtgccgagattatagttgtgagccaccgcacccggccagtctctgctattttgtgatattagagagtttaatgcactgtgatggttaaaagcagtgtagtggcctttcggtatcgataaaactgggttccgtgtctgtgttagctgcttgtttgctgtgtgatcttgggaaatctccctcaatctttatgttctccattttcatcatctgtaaaactggtgcaatagtaatagctgtagcccagactcgctataaagattaaatgctttgtgcttagcacagtgcttggtacatttaaactttcagtaaatgaaagctatgattattattatatattcttctccattttatatcatattctacttaaataattaaagatccaggaataaaaataaagccctcaacagaattttgcaaaaaaaattaagcaaaacatgtcttcagctagcatgattttcacaagtgctctgctctgatctagtgctagatacgtaaagaaaggaggcactattagatccatggcaagtatatggttcatctccaatttcattcatttaaacaaccaaccagcatccctgaatgccttctaggttcttgacattcaattagcctcccaggataaaaaagcaaatgtgacatttttcttgctattatgaggcatacagtggagagggcagaagtagacatagcaatactgttgcattacgttgtttatcaggtctctcaccttgtgctttgtggaaatcctgtcagatctggaacccagaagtctgtgccaattttaaagtttgccttaaagccagctttctttgtgatggtgtttggttccgatagacccttgcttatattctaagtccacacaatttcaaattctacttgctgaagtctgcaattggtagaattctcctctgcttaaaaagagtttatttgaaagaaaattggaaacaaacttgaaaaacgtagatttttgtacagttacttgaaacaagcaagcaaacaaagcaagaagagggggcaggctggttccactttaaaaaataataaacatagctaacttatactgagtactcattatgtgccaggcagtggtttaaggtcttcctgtgcaataattcatgaatcctcacaacagtcatgttaagtagattctactataatccctgtttaactggtgagaaacctgagggacaggtagactgagtaatttgttggtcagacaactagtaaattgggatttgatctcttgcaacgtgacccagaaccaggctcataatcagtagtttctgaatggcacaagacacttgtaatcattttctattgttttattaaatattgaactcaagaaaattaaatcccagcaggttgcaaatataattcaaacttttattaaatgtcagtatattgtatccttggatgcgttttgctcctgggcaattatccaggtttggagcacatatttaagtatttgctgctgtgattgttgcattgacttacagtggcaaatcagattacacagtgtggagaatgaaattactgacacacacttttgggaggacaccttttgattttggttcgtgaattcaaatgttacctcaaaaccagcaggggttctccacagcctgagtatttcctttgaactacctgctctactgaaaaagttgtcatccaacctggaacctcctgtgagttccaaaagggaaataaaagatctttttctgtctgtcttactctagtatactagaaatagtcattttgtaagtctctgagtcctccaagaggcatccacgttacttacttcttgtaccttaaaatgatcccaaccacatatcctcctcagttacaaaatccatcctggcaggaagtattatatagtcaccttacctctggaatttgttcacgctcccagcctgggtgtccagcgacaaggtccctgagcacttcctcagtgtcaggcctttattgcccagtgctacccagtaacctccttcctgacactaaaattgagtctgccataagaataccttgccactgtggtcctccttttgggaagaagcttcatgtatctattctcaattaggcctgacttcactatgtcctttgaggagtatgctgtaagactgagtctgactccttctgtttccagaatcaagggcaaactataagctgggaatgttggactgaatgcttgggctgcctatggagccagttgcagaagtaagtcctggagacaggcaagagggccacggtgctcatgattctagaaaagcagttaagggctgggtgcggtggctcacgcttataatcccagcaccttgggaagccgagacaggcagatcacttgaggccaggagtttgagaccagcctggcccacatggtgaaaccccatctctactaaaaatacaaaaattagctgggcgtggtggtgcgcacctgtagtcccagctactcgggaggctgaggcaggacaattgcttgaaccctggaggcggaggttgcaatgagccgagtttgtgccactgcactccaccctgggcaacggagtgagactcggtctcaaaaaaaaaaaaaaaaaaaaaaaagcagttaagtattacaaaacaaagaaggagaagaaacaccatgagcctagaggtgaaatgatgggtttgctgtccaaaagcacaggtagacagaggtacaaggttgaaactggggctgaaatgaatggttggtgaacacagagtgcaggcagggatggagcagggggcaggtggcagggagtgaatcttgcaggtctttttacccttttacaggacagtgagtggcacctgtcagactggatgcaggaccttaaagtttgcaactggcctggcttatagtctggttcaccgtgcccatgcctatctgccctttgctgccaaggccctagcagaccgcctgcctgccagagtctgggctctgtcccatcttcagtttaatagaattgatgttactcaatgctcccaggacacatggcattgctctgtttggctctggcctgctctcaacagaagggggaaagaaaagaggactgccaacaaggctatttccttccactgcagccccactgtgcctcctgcttcttctgagtgatgagcctgaaagattctgagaatttttaagttaaaatattttatgttttctatcatagaacataagtagtggggggaagaaatcatctctaattaaagtcagcaagtgtttatcaaatgtctagtacttatcaacattacttacatccctaaccttgttataaaggtcacagagggaaaaataatataaaatgtggttgcagactttaagggcatatccagaagtcactatgacttaaaatcatctaatgcatatagaactgtaactaatattacaaaatggctcatgagtttagatatttcatgactcaaatcatgttgactgaaacataaaccacacagagaacatttgttttagtctcactttccagcaccagtctttaaaagaattctttttttcagctttattgagctgtaattgacaagtcagaattgtacatattcaagatgtgcaacttgatgttttgatatatgcatacgttgtgaaacgattaccacaatgaaactgctagcatgtctatcacctcacatagttgccattctctttttctttttatttgtggtaagaacacttaagatctaccattttagcaaatttaaagtgtacactacagtattaaacacagacatcatgatgtacattagatccccaggacccattcatcttacctaactgaaactttataccctttgacaaacatctccctatttcctcctccttccctcaccctgtgcccttggcaatcaccattttactctctggttctgtgagttttattttagattccacatgcaggtgggcgcttgcagtatttgtctttctgcatctggcttatttcacttagcataatgtttcccaggtccattcatgttgttgcaaatttacttctttttatggttgaataatattcctttatgtatgtatacacacacaatggaatatatatatatatacgcacacacacatatatatatttatatcacattttaaaagaattctaactttaaactctttctatgaatccttgaatttacaactagtgataaaatctcacacacacacacacacacacacacacacaaacatacacatgttctaccttgaattactaccaagtcaaacaaccacaaagctggccaatgaatagctaataactggttgaatgatcagcccatatattctttggcaaattggatcaaaccacagaaaagtagtctcagataaagtgaacaatataacataatttactttctcatagagagaggctctatttaattttcacacccctgtgtctggtgtcctttcatgaaatacagtagtctccttctcaaaacttccctgctggtgaaagacatgcatttttttaatgcactcttaatttctggtatataggaataaactatgcctctgggaaagaaatgcattgcatggatacactttgtgaaggtaaacacacagaggcattctgctttctgttaattaatgacagtgacgacaagtttttataggaaaccaattttgcttttgaacaccagggagatctttgagcataagaaatatttcaatttaggaaaattatagcacagccaaaagcccaaatgtaacaggtgaattatagttggtctaaaaaattagacacattaggaattggtccatgaatgttcagtaaatacaactagatccctgaaaatattttctcgaagctaaagacaactctgaaagttgggatttgttccagcattttcccaggaggtggaattcagatgcatgggctgggactgtgggagctgagagatgctagagtggtgagcagcccgctgggcagaaccttgcctggctggtgagagattgatgttccctggttccaaatggagactgagtctgacatatttgcagagtggaagtttgagcttctcttgtttttattcattacaaagtcatttatgaatgcacactaactgtgacatgacctcgctggtatatttaaagcaaccctaggctggtggggtcaaaagtttcattgtacacacagatgcggcttgtcagcaggaatgcagattttggcagggttagaggcaatggatgtgagggctgagtcaccctgcagagcatgccagataacccctccccaacccacacaatgggttctattctagtgccattcctaactgcacgatctatactgtatctgtcttggatttgtgtgcgattgtctgcatagaggcatagttggtgacaaaagaatgatgaaaatcagaacagttacttaaagtgaaaacaccaaagtctgggttctctgagctctctcgcaggtgtttactctttgacttctaaaatcagttccacagaaatactcaagtgtccacaaatacacacatacaaagaagttaattacagcatggtatagaagaatgacaaattggctgggtgcggtggctcacgtctgtaattccagcactttgggaggctgaggcaggtgggtcagttgagcccagttttagaccagcctgggcaacatggcaaaaccccatctccacaaaaaatacagaaattagccagacatggtggtgcacacctgtggttccagctactggggaggctgaggtgggaggatcacctgagcccaggtggttgaggctgcagtgagccatgatcaagccactgcactccagcctgggtgacaaagtgagaccctgcctcaaataaataaataaataaataaataaagacaaattggaaacaacataaatcggagggggtcataaattatgacaggggtccccaacccccaggccatggaccagtactggtccgtggcctgttaggaactgtccatagagtaggaagtgacctgcggcaggccagcattaccgcctgagctcagatcagcggcaggcattagattctcataggagcgtgaaccctattgtgaactgcacacgcaagggatctaggttgcacgctccttatgagaatctaataatgcctaatgatctgtcactgtctcccatcacctccagatggtaccgtctagttgcaggaaaacaagctcaggactcccactgattctacgttatggtgagtatgaaataatgatagaaataaagtgcacaataaatgtaatgtgtttgaatcatcctgaacccccgccccctgtcctgtgtaaaaattgtcttccacaaaactggtacctagtgtcaaaaagatggggaagtgatgaattatgatacatttttgcaatggagtattatgtagctgtgaaaaacagccaggcagctttatatggataaaaatgcccatcacagattgctaaggaaaacatcaaatggcatatatatgtatatgtgtgtgtgtatatataaaatctcatttctgtgttttaaaaaaccatgtgtgtgaaccagggttacagtgttacctttggaaagtggagttagaccaggtaaaagaaggaccagcactttgttttttgttttgttttgttttgttttgtttttgagacagagtctcgctcttggcccaggatggagtgcagtggcgtgatcttggctcactgcaacctccacctcccaggttcaagtgattctcatgcctcagccttccgagtagctgggattgcagccaaccgccaccacgcttggctaatttttgtacttttagtagagacaggcattcaccatgttggccaggctggtctcgaactcctgacctcaggtgatctgcccgcctcggcctcccaaagtgctgggattacaggcgtgagccaccagacccggccaggaccagcactttggcttcctacatttctgtagtactagaaagtttgcaattaatatatattacttctgcaactaaatatacatttgaaaaaaggagattaaataactacaaagtttcagtcaaaattcccagagtaatcctgggattacataacagccaaaaagcacaaatccacagctagagacagaggttctatggtagctctaggctgttggatgaaacatttcatcatcaaagtataaagtcatgtgttgcttaaaaactgggatatattctgagaaacgcattgttaggtgatttcacccttgtgcaaacatcatagaatgtacctatcaaatgtagttggtaaagcctaccacacacctaggctatatggtatagcctattgttgctaggctatgaacctgtacaacatgttactctactgaatacagtagccaattgtaacccaatggtaactatttcagtatctaaacatagaaaaggtacagtaaaaatataatattaaggataaaaaatggtacctatatagggcacttaccatgaatggagcttgcaggactggaagttgctctgggtgagtcggtgagggagtagtgagtgagtgtgaagacctaagatattactgtacactactgcagactttatagactgtacacttaggtgacactaaatttatacaaaaatttcttctttaataataaattaaacttagcttactgttaactttttactttatcaactttttaaaaaatggtttaacttttgtaataacactcagcttaaaacaaacacaaacccaaagtacttgggtatagctgcgcaaaagtactttctttcttatatccttattctagaagcttttttctatagatttttattttttttaacttgttaaattctttgttaaaaactaagacacaaacacacacattagcctaggcctacatagtgtcaggatcatcaatatcgctgtcttccacctccacatcttgtccccttggaaggtcttcaggggcagtaacaagcatggagctgtcacctccaatgataacaatgccttcttctggatacctcctgaaggacctgcccgaggcagttttacagttaacttgtttttttttttgtttgtttgttttttatatataagtagaaggaatacactccaaaataaggataaaaagtgtagtaagtacataaaccagtaacagtgatttagtatgaagtattatgcactatatataactgtacgtgctatactttaatacaagtgacagtgcagtcagtttttttacaccagcatcaccacaaacgcaggagtaatggttatgatggctacaagctcactaggtgacaggggtttttcagctccattataatcttatgggaccacctatatgcagtcaatcattgattgaaatgttatatggtacatgactgtatttctaggatatgtgttttatcttctgagagaagatgagactaattaagtccaaactttattgggccggcccttttcttctatcagtgtaattgtactaccaataatgtgctgttattcgtttcctattttacagcttacaaagcacttttcacaccttgaataatacttacaacaaatctgtaatggagtatccttattttcagaaaaagtaattgaggtttagggaagttagtttctgtgctctaaatgacacaattagttagggcaaaactttagaaggagtcacatagggattgtatccccaagcagaccattaattctaggtaaatcactgctttctaggtctcaggtttctcaactataaaacagggtggcgaagtgttctaagtataaaagtatacagttgtttaaatgaaactgagtagccgctccctacccaccacccttcaattaactgtggaaaaattccctggatgtggttgaagatatttatgttgtgtagacatccttctattagcatatttaggtgtagggtaaaaggctatctactgtgaatggattaaaaggacaaattctgtttttacagattggttggaaagaacccaaggggacatgggcacagcatcccttcctgggcctcttcctcaggtggtgcgggtgggaaatcaggaagctcccagacatggagcaactcaggtgatcatggaacagagaggtaaggattttgcttgaatttagagggatggttttgtacagatctggttggtacatagtaactctaaataaatatttataaaacaattggatttgtcatgtggctgtttggcaatgggtcagagtaaaacaaattgacttttcttatgactgagctgtcacctgagtcttattattaataccatctgtcaaacaactgaatcctaatctttagttaatcaacaaaattttaatgagcctacacccatagggccaccctttttttttttttttttttttagacggagtctcgccctgtcacccaggcaggagtgcaattgtgcaatcttggctcactgcaacctctgcctcccgggttcaagtgattctcctgcctcagcctccggagtagctgggattacaggtgcgtgccaccacacctgggtaattttctgtatctttagtagagacggggtttcaccatgttggccaggctggtcttgaactcctgatctcaggatccacccgcctccgcctcccaaagtgctgcgattacaggaatgagccaccgtgcccggccagggtcatgctttaaggtgtgggtgtttttattattcaggaggtgactgccattgaaaagatgtcttgttactccactttccaaaaggaggggccatgccacacagggtcacaccagggagtgacaaggtgggtcaggaggcagagggagcaatggaaaacctgggccagagcctttatttatggtttccatgaaggaatgggtgaggcagggtaagcaggctagtgtgaacacttcccatgggctctggggtacagggcctgtctctatcaggtagtttgatacctggccctgggtggttagggtatagtgtctccaccagtgagagcccaataaaggaggtgattggggcctgggatctggattggttggtttgcatatgaaagacagacatccttcactatctctaggaattggcccagccctgggaggggcagtctctccagggtcagcaaggccccagctgtcaaagcatcagaataaaaagacatgcttaattcagctgatataaattaggttagccttaaaaggaagcacagaattggcaagtgggagtgctaggaaaaatctggatatataacttatcgctctgtataatgacatgtgtaccaacacatattacacatccgttgtgggtcatgggtttggcattagtgagtgggggaaaggcttttatgtgttttactaggttaccttgtcatttgagatagtgtgtttctttagatggttttcctgcaattgagctatacaattaccaggtgacagtgggttcattagcatggtgtttctagcccctcctacgccacccccatatgtatacatatatattcttggttgtttaaaggtagcatttcattacccacctgttttcaagatacagggagataaatacaatcctaatattagtaccacagatttcaacaaaaatatatcttgaaaatatatttattatattattgcccctccaactccccaacaccagccccttccctgtttagttagagagaacagttcctgaaaaatatataagtaagcacacatattttatttttgttcaagaatgacatacatagacacattatcagaatcaatagttttttttttttttttttttttagacagtgtcatgctctgtcacctaggctggagtatagtggcgcaatctcggctcattgtaacctcagcctcccgggttcaagcaattctcctgtctcagcctcccgagtagctgggactacaggcacatgccaccatgcccagctaagttttgtatttttagtagagatggggttttaccatattagtcaggctggtctcgaccacctgaccttaggtgatccactggccttggccgcccaaagtgctgggattatggacatgagccactgagcccagcccgaatcaatagatttgtttgctgtaattcatggtacccttaggtgagtctctgaaaaattagctcccatatatgacttaacattggccttgttcttacagatgtatcatttatagaatgataaatgccactgactcttctcttacacacacacccacctgggcaggcacagggcaagtgacaggtaccacccatgcctctgatctcaggccagctgatgtagagcatgaggggattgcactgcttctttgtccatgggctgagaatttcctttcatgtggggctggcaaagcaatgcttatatatacaaacatgctttttttaaaaaaaaaaaatacttacactcatttgccagttcacccagagaagcaacaggtctcagggccagttctttctgctgggagggtccaatttaatcctttagacatagctaattcatttccttcatgacctcattcactgctgcataaccactcttcctccaaacctctaccctgatctcctccccaagtggtgctaagtagtcacatggagcccaatttctaataacaaatgaagtattttttccttgtcatcactttaataacaagggaaagaagcctccaaagccagagcaatagagactggatcaggcataatttagcttctcttgcagcctttgctctacatacctaacccccaactgtgttcttaacacctttcacttttatggcaccaagaataagaatataaatattatgcagtttcttcttcctttctttttttctttttctttcttttttttttttggctgtttttctataaagtcttcattaccagtccacattcccctggatttaataactgagtcccttttctttcttctagttagccttgatgtcttttctttcttctgtacaatagtcctcctctggatcaataatggttacctcctttataagtaactctcaaaagacttagatcctttttcagagtccaaaggcaacctctggggtcttggtggcttgggttcaggtaatgagagggacagcaacatatgctttattctgttaaatgccaggtgaaaatccattctgattgaattcaaagtgaagttgaaagaaaaaagtcttcacagaaacaactcatggttttgcacaaacctgaagaactcactagatatatccttcctgtgactgtaacagacagaataatctgcacttgggtttctctgttgctttctagagcatccgctatagtaattctcacacctttccagtttctgcatggcagatagagcagcaccttgggtaagggagtgagggctcaggtaaaataaataccccaagagaaaggcagccaagctctcaggaggaccagctcagaccttcatgctccagctgttaagaatgtttattttaataccttttgtaattccatagacctttggcgcattctcagagggagtagggtcagggaggaggggagacaatggtgagagcttcaggctacctgtctgaacaaggaagtggcttaaccactgtattagtttccaattgctgctatatcaaattactaccaacttactgattttaaaaaagatcgtttgttatcttacagttttgtaggtcagaagtccaaaattagtcttactgggctaaagtgttagcgaggccatattccttctggagtctcttagggggaatccatttccatttccttgcctttttcacctggtggaagttttcacgtgcattccttggttcttggccctcttcctccatcttcaaagccaacagggttgcacctctctgactctttctctattgtcacatttctctctttcccaggccatagctgggacagtttctctggttttaagaacccacgtgattagattggagccacatgaataatgcaatggggagaggataccctccccatttcaagattctcaatcacagctgcaaagtcctttttgccacttcaagtgacttattcataagttggggagggggaagtcaattattctgtcctaccacaaccacaaaattgacaccctcactgagatggaaaaaggaagcctctactttggacctgatgttgtgagtgagtcaggaggccacaccagctcaggaggcagagtttccaggaggcccttgtcaatggtatggagaattacaggaccatccagaactggtagaagagaaagggctcccgtgatgtgaccccttaggcctgcagcctattagtgtcaagagagaggttaaagcaagaatcaagcttcttgggtctgaggggcaaatagaaggcaaacaaaaataaataaaatagaataaaaaataaatattaaaaaatatgtttaaataaaaataaaattaaaaatgttaatttttggagaacttcggcagccaaaggagggagaggaatcattctgtagcttgagaggatgggaagattaaaggttttttgtctgtttgttttgttttgttttttactttaagttccgggatacaagtgtagattgtgtaggattgttacataggtatacatgtgccatggtggtttgctgcacctatcaacccgtcatctttatttaaagccccacatgcattagctatttgtcctaatgctcttcctccccttgcgcccccaccctctgactggcccctgtgcgtgttgttcccctccctgtgtccgtgtgttgttttcattgttcaactcccacttatggtgagaacatgtggtgtttgaagtttttttgaaggtagagaaaactcatgtgtgtttgaagaagggacatggagaagagaccaaagtcacccataaaactgaaattaaggtttcaatgtgaatttaaaaattgtcattattaatattattattgcttgcctgtaataaaatttcatgtgtcagactgatgtgatgtcaaataaagtagaattttaaaaaatcccattacagctgagggtccttctcgcttctcatttgtttcaccatcattgctagattaattcttaatcacccttcttccatcatgtcattcatggcctaagatcttgagtttctcgtgttgttcaaatcttctacagtctgaatctaaccattatttccaaacttaatctgaactttttaatcacaaaccctcctgtctggcaggacctggaagctcaatgtcttgtgtacataacttgttcattactatctgagttcacatggttttccattgcccaaatactcttcttcctctccaccaatatactcatttagatatttgaaagcttaaatttcattaatactttggctatctccatttataagagtcctcctttctttgaacacattaacatttattttattattatttttaattatactttaagttttagggtacctgtgcacaacgtgcaggtttgttacatatgtatacatgtgccatgttggtgtgctgtacccattaacttgtcatttagcattaggtatatctcctaatgctatccctcccccctccccccaccccacaacaggccccagtgtgtgatgttccccttcttgtgtccatgtgttctcattgttcagttcccacctatgagtgagaacatgtggtgtttggtttttttgtccttgcgatagtttgctgagaatgatggtttccagcttcagccatgtccctacaaaggacattaactcatcattttttatggctgcatagtattccatggtgtatatgtgccacattttcttaatccagtctgtcattgttggacatttgggttggttccaagtctttgctattgtgaatagtgccgcaataaacatacgtgtgcatgtgtctttatagcattatgatttataatcctttgggtatatacccactaatgggatggctgggtcaaatggtatttctagttctagatccctgaagaatcgccacactgacttccacaatggttgaactagtttacattcccaccaacagtgtaaaagtgttcctatttctccacatcctctccagcacctgttgtttcctgactttttaatgattgccattctaactggtgtgcgatggtatctcattgtggttttgatttgcatttctctgatggccagtgatgatgagcattttttcatgtgtcttttggctgcataaatgtcttcttttgagaagtgtctgttcatatccttcgcccactttttggtggggttgtttgtttttttctttgtaaatttgtttgagttctttgtagaatctggacattagccctttgtcagatgagtagattgcaaaatttttctcccattctgtaggtttcctgttcactctgatggtagtttcttttgctgtgcagaagctcttgagtttaattagatcccatttgtcaattttggcttttgttgccattgcttttgatgttttagacatgaagtccttgcccatgcctatgtcctgaatggtattgcctaggttttcttctagggtttttatggttttaggcctaatatttaagtctttaatccgtcttgaattaatttttgtatacggtgtaaggaagggatccagtttcagctttctacatacggctagccagttttcccagtaccatttattaaatagagaatcctttccccatttcttgtttttgtcaggtttgtcaaagatcagatagttgtagatatgcagcattatttctgagggctctgaacacattaacgtttactaaacatattataggtcagtagataacttccgtaaggtccaatcatcacactcacccatcttcctgcaacgtcactacattctcagttctttccactgttactgtgaatgaactatgtgtgtgcctacctaaaacaacctctccacttatctgccagatcccttcccctcctgcccacttacagactttgctccaggaagtctccctctctttttttgtatcaatttttccatctctcaataaccattctcatccgcatacaaatatactgctttccccctgtcctcagtaaaacaaaccctctcttaatgccactttcaccactagctgctactccttctctttccctttatgacaaaactccttgaaagagttttgcgtatacccattgctataacttctttctttccattctctcttcaactaattccaaacatacatccccagtgcgcttattaaactgctgttattaaggacactaaagacccgtgttgctaaatctaatgctcagttaccagttctcatcttgcttgactaatcagcaactttgagatgctggtgattctctactgtttgaaatactttcttcacttggctcccaggattccacactctcttacctctctggccactccttttcagtctcttttgttggttcccattgatctcctagacctcagcacaaagcagttttccatgttcctctcttctattctatcaacacccacccctggaggacatcattcggtctcatggtttaggtcccatctatatgttgattatcatgtctctcaaatttacatctttaatctgaaactctcctgtgaactctagacttgtgtatcttactgcccactcaacatgtccacttggatatctaataaatatctcaatatcaggagctcagtgtgccccaaactgagctgatattgtccctgccccaccttgtactttccacggtcttccccatgtctgttgatgacaactccacccagtccttttctttctctttcaccacacactacatgtcagctaatcctattggttctactttcaatatgtatccagaaaccaaccacttctcaccactctacttttatgacctggtccaaaacactgtaatctctctgttaggtacacaaataacagttaagagtgcaggccctggagtcacaccatgaaggtttgaatcctggcactgccacttactaagagtaggatgttgggcaagttatttgccgtctctgagcgtcggtttcctcatttgtaaaatggggataatagtaacagcaatattactgcttctagtactactaatattaattgttacaaggattaaatgagaaaaacgtataaactgcttaacagtgccttgcaaatagtatgtgatccacacacatttgctatatactattatgctataaatctatgaaagcttcatgacaataggtggaaaattgtaggcaagaagatcagagaaattgtggaaatggccattttcccaagcataaagcatccaaatctttaaatacccaaactcacactgaaccaggttgggaaatttttgtaccaacccactctgacctgtgtctattgcttggtatgttgctttctttgtgcggcttttacctatagatttatagaataacaatccatggctaacatttcttaattatgtactatttgctgtcattgcttctctttcttttgtcttgagaagaatttctacagctcctcttttccaaattttcattcagatattcagacaggcttagacctgatactgcctgtatgtgggttggcctcccatttcaggatttcatatctagtttgctgtcacttctacctattataacattcaaaagggggccctataagaactacaaaccactgcgcaaggaaataaaaggacacaaagaaatggaaaaacattccacctcatggatggaaagactcaatattgtgaaaacagccataacgcccaaagtaatttatagattcaatgttattgccatcaaactaccacagacattcttcacagaattagaaaagaactactttaaaattcatagggaaccaaaaaatagcctgcatagccaagacaatccaaagcaaaaagaacaaagctggaggcatcatgctacctgacttcaaactatattacaaggctacaataaccaaaacagtatggtactgttaccaaaacagacatataaaccaatggaacagaatagagacctcagaaataagaccacacatctaaaaccatctgatcttcaacaaacctgacaaaaataagcagtggggaaagtattccctatttaataaatggtgctgggaaaactggctagccatatgcagaaaaccaaaactggaccccttccttacaacttatacaaaaattaattcaagatggattcaaggcttaagtgtaaaacccaaaaccataaaaccctagaagaaaacctagacaataccattcaggacataggcatgggcaaagattttatgatgaaattgccaaaagtaattacaacaaaagctaaaattgtcaaaagagatctaattaaactaaccagcttctggccaggtgcaatggctcacacctgtaatcccagcactttgggaggtcgaggtgggcagatcatgaggtcaggagattgagaccagcctggccaacatggtgaaactccatcctactaaaaatacagaaattaggtgggtgcagtggcatgtgcctgtaatcccagctactcgagaggctgaggcacaagaatcgcttgaacccaggaggcggaggctgcagtgagctgagatcgtgccactgcactccaacccagtgacagagtgagaaactatctcaaaaaaaaaacaaaaaacaaaaaacaaaaaagaaacaaaacaaacaaaactaatgagcgtctgtacagtaaaagaaactatcatcagagcaaacaggcaacctacagaataggagaaaatttttgcaatctacccatctgacaaaggtccaatattcacagtttacaaggagtttaaataaatttacaagaaaaaaacaaacaatcctgtcaaaaagtgggcaaaggatatgaacagacacttctcaaaagaagacatttatgcagccaacaaatatatgaaaaaaagctcaacagcactcatcattagagaaatgcgaatcaaaaccacaatgagataccacctcatgccactcagaatggtgattattaaaaagtcaagaaacaacagatgctggtgaggctgtggagaaacaggaacacttttggtgggaatgtaaattagttcagccattgtggaagacagtatggcgattcctcaaggatccataaccagaaataccatttgacccagcaattccattacttggcatatagccaaaggaatataaatcattctcttacaaagatacatgtacacatatgttcattgcagcactattcacaatagcaaagacatggaaccaacctaaatggccatcagtgatagactggataaagagaatgtggtacatatacaccacagaatactatgcatccattaaaaggaatgagatcatgtcctttgccgggacgtggatgaagctggaagccatcatcctcagcaaactaacacaggaatagaaaacaaaacaccacatgttctcactcataagtgggagttgaacaatgagaacacatggacacagggaggggaaaacactcatcggggcctctcagggggtggcgaggagagggagagcatcaggacaaatagctaatacatgtggggctgaaaacctcggtgacaggttgataggtgcagcaaaccaccatggcatacatatacctgtgtaacaaacctgcatgttctgcacatgtatcctggaacttaaagtaaaaaaaaaataataataaaaattaaaaaaaagggggccctataaacccagttaacactgcaatgagagccattgtaaattctcattttattgacaaaaagaacctgggcttcttggcaaaagtagttgatacaaaaaaggtaaactgctgagtgagaatgaaaaaagcaagtaattaaaactacacccacgaaattcaggaccaaaacagccagacatctttcagaaaaggaagttgataaattaaagaatttccctagatacccagaaaataaccttttatatttgggattcaacttcagtgtttgaaactccaggattttcttttggctaaatacaaggattcttaggagggaatcccttgctgttgtgatttggtttcagcggggttcagaagggcacatggtgatttggctgcaaaacactaagagataccttccccactgccaaccccctccccaacttgccactcatgtaatctgaggctctcggtaacatgcaggttgcagacaccaaatgaattaggcagatggaactcatacgtcaaagacacatacttggattcctttttggccattggtgcatttcctctctttcttttttaatcagcctcataaatctgaccttgacaaggtcctgcctctctatagcatagttggaggtgagatggtaatatgtcctgaagctttcattttcttctccacttgagtgaccatcaatgccacgtggcacccattcattatggggctcaggtgcggctgtgaggaggcatgtgccaagtcctgccaaattggttactccttccaaaagaacaggatggttctccaaatactgcatatcagatgataacacttcgcagtgcccgatgaaatcctggcatgcctagagctgtgaggaacacaacacattgttaggtattcttctgagtatctggttcataatagctatttacatactgactaatgactacctggattcacataatttttaaaggggtttatccaaatcgagaattgaagacaaaatcagagtggtccagaatagtaaccttgttctctgaggtgggggcaaatgccaatggatttgtgttgaattcaccattttcagggatatctgactcaatgtttgtctcctggtcttgacaatgggaatctggaatactgacctagctcatgtgggcaaagtatggatttctcaccacttgtgaaaagctgccttctggcttctagcagttacatctttgctagtctttggtccttcctgagtttttgccgttttctctctgcccttcttggaaggaggccgtctctttttctcctctcaaccagaggctgtccacagctggctcaatgtccccttgtgctgccaggtcccctcccctcctccttggttggggaggggaagttccaggcactctctttattctccaagcatgatttgtacccataaaatgtggtagctatgggcagtctttttccatagcggcctttctatctagtccattttaaagaccttgagaaatggagataccttatcgtactctggcagcttatttctgctattcacaaaacagcattaaactccttttatgggctcataacaaaatagcctattgaaagaatataatggcccctgtgcttttgaatgctcatcatttcactattactaaagatgctttatgtttttagggtcctgatgataggtcttcatgcttttcattagggcataatccttgggagagtaatgctctataccacttccaggactgtggcctgcaaatgtgagcagtcaccaaatattattgttggagctgataaatgagaacaatgacaatagctgtcattcatatattgagctctttttataagtcagattttgcattctttatgttgataagtgctttatatccattatatgtttggatgctcctaacattctaaaggtattattattcttatccccatttcacggatgaggaaatcaaggcctgaagaagctaagtactcccccattgtgcaaatcacactagaatttaaatccaagtctctctgatgccacatcctagactctgtgttgtactgtcactgtgtcatcatagattattagattcccctgtcttggctatgaggacacatattttcatagttttccccccattttcctactcatgcttttttgtggtacctcctcctctaatggagatctaaatgcttgtgcctcagagcctggatattgacctcttagtttttctagctatactttcccctaagcaatttcatcaagtcccatgagtttaattatcagtatgcgtatagcacctatgcgctgatatagccaaaatctaaatctctagaccagatgcttccctcaggttcacacatccaattgcctctccaactgagattggcagcaccattcaagcactcacactagaaatgtagcatggctcttgatcgcttctttccctcatctgcactcgcagtaatttttaaaaattcatttttatttttaacttttattttaggtttgggggtacatgtgcaggtttgtcatataggtaaactcatttcacggggtttattgtacggattatttcatcacccaggtactaagcctaatacccaacagttactttttctgctcctctccctccttccatcctccccactcaagtaagccccagtgtctgttgttcctttctttgggtccacgagttctcaccatttggctcccacttataagtgagaacatgcagtatttggttttctgttactgtgttagtttgctaaggataatggcctccagcgccatccatgtatttctatgattttgacctttacccatttctctctgtttccactgctgcctccttagtccaagttactaatatttcttgtctgcatgattgcaatagcttcctgactggcttccctgccttcacacttgctacccccagcttcaatccatttttcacacagctgtctgagtgacattgcaaaacaataatcaatgcctctcccctgcttaaaactcttcaaagtttttctttggactgaagtccaaactccatagtttggccttcaaggcctgcataatctagcattgcatatatctgcaatttcatctcatactaccccttcctcattcactactctctaggtctctttgcagttcctcaaagctctttcatgcctcaggacccttgcactggctgtttactctgcctggaatgctctttctctggcccatgggtgctcaataatgttaatggaataaatgagtatagattgtttctcttatttgaatactataaataactaatgagaaaaataatgtgtcattaacgttttagccatttgtatttataacatttaaattatatggtcttaatatgatagacctatggaatttctgaagcatgtttatgtgtttacatggatggagtagggaggataagagagtgggaggaatgtattcagcatgtgataaccatgaatcatgcatcctgtgagatagatggtgatatccctatttttcagaactcaggtggtttgggaaattaggtcgctggctaagggtgaataggtagaaagaagtgggtagaatttacacgtggtttgaccccagtacccatgtgcattccccagatcctggtgcctttgagcagacacagcagagagagaagtttgaaggtagaaaagaggaaagacagctggaaatactggtttttttgttcatctgggcagtatcacaggtggctgtgaatcagagacaccggatatcttagttatatccaattctgccttatttgtcaaacatggcccaaatgaactgaattagaccccaacttcaaaacccagtatccatacacaaagaaaaggtggtgagtacagttaggtgtggcaattaatgagccaccatctgctgaaacatcacactttaagtgggacttaacatggttatgggtttctttgaactttttttttttttcctttcccaccatatgtgcttaaaggctccaaaaaggaaacagcttaatccaggaatgtgaaaaagaatggtgacattctgcggtgtgtcagtgaaatgagaaacttatcaggcactgtctattttgggggttttgtggtattttatggttccaggcttctagtcagtgacaaaatggcactgccaagatgacttaccacatgcgtggggtatagcagagcactatggtaggtgctgcttctaaaatttacttttggctttgccctggactgagttgacacacatacagaaaatactccttttcctccaaggcctaactgagacagcatcttggcttacccatattcttcccaatggagaaaggaatctctctgtagtaggttttcctgttgcattgttttgtaccttggtgacagtactagtttcaggcagttcttctttgtggcttcatgcatttctatcttccttaccaactaccttaaagctccctcagggcacaggccgtgttttcttcatctttacaaaatccagtgggactttgcacaataacttacattgaaggtgctcaatatatgctgttgaattaaaataaaattgttttaggagaaaaagttagagtgatgactttaacataagatacttcaaaaatgtgcaaaatgcacgttttgtatatattgtatatatttgtaggttaacaatataattgactgtatgcttatattgaatgctgaaaaaaatctgatactaccaagaggaaactttcacactctttatgaaacctagtgtgtagttttggttaaaattcatagtttaaactgcagaatctaaacgtttgaaatgaggaaagatgttgcttttaatcttagcactggtgcaacagggtgaaaatcttttagaatatgcatggttaggatggttagcttagcacaggtatgtcaacaaagcattaccatagctctgtgtttgagatctctctctctctcactctgtgtgtgtgtgtgtgtgtccatggaccttttttcttaggaaatatttatttaaagaatttcctgactatagagagaaatatgatgaatgtcatagatattatggtaagtgcgtttggagaaggcaaaagtattttgttttctaaatatttaaacatgacctgcacatcagttgtgatgtgtaaatgccatgggaatactgggagcaacaaagaaggggtttggaatgctagagtggatagttctctctaacccagaaaggacagttggaagccaaaagatgagataaagtaacacttgaagaatatgcatttggcaacaatatccgggataactgcaggaaggttgatcctggagtcatggaggccaaggaggaagctgtaatataatacagatgtgacgggtagaggcacagtaagagcaagtggtagaaatgtagaggaaggagtggatataaaagaaatttcaaaggagagatctctataactttgtcaatgtgatagataattctaaaatactgtgtctaagtgaattgagtgatataacaccagcaaaagagttgaggagggcagttagaccataaggaaatatgagactttaattttgaatatcttgagcccaataacacattaaaataccctggtggaaattctccggctctccctgtcatgtgagggattctgtttttctctgagggatgcactggggatatcggatctggagatggcaaagagaaatttaagacaaataaaaaacaagctaagtttgaaaacatcaaggtcatagcatagccacagctaagatatgccaggtgttctggctggatatttgatctcccatcatcttgactccatgctgagctaaatggcctcctacactgattatattcaggtatagacttttccttccactcatctacagctatccagcttgtagtcagtcattagaacatgttaactttatgacttaaaaatgtacaaaaaatacttattttacagtggcctaagacactgaagcctccaaatgtatgaagtagacactaggccaaagaggtattctctgactgcaatacaaatatttctgatatcctcttggcaaagtttaactcatcctttaagaactaactcaacagttactgtctctatgtagcccacctgactccccacggcagttagtctcttcattgtccatgttcccatgaccctttgttctcttttatttttttactacagcatttgcctctcattctgtcaatacatctgtttctcgccactaggctgggagtatcttgaagatgggcaccacttactcatcttcatatttttcactcccctaacagagtagggggctactgggtgatagttcattgttggaagtatccaaaaggggaattttaaaaacatagatggagcaatgtgcagttgctgtaacaaagcctgtgtacacatcatatgccacatccctgctggcgccattaatgctgcaccagcagaggcagcgctctcattacatactgctggcccatatttgtaatgtgtgacattttttatgaaatactgtcaagggcaatccatcatatagtaacctttggattatatgctgagaatggtcttaaacatagacataaatgaacttgaagaataatgctattttctaaaaagagtatgatcaaagagttctagctaggaaaatgagacagaatggtaagttcttttaatttaaacagaagtgccttaaaaagaggctttcttctgtctagctccagctgaagacagggttattgtgtgaagatgattaggtgactctggaatgtggctgaatatttatttcttgtaatacatgaggtgaagacttgaaaaggggatgaggacttgctaaaggcttgacaacccttggggcttccaaggttttgataactttatctcaagatgcatttctaaaaataaaagaacacatgatgacttgagtgaatttcagatgtcaactgtggactcacagttaaaggtattctctctgtgcatctattaagatctaggattttatacatattgtagagtataaattaaagaaagcttctaagtcttatcatttttgtgtaaatccagctaagactcctttgatgagctcagtgtttgctgtgaaggaaaagcttataggtgagaggaacactaaaattataattctttgtcttccttaattagactagagctcaccatagaccttgctgaaactgtgagaaaatccaagcaataattcacactgtcaggtcagcagaaatgggaatgcgggtctgatataactgaaagatttgcttaagtgatctatctatgaactgaaccgctcagaataggcacacgatcttcactggaaatgtaccctctgaagatgctaaacacaaacagcaatgaaaataaatcccagcaagagccttataccacctttacagatgtcatcctagaggaaggatataaagcatattaataccaattgatgtagggcactaattaataagtcccattaaatcatggagtaatgacatttagcatgtaatgaatgcctcataatttcttcatcattaatatttcatagcataagaacacaagcattttcatccctgggccagtgcagcatggttttctgtctctgacatgaccacaagggcattgagtggcacgagtgtattgcacctctgtggtatagactgactataccgcacaagtgattaactcttagcaccccgggtcctagcgtttcctcattttagaaaatgtgaatctgcctgccattcttggaagtaacctctgtgactggaagatggaagaactgccccaggctcaggtgttgactttggtgtgtagcattgctttgctgttgacccccaccccccagcccaagaaggaaacctgcacaggagaaaatcattactttgatttattactgggggcttgctgtatgcaaaggcaataatcacctcatggagcaggtgccactgccagggttcattgattccaggctcttctagaaattccaggaggccagtcagtctggcgggagatggacgtagtcaacgaaaaaagaagtccatctcatagcaggttgaaatgaagtgggagaaaaatctctggtcatcgttctatcgctccactgacactcggtgtctttttctttcagaagaggggcttgagcagagagaatgcttagaggctaagcgatgggcaagtgagagggaaagagccgcgacagatagagctggctgcctaggggtctcagaggcttcatcctgcaggcggcaggcggcaggacaaagggaccttcggactccagatcaagattccaaggagttaaacgctaccacgcagcccgacctggatgggatttgctcctgggtacaaaacgggacactgatcaaaatcaacttggacaagtga

SEQ ID NO: 808 - DNA, 486 bp, Homo sapiens
atggcggacattcagactgagcgtgcctaccaaaagcagccgaccatctttcaaaacaagaagagggtcctgctgggagaaactggcaaggagaagctcctgcggtactacaagaacattggtctgggcttcaagacacccaaagaggctactgagggcacctacattgacaagaaatgccccttcactggtgatgtctccattcgagggcggatcctctctggcgtggtgaccaagatgaagacgcagaggaccactgtcatccgccgagactacctgcactacatccgcaagtacaaccacttcgagaagcaccacaagaacatgtctgtacacctgttcccctgcttcagggacgtccagatcggtgacatcgtcacagtgggcgagtgccggccttgccggcctctgagcaagacagtgcacctcaacgtgctccaggtcaccaaggctgccagcaccaagaagcagttccagaagttctga

SEQ ID NO: 809 - DNA, 53249 bp, Homo sapiens
gtcgcgtccgcacttctcctgcccgagagagactgagccgcgctggcagctcgcgtcgagtcggtctgccctagccgcatcccgcggcgcccggtcgggctccgggcaccaggcaacacctaggccgttcccttcagacagccccgggccagcggccccctcgggaaatgtccagcggccgcagaaggggcagcgccccctggcacagcttctcccggttcttcgctccccgaagtccttcccgggacaaggaagaggaagaggaggagaggccggggacgagcccgcctccagctccaggccggtccgctgccaggtgggagtcgaggagggggtcgcgggggggccctgcacatattcgcgggatgaaggctcccggcctgaccgccggcagcgggccgctcttgggccaggctgcagttcgctcgccactttctgttctccttcctccattgctaaagtttcctcctccttgccccgttcccgtgccgcactactcgcctctcctctgcaggttaaatcggggtgaagttcttgcccggcagccggacgcatatcccccgatccccgcctggctccgcgctcttcctttcccactttcccctgcccggacgtgattgggttcccgttccacacacgctctactctccaagttctgtggcaaaagcgatttccccggcgtcccgcctgcagtaatgggaaacacttgtgagccgagcggagccgtcggccaggggaattgggggcgcgatcccagcaccacttgtgtgggaggagatcggggcaaaagtggaaaaggtaaagctttggggcgtcaccccctcagctggtatttttgccatcttatttaaattttctcaaaatgatttttaaaaggaattgtgataatgcgttcccaagactttcaccaaaatggactggacatgtaaatgacgccacccttctttatttctcatctctcctagaaacatctgcctcaagttcccaaacagattctggaaatcaggtttccagctgtcttggtttcagtaatcaaaatgtaccctttctctgtaatatttttatctttccttcactttcccatgttcaaaaatcaaaaaattttagacatgcctcatttaaatgcctgtttctgagtcttttcatccccccgaagaaagaggggttaagtaaaacgcagctcgctttcttaaacttatgagaggcttacactgtcttctcccgagattgcactagaatgaccattgtcattggaaggacacactccagaaaaccgtgtttacttcggactcaagatttcctggtgggcttaaaaaaaatggataggaaacagaactgagagtgagccaattccattagtattcagattttgtgatgtgattttagtcgtttgtgtgttcctcggtttccccgcttgtgaaacattttcattatgaccgtctgttaataacatgccacatgtttccaagaaagctcctacgataattgagtggttattctcctgggacgtttcagctattattgctctgactgttgagagtttaaaattcaaagttacacagaagttaaaaatagtttttaagtctgacagatctcatccagggtgtcagctagttctgttggtgtgggcagacagcctgtggtgcctgccaccgccgtaacagcactaacagtcttggataatatgaacgcagtctgcaaggaaatcccaagtaggcgcagcaaaagttgggaacttgagagtcagtgttagaaaggagtaagcaggtcaaattcaggctcatgtcagtaatggcctgaaatcctgcttgcctctctgccctattttggctttttaaggcacttctcaattctaatttctttactgactggagctgacccctccagcaactagttccttgttcacctaccacttctctattctcatcatctccagattggcacaaattatggcttttcaacgatgaagattttaattgtgcttatatcaacgctaattttgttctcatcttttttggaacttgccagatgttagggggatagcagatgaccctttatgtgggtgttttactgttttaaatgagcttaaatctttcatttcaagggcataaacaaacacaaagcctttattgaaagtttaataaaacaaatggaaccgctttatagtactgaatgtcccagtaacacaacaccctgatgttaacaagattggaaacagaattgcaatttgtcactgtgatcttatttcaaaatgaaagagtattttggctatttctctttgtgggcataaaaacttttatcattatgagagctgggtataccttctgtagtgatgattttagatgaagaggagtacaaaattaaaaaataaactaaaacataattatgagacccgtaaaagtcgaatttacaacatcctgaaactgtttttttgcctgctcacaaaatgcgtactgggacaaacaccaggtctttggggagctgccatgccttgatacaggtcttccaatattttactgttttgaaccataggaaaatctttgtttttatggtgtgctgtgatttatatgggcttcagttggtgacaacacttcattatgtattctttctttgtcacaattaaagaaggcctattagcatcaacactattgtatatcccaacttaggcgtaggcactcaaattgcttgattgtactcatattaggtggttgaccatttccaggaaatgcttatattaatttattttagatgataaaaaggaaaactgcaattgaagttttcataggaaactcaaaaactcccagagttctgtggatcccagtttgagaatcactggtgcagtgttaagcccagtttataagcatacaaggaatggactcattagaagtgataggggagaccaggaagtgcttcctggtagggatgattttaactgggtcttcaaggaattggtgatgtttctatacaaagagaacttaggaagagagagaatagggaacaggtattccgggaaaaggcattccagactgagcaaaggcctgcaaggggtttatgatctgttaggggatatatacattaatgggacagagtgaaaggagcagtaagaaatttaggttggaactgggttataaaggtctctagacaaaatgtttggctctagatttaaggctcagagaatttttgcaaaagcctgttatacagatattgctgaaatatgaaacttggaggaattcctgcctttatctgcttcaagaaatgattgctcaactttgtttcttggctgtatcatgcatgatggacctgtttaaaatgagttctgtgcaatgtttgtaactgtgaagagagatggtaaggtgagaacagtatttatcaagggctgactgtgcacttacttctgggctgggtacttttacttgcaacgtatcatgtaaatctcacactcagtgtgaaatgttggtccacttttacgatctgacaattgaagaaactgagtttgggagagtgctcagtgatggatgctatgggcgttttgaatggaacaattctttgaactggactcttttgtcctttgcaagatgtttggtatccatgattacacacactaattgccagtagcatcctctggtcattgggataactgaaaattcctccacccaggtgggtgggagggagagtgataccactcccagtggagagtgattaccctaaatcgtgagaggaggtgaatgggtgggaccaggctgctaatgagctgtggtgtaggaggtactctgtactgtcagaaatgtcagtagtacttctgatgaccagcatgggagagctattggccttcaggttaaactaccagtgttgacaacagcatcagttatgtgaggaaaggaagctttgttttctaaattgtcatgatgattgcatttttattgatttgaagcactaaaaataattggtaactagttagttggataggagatacctgtgtcacatcagcagttcatgccttcagtagtgaagatgacgagagaattccagaagtctttaggggtgtgtaatttgtgagaatcttgtccccctctgctcctctaggttaattcaaagcaaaagcttactcttggcagcagagtcaaaatatagcctgttgtagggtatcaaaagtccaccttttccaagtgatttccatctcttgggttcaataaggtgtctaccagatggctaatttgggaattctattttttgctgtgaacattccttggaaatggactcaattgtatgctctgaaagtgttaaagttgcaaaggtaccacaaattgacctgcagtaagtttatataatcagaacttctaactttattgacagttataacatttttaagtttttttactcataacagcggaaaatatgtaaaaagggtaatagcaagttttgtaaaataagagaaaatattccctcaagacaaaatattttctatccaaagttctgatgaaatataccaaagtccagatataagaaacgttagttaccaattattaaataaaatgatagcaacaaactgtaggtggttgtaaaattaaggaaaataatctaggctatatgctgaaaagaaggaatcagcatgaagtaaaagttaaggaggtaatacctactttgagtctgttcaatccataagttagagtggctgctttgtgtctcatatggtgcaaagcaatgtggatataaccataaatggatgaccaaatatgccttcatagaattcacacattaatggaggagataaaagtgtacatctctgttcttaatatgaactcattataaaccaaacatgtctttggagtgtgtgacttgtttcgttcagagcatacttaatgtttcacgaatgtcatacgttgtatgagaactttaactgggctttcaaaatatgttctcacattattaacttttctccaagcatggtttggttagcttcctttgccaaggcagcatagtgggggaaacatgatagtaactgcaccatcaaggtgaatggaaatgctgccccttggttcctcttgctttcctccttgacccttcaggctttgcaagtcctggatagaggcagaaaagggcatcccttcgggaatcaacattccaaaaaagtggcagtgctttttttttgatggaaagaagttgagacaggattgctagacccaaggtcaggggctttgtcttcatctttgcgtccccttagttcaggtgaggagtgactgttgattggagcattaaaggacttattagtaacattcagctaggggtggtaccctccccaaccttcaagtaggcacttagaaacaccaggaaggttgatgctgttagagaacaaatcgaagtttttccactagtaataagtcattcttagtgtttatttggcagttgtacgtggccaagtaatggtacaactccatccagcaggactgtccctgaatgttttacttactcccaggagtttttaattggaagtatgctaaagcactgaaacaagagcttaaccaagtgtgtgtttgttttctttcttcctaatcaattaatgatgacaaaaacaaactaacctttattaaggccctaccctttattaagggtacccttaataccctttattaagccctgagcttggaactttaaaaatatcaattcacttaatcctcagagcaaacgtatctttactcccttttacaatatataatttaaggcttcaagaggttcagtaggtaatcaaaagtctcacaatattggtagtagagtcaagagtcaagttttccttcctgaattcaaagcctacagcattatgtgacagcttcctccgcttaacttgggaagactcgtaaaagaaggctgcccttagaaaatggtttggaatggaaataaaagacaatggcatgcagctggacatctgcccagatggactgggtcagagctatggacaatcaagaattatactcctgagagttgggagaggaaaataaatgcacacatttatgcaggttatagatttatatttaaatacaaagaaagggtcagtctccttcaaaagagagtttcagatggaaaccatagcaagataccatattctacctatttgataagcaaaactccagtttcatgtggggaagctggaactcttatacactactagtgggagtataaattgatacaccactttggagagaaatttgatatgacctatcaatattgcagattcacatactcagcatttctgatttcagggaattccactgaacatgtacagtttgcaaacaggccaaaagttgcctatagaagttagtcattgcagcattgttttaatagcaaaagatgaaaaatagagtagaatgccattcaattgtggactaactgataaatcacagtacatccatatagtgaaatatgatgtatctaccaaaaagaataggaaagctttttatgtactgttaaggaaatatctccaagatacattaagttaaaaaaaaaaaaaaaaagccgggcgtggtggctcatgcctgtaatcccagcactttgggaggccaaggcgggtggatcacctgatgtcaggcatttgagaccagcctgaccaacatagtgaaatcccatctctactaaaatacaaaaaaaattagccggtgtggtggtgcttgcctgtaatcccagctattccagaggctgaggcaggagaatctcttgaacctgggaggcagaggttgcagtgagccaagatcgtaccattgtgctccagcctgggcaataagagtgaaactccatctcaaaaaaaaaaaaaaaaataacaaaaacaaacaaacaaacaaaaaaaaacttaagctacaactaattgtgtatagtatgccccatttgtatatacaaaagaaggggatatgaaataaatctgtcactagtgttgcataacttattttgggggtatggggaactgagtgaagggatgagaggcaggagaaagactgtcttatgcctttgtacacttaaaaattatgtgaattacctatttcataaagtaagaaaaagattggattaaaatctggtgaatacctgtggctaaaagaaggaaaaaaaaagaaaacaagagaatgtatgatcctgagttggcaaaaatcctccagagagagaatgcactacattaacttattcaaaggggaaaagtttcagttaaggatataaataaacagaagtagtttttgtaatgcagagtaatttgatattttgacactttgtacaagtaggagtgagacttttctatattattaatctctaatgtgaaactgggtggagttgacacttgcagccacaaatatatcaacataactcatttttacgtgctcacctgtcacccaccttgacctctccagtatgacccaggacaggttattaacctcagagtctttagtgataaatcaagggagttggttttcatctctaaggtctctctcagctttagcgtaccagccaaaactccatgggctattaagtgtgtacaaaattgatgtgccttataaattagaaagatttatattttattggaaaagtcacatatgaaaatgctttggttaattcttccatgtgatcctaacattttggttatttgatttgaaagcttcacctgtgtttaaaaagaattaatttagtgtcgctgtgtcaagcaccagtctaggtcctgggaatccagcagttaacaaggtgcagcattgtctttgcctcaaagcatgcatgcagttttgtggggaaggcagacattgcccaaatctttcttctctcttgaaataagtaccaaggtaacatgtaggggactgtaggagcatttaacagatgtgagcccatttttgaggctctcagaggaaactttaattttttttcaatctcatttaagctgtttctcctggaacatgtgtctaagtaatgtttttctgttcttggtttataaactttggacaatatatattgacctctggtagatgagcactcagctattttatacccttccacatctcattactcatccagccaaaataatcattataaatggaagattaaataaacctgtagatttctatgaatatttagctgttgttttctgctaagccaagtgctgtactatggttactttctttgtgtgatattttgtttttcatggagtaaattaccttgtttttcatttgcttattgctgctacttctaggatgcacaaatacatttataaaaccactttcagtgcttttttctacatcattaaatcacatctaccagtttaccccatgacttccaagacctttctcttggtctctgtgtcttcctgtaatttgtatcatctagtagttcccaagcttgctgtattgatctctctactactcagccctatgtaagaccacctatttttggacttcacgtattcctctttcttggttaactcctccttttgttggcatatatctaacaaacaagggtacatgttagatattttttttgtctttgcacttctgaaaatacatttttctactttagtaaatgatagtttgggtataaatttatagactcaaaattacttgcactcagatttctgaagacatttctctattagtcttctctttaattctggattgttgagaaatctgaggctagtacgatttctggacctatttttgtgattcattttttctttgtgaattttgaaatctctcttcagtgtagactctacaaatgcacagtaatgtaccttgcacagtgccttttaaattcattttgctggacagttggcaggctctttcacttgagaggcttatatcttaacgatttagaatggagagtttggctcaagctccctgtgtgtggtctgtgctttctatacttttattcttggtattccagagtctggaggcttctctttttaaaaattgctaggctcctgccaaatgttataatttggggatgtgagttcactaagaaatcaactgacaagaggcagattaataggagaaatgacatcgaaatttattagcatgcagggggaaaaaattgattaccaaatatcccagtagggtagagatgcttatataccccacctcttaagagagagggaagtggatgattttaggggaatagtaaatactttttatgggaactcactgggcttgaagaacataacaaaggcctgggacaaagtctgttgggcccacagaacagacagtggtttatgacaaaagtctgttgagatgttatgacagacttcagtctttcttcttgtaatatgattcagttaatgaaaactagggaagggactagaggtaattgtttttttctttgatgggtccaaactttaagcagataagagaacttcagagaacagaacttcattctgtgctttgggagagacagaggatcaaagacaaaagacgaaggtgggattcagagagaccttgaggctgctcagttcagcatgtcaaagtgccatattttggggtatgggattctgagtttttatctattcttttttgtaaaagaattattgatacataattattgtactgtttatgaagtgagtatatgatattttgttacattcatgcaatgtgtaatgatcaaatcagggtttttagtatatcacttcagcttagcacttcactgttagagtgggggggattaccgttaacaatagtatactttaaaatagctagaagataacatttgaaatgttcccgacacaaagaaacgataaaagttttatttattctaaattatatttcttcctgtttttctctccttcaaaaatctcatctgtcctgaatgctgttattcttcgtctttttttttaacctgatagcttatttcctcttattaattgctttaccatcgtttccatgggacagagttaaacatgtgttcacctatatgcttttgctagaaatagctagaaaatctttgcaattatcattgtttccaaactttttaattctttgagtataaattgaactccataacctaacctctcaatgatggctatgaggaaataattgcttgctcgttgataggaagaatcgatattgtgaaaatggccatactgaccaaagtaatttatagattcaatgctattgccatcaagctaccattgactttcttcacagaattagaaaaaaaatactttaaatttcatgtggaaccaaaaaaaaaaaaaaaaagagcccatatagccaagacaatcctaaggaaaaagaagaaagctggaggtatcatgctacctgacttcaaaccatattagaaggctacagtaaccaaaacagcatggtactggcaccaaaacagatacatagaccaatggaacagaacagaggcctcataaataatgccacacatctacaaccatctgatcattcacaaacctgacaaaaacaagcaatggggaaaggattccctatttaataaatggttttgggaaaactggctagccacatgcagaaaactgaaactggaccccttccttacactgtgtacaaaaattaactcaagatggattaaagacttaaatgtaagacctaaaaccataaaaaccctaaaagaaaacctaagcaataccattcaggacatagacatggacaaagacttcctgactaaaacaccaaaagcaatggcaacaaaagccaaaattgacaaatgggatctaattaaactaaagagcttctgcacagcaaaagaaactatcatcagagtgaacaggcaacctacaggatgggagaaatttttgcaatctatccatctgacaatgggctaatatccagaatctacaaagaactcaaacaaatttacaagaaaaaaacaaccccatcaaaaagtgcacaaaggatatgaagagacacttctcaaaagaagacatttatgcggccaatgagcatatgaaaaaaagctcatcatcactggtcattagagaaatgcaaatcaaaaccacaatgagataccatctcacatgttagaatggtgatcattaaaacatcaggaaacaagagatactggagaggatgtggagaaataggaatgcttttacaatgttggtgggagtgtaaattaggttaaccattgtggaagacagtgtggcgattcctcaaggacctagaactggaaataccatttgacccagcaatcccattactgggtatatacccaaaggattataaatcattctgctataaagacacatgcacacgtatgtttattgcagcactgtacacaatagcaaagacttggaaccaacccaaatgcccatcaatgatagactggataaagaaaatgtggcacatatacaccgtggaatactatacagccataaaaaagatgagttcatgttctttgcagggacatgaatgaagctagaaaccatcattctcagcaaactatcacaagaacagaaaaccaaacaccacgtgttcttactcataagtgggagttgaacaatgagaacacatggacacagggaggggaacatcacacactagagcctgttgtcgggttgtcagggggtgtctaggggagggatagcattaggagaaatacctaatgtgatgacaggttgatgggttcagcaaaccaccatggcacgtgtacacctatgtaacaaacctgcatgttctggacatgtatcccagaacttcaaagtataataataaaaaaaattgctaaaagattacaaaacagaggtttttcgctgtcatagtctgtgttctgtgctataaaggaatacctgagggtgggtagtttataaagaaaagggatttatttggctcaggattctgatggctagaatgttaagattgggcatctgcatctgatgagggtgtcaagctgcttccactcatggtggaaggtacaggaatcacttgggaagaaaggaaacaaggggtcaggatgtgccaggttctttttaacagccagttttcctggaactaacagagtgaaaaatcactcaccaccactccagggagggcattaatctattcctaagggattcacccccatgacccaaacacctcctattgggccccacctccaacactgggggttgaatttcaacatgaactttggaggggacagacatccaaaccatagcacttgcatacttataaaatcagatatgctttataagtgctgatttcacgtaagctgttggcacaaaaatataacccattgtaataggcagaattccaagatggaccctagtacagttatagaaaacagttaaggaaaaatattttctatgttctttatgacaaacaatacaaatggcaatgtcagaagtgacatgaaaatggtatttgggtggtctcaccaatatttgttttatgtaatttttagaagatatagtagaaatttttacctttcatattaaaatgtatacaaaagtggtttctacctcagtggcagatcataaatttcttgtaactactatgcttcttatgacaaagaatgaaatgttttgaatttgatgttttaataactggggacaaattaggtgagatgtaaactctcttgccttttattgtcttgtcaaagcacaaaggagcattcacaggatggaaggatggcattgtgctttttatcagtaaaagctgaaaatgtgaactgtaattatggtgtttcattgttctaagtaggcaaataaaaaatttttggcaatgttgcatatattatgatgcaaaggaattaacattaggtaatatttgcagtattcgtattttgttatttaattgcttgcattttttgcactcacttgtttttgctttctttttcatcaactatgctactttgtattttttctctttttgatagtaatatttgcttttacaaaacaggtataaaattataagaggacgaaaaagcaaaagcacactcataaccctacccactcagaaacatatatcattctttcaaatgattccctatgggtgtgtctaaatatgtcttcatgtctaaatatttttataaaagtaaaagttcttcttcaagagtttggaacttgaatttttttcacttaacaatagtgctctaacatttctgacaataatgcgtatatttatatgttgtaaaaataatttaaaatataattattagaacaacttagtcgtgtcatcacttttcagaatcttgtttgcatgtctaaatgtgtctctacttacatagggttgtattctaatggggagggcagaaaatatatagattaatatataatatgctttgaagtaaaaataaaatggggagggactcaccataatggaagtggtgagtctaggtagggtggatatgaaaggtgtctctattgggtagcatttgagcaaagacccagatgatatccgggagttgggcatgagcaagtctgaggaaagaactttctgggcagaaggaacattcacttagaaggtcctggggcacaatcatgtggcacagatgccagtgtggacagagacacagaattagaggaggagtgggtgttagtaacatggtgttagttcatagtaaggagttgaaatgaaatgatgagtttacttttggaaagtatcactgggcatgtgtttatatgtgtgtgtaaatgtgtttttatatccacacatatattatctgtttatctgtgtctggaagaatttacagaggaggaaggatttcagttgggggggaggtcagccaaggtcagattctggggagctctgtgagggcacagtcttgggtctccagtgcgctgtcttcaggacaatttgttgaatgatatgtgaatgaatgctccattttagaaagcagctaaaatactgttgtgagttcacatcacagcgagggattcagggtattgaatcttgtgggggtgagtcaaacattcagaatctgaaggttatgaggtggacggagaacttggggagaatggaacagtcattcacaacacatgtactgtagacagctcaggcacacctcagacgtactgagattctcactctgcagcctgtgatttaactgtaattatgggtcttattttgggggcgtgagttggggaacaggaaataagtcagcctcaaggtagatacataaattataggagaggactgaccttatagagaaaaggagtgtcagaagtctcagactgtgaagcaacagagcctcataatcatgcctacctttcctctctcctcctgatttttctctagagttttgaaatcattcaactgccagatgtttgggctaaaatacatactgtttgagtgccttaaaattgcagcttttagttaccttttaatttgaagcccagaaatagtgccataaccacctgttttatattccgttaatagccattaaaaaaaatacaagtaccactcttctgctggcagacaccatttgtgaatggacagttttccagatggtggtttggaaatcattggtgtggaactctgtctttttccccatagcattggacctgccggatgggactccaggccagtgcacgaaagtcaatttaatccataatgtatctgcagtatagctttgagcaaagaaaattatagaacttgtcacgtgaggctgtgtttctaagaaaaatatcccaagggtaatgtagatcccatggcttgagcagaccctttgggagggtgtgaggatgaagtccttgctgtatttaagggcctaaaggagggctgagaggtggaatctgagggaatagagggcaggcccagagcgagcctcagtaattttgaaataagggacggtagacatttctgcctctttgttataatgccctcatactagttttggtctaagttggtttcttggccatagtctttctcatcttttaccagaaaagcctcaaggttggtctacctgttttttttcccactcattcttctgttgtagaacacagcaatgtgggattttagatctgacagagatctcatatcagctggtctgaacctttttaatttacatagttgtaaaatcagatccaaaaacgttcattttgactgaagtgcattttgtcctcaaggtgctgtctctgaaacagacaaaagttcattctgagttgttgcaaagcattttactacttatgacagtgggagagggagtggataggtaaagatctcatcttgttctgcattatttttcatttaatccaagggaaagtctcacctggaagactggggtattatttgatcacattttaagggaaggatagattctggttacttttaggacttcatcacgggagttgggtcaggtgggctctgtggtgaggaggaacatgccaggaaggaaaggcctaatgaagctgaggtagaaggggaggtgctggtgagtggaccaggcttctggaaccagcaagttttacagtagttggggaagataaactaatggggagatttgccctgattctttttccctgttctcaacagtattgctgattcttctactgtagaccacagctcatgtagtagaagtgaaaatctcaagtgggaggataatttcaggcggcatcagttttgagcggggttggaaacaaaggagagaaggtaaattggctctggaagtggagaaatgtccctgtggacagagggttggggtgtgctgtttagatgtaagggcattcccaaattagggaatactttatgttaagtgacctcatatttgggggtactctgaattgctgccagtgatggcattagcaccaaagatcgcttcctctctcgaaatggcaagaattcatagactctggcatccataaagaggtaagcaagcctctagaagacgcttatggaagctgtatcaagtctttaccatttccagatttccctgatgcagtcacagttatgtatgaaagaaaggcataggaggaggaggtgcccaacaggtgcattacaggaggggaggagagctttactctcccttactgtgcctcacccctctccactgagtgtaccctttgtttctgtgagtctgtcctgtggccatccaagaaggtgctttcttacctcatgagaaattgactctgaaagaggcccagaagcttcccttgtgctccagtctgtggtatggactgaaaaaaggggatttttttccttccaggtcccaccctgtactttcagtgctgtatgtgctcattagggcaacacctcttttctggatcgagaagctttgctgaacggcagtgttggaaaatgggtagtgttttctaaataattgttacctaatctttagccacacttaacatctttaaataataagtggagattctcctggtcagatttttttcttccctctacagctatcagttgttgatgtcagctaaagatagagaggctctcagaccattgtttatcaagaatggggtcagagggccacctgcattagaacaatctggggtaaagggtgatttgtagctcaaaatatagattcctgggccccgttccaattggattccttgacagtcgggcccagaaatctgtttgagaaacatagatgcctcaggtgattctgatgcatatagacatgagttctgaaagaatgagggcaaggaccttgtctggtttgtacattgtgcaacccccagcaccaagaacggtgcctgacacatgtgtgcactgctagtttgttgagtgggtgagtgagttcttgggcccagttttccactgcttatctgctattggttagggaatcttgttataatttaattttaagaaaataatatctcttaagtgacaggttaggagctctcctttatgtaaattatttgaaatttagaaggttaaagtgatccttttttttccattgcttatgaaaaatattttgtctggcacagagtcacacaaaggctaaatggctgtatgttggattcgttttcagccatggtccaaataaagttgcttgaaaaatgaggagcttttatgttacattgaccttcatatttgagctattttgaaagattgattcttaaagttctgttagctaagatgaggctatttagaaatgtaaggtggttttatttgtgcgtacatgtgattttgaattctgctcttcaccccctgccatgaataaaatgtgtgctttctaaaaatattcctaattgaaataccctgggtcccaaagggggttaaattgtgagcaaacaataggaacagattgtggtctctcatgaagcttgaggtgaacatggttctctttccttggtatttattttttaagagactgaaaatatcaccccaagccttttgagtcctttttattttatttattttattttatatttgtactaagcaaacatctgagtattcactgtttttgagtatatgtagctactgtgttctcattttttaatgttttgttttatttttaaatcaactgaaaatgaccttgttcttgttgagtaattttttcccaccagctccactccctacttaatggttttagagaagtatgttgtaggataggaatggctggcatattctttcaagagacttatatgctcctccttaagaaaaaaagactgatgttataattatattgttcccaatgtaacagtgttttctgatgaaggtaagcaggcgcaaatggaaatatggttatagatttttttttttcttttgagacagggtctcactctatcacccaggtggagtacagtggcgtcctgaatagctgggactacaaacacgtaccaccatgcccagcccccttttttttttttgtcaagacaaggttgccatgttgccctgtctggtctcgaactcttaatcttaagccatctgcctgccttggcctcccaaagtattgggattacaggccacaccgcacctggcctggttatagattattttttaaaatttgtctaacaaataactatttgagtgcgttcgtggtgccaggcggggtgccaggctctgggatcttctgaattaataagtttatattctcgttgggaagatgaaaaactagctgttaatgataaagagtggcaaatatgtgggaggtattgctgcatgcagtgagagcacaaaaaatacaagtaaaaccagaactaagctgtaaaggatttagagttgattagggtggggaaggatgttgcaagcagcagaataaagtgatttgtaggagtgtaaacttttgtgtattctagtaatgtcaagtggttctgggtaacagttgtatcaggagttagggcatgaataatgttatccatgctaagaatgtttcatgtagaaaagtgttgaaattttaataaaaggaatgatttttatcagtcaaccaaaattttaaaatatgttgtttgcattaaaactcaacacattttaaaattttggtttagcaataagaatcatgcaacttaaaggatgtaagtgagaattttaagaaatatcaagtaatatttcttttggtgattttaacttaaattcttccattgtttgctcagtacttaatgtgctgatttactgctgtgtttttctggaatttgtgtgtgtgtttgtagtttgtatttggaagtaattacagctatttgaaaagactgagttctgccataatctcatgaacttagctgtattttctggagagcttttatattagaaaagaaacttaccgttttcatttacagtcttaggcagtatgtttatagaaaaccctgtaaacacaccaaataaagcagaatttcagcaatcttgaagcatgaactaggagactaaaattagatgttgtatgtttaagtagtttttaggtagatcattcaaaatagattgtagttagagaattcacttgtcaaggtcagcattattcttaattataccccaaatctttataacatgatctttttacatgtatttgccagtttgtttttgttaatttgagcttaaatagaccaaaatcaattcacgtttactttaaaaaaaactgaattgtaaacagccttttggcaaaagataaagactagtaaaatagaaaaaaagagataagaatttattcacttttaaagaagcaattatgagaaattcttattttatacatttgtacgggttacaattctgtattgtacaatattttctattgttttattcctgattttgttcctgaattgtcccacagaattttttatgtgtttaacacacagctcatatatgtgtgtatatatgtatatatgtatatatgtatatgtatatatgtgtgtatatacatatatgtatatatgtgtatacacatatatgtacatataggtgcgtacacctatatgtatatatatgtgtatatacgcatatatatatgtatatatgcatatatatatgtatattctttttctgttgacatttagaagctttaaggatctgtttagcggtatccgtttggtccatgtgtttctgcatggagtcttggacttaatgacattttaatccattgtattttccaggtgttcatgatttattttttgtttccattttttgaccatgaccatttgtttcttggatactgtgcgtaataacatagacttttatggatagaaaatctaaatggcataaatcgtgtcctctctttccatctgatccgctttgggacagcctttatttgatcagagctattgatacttcctcctctccgggccttccaccaccagtgaccactattcgacatctggcccactctcagtcatcctcctgcttacgcttgtcccctccttgaagacttcccactgcatgtaggacaaaggtcaaatttcataacgggtcagccctggtcttcatagtctggtattcactaatttttggtctcagtctcatcccttggaggattacctctgtccttcgcaagctctgtgctccagacttatattaaaagcaaacaaataaaatttggttttcagaaaatgcccgattctctattaccacctgcttttgcacctcctctgagggtactttactgagtaggcagaattggttgctccttatttcttttatgcttcgtagcattttgttcatttagcagttataactcttatgaaactgtattgttaaggtttatgtattagtctctctaactagactgagttttgcaaagaacctgacgtgctcatttttatatccttaaggctaagcagaatccttggcatatggtagagagtcagtcatctttagagtgaagctacttaatttgtctagtattatgaaagtatgaaaacaggataatgtttgaacagagatataaatatttagttctggaagctgggcgtagtgactcctgcctgtaatcccagcactttgaaaggccaagtttagaggatcacttaaggccaggagttcaagaccagcctgggcaacatagttgagacccccatctctacaaaaaatgaaataactgggcatggtagcatgcacctgtagtcctggatacttaggagggtgagccaggaggattgcttgagcccaagaggctgcaatgagctatgattgcaccactgcactccagcctgggcaacagaacaagaccatctctaaaaaagaaaaaaaaaatcttaaatgtgtcttgggaaagtagtttataatgacatcccaaaaggcatctgaggaggtattccagactaaagacagttagaagtaactatttgggaaatcagattttaaggtgccatctggaatacgtttggggctagataaacctacatctatttttgagtattcccagaattcactagatggacctatatgtttatagtgatttgctgaatagaaatgcattctgttccaaataacacccagcatgggcattaaaaaaagatctggctatggggaaccttcacataaataatatcttagagtgctagcacttgccagtgttatgaaagtaatacacaggtgctcttttgttcagatatatcattactgtgatgttgattatctgtgtaagaaaatatgaggcacaatgagttcacacaaatatctgaagactagatgaacatttttgaatgcattttttgaatttagagattcaaatcaatatatccttggtataacatggtgtatcaatctttgagcattgcagataaaggacctttcagtttgagtttaaatacagaaaacttttagtttcgtaattttcttttaatttcaaaagaaactgtggtttttatttttcagtgttgaaaatgagcccatgagcacaagtcagaaaaaggaaaatgtactttcatcagaagcagtaaaggtatagttttaaattaatattattttatatcaagcaaatatcttaaattgctgttaattcttttagattctgtcatcttattttacatttcaaaaagaacactgtataattactttttgtggaaatccagcccaactttgtcagacacttgcatcaggaggtgggacgggagtctggacaggtggggaaaggctctgagaagggagtatacagagtggtgttcttggctttgccactaacccaactgtgtgatcttcagctgaggatttaacttcttcgtgtctttgctaatctgtaagtcagatcacatgacctccatggtctctttttcctaggaagttctgggatttatgagttttctgaaatgttgcaaagcaatagtgcttttggagggctgaagttaataatctgtttctacatatcattgctctgtgttaggtgtgtttggttagtttgcatgtcgttcttggcttctctaagaggacaagcacaaaaagtagataagctacacacctacataggggattctccatgagtagttgaaaatccttgaaaatcactaaaccttttgatctctctttttattcataagcggttttctagaaatttgatgtttccagtttctaggtatgtgatcacgttttggtagctatcccacaatcatggcttttggtcccagttgctttcttttcacatgatttgtgacagtcaaggagaaaatttgaaccttctggggatttcagaataaattagcttggtcagtagaaagactgaaaagttatttcaattcttcattactgatatgggcactttttaatatttttaaaaactatataatgcccaagtacattacacattataaagacaaagttgttttaattctttatttctgccttctccattataataaaaaaatacttattgaaaggaaaaaatgaagatcaccttgctttcctttcttcactcctttgtgagtctggctactaaatcctccttctggtggttttttcatgtatctcacttaacttctcttctgcaatcagttgttacccagcctgctggtttaccattgtatgggctctatagctgctgctgatttttcagtttttacatgccttgagttgccctactcaagacttttacttctaatgctataaaacttgcccttgtgttgtttcataggaaggctgttacttctgagatctcaaacttccaagtttctttggttatcagcttttgtcattccatctcttaatcccttgttgactctgtactcaccctttaccaaaccttcctgctttccttgctcccttttcttctcttagtctctgcttctttccccatttagcctatacctgctggcttattttagctatactttcacctaaataaatcttcagtctccaaacttggataaattcagcctcttatttccagtagtgctgttttccacctgcagaggctctgaaagttacatctttgtggattcagtaaatatatttggcaaatagaatagctgggcctctatgctaacaatcttttccatccattcttaacatctaattttgagtgccgaggataatttcattttggcatctaagcccctaagtaaataccatgcagtcatgaaactgtttttcttgtgatttgaagcctatgagtttacttatatacagaaactgcagttatcccgtaatagaaaggataccgtggcactttttctggggtatcctgtgcattttggctcatgtaactttttaaaaaaccttctggaacctactggtaggatttcttcaacctagccgcacagacccagttgttcagggactgttgctaccaggcatcataacaaatatgtattttggtaatgtaacataaattttataatgctttctgtgataagagaaaaaatatgcagcatttcccagttgatcagaaccataacagatttatgtaaacataaccttatatagtcttctttttgtgtttgaccttgagatacccaatgatgatgtcaaagattgttggttgcaagacaagtttgaactacaaaaattaactgtatttttaaacaattagagattatattttatattaactttggacatcattaaattttttattcttaaaataccacttacatgctacacaaattttgctattttactaacatcggcggctacttctaacatttacatctatttttctactggaatatgtattttatgttaataaggtttttatatctagctggagatgcttccggaaatttagtccacatttgatcattgtcttgtagccttaaactcttgcttcattcacatctactttgtgttatgccctgctctcttctacctatgtcagatgaatacttatccctttctgccttgaaaggctaaattccctcaagcccccatcttgactacaacatgtgcagtggtattggtgtccttactttactgcctttccttggcccttgccttgactactactatccctccatcttcactggcttctgatttgcatcaggtctctgtgtttctctttaaatatataaaattaaaaacaatgtttttgttttatttttgtgaatctggtttcctttccttttggtctgttattctacattactcctaccttttacctcaaaattccttatgaaagtctgtcttaagcattgttcagttcttaatgctttctgctcggactcctgtttctcttttagttccctctgacatgggaagcctggtactgtgtctggcgcacgtgtcatggatgctcagtatgtagtcgctgattgaatgaaagctattccatgaaaccagttacattcatgttcaccagtgaccttttgctgaccatattcagtaacctttccctagttctcattctatttaaccagttgaaacacttttttttcaagtctttctctcctttttagaaatgttctttggtttatctttgcttctgtgatattgtcctttcttggtcccatccctacctctggctacttccttcagtttccatcactgatttcttttggctaaatactttttcatgaagatgtttctcaaaatcttcagttctcctcagtgtcagtcctctgaagtaatatcttccgatcctttggttcatcttttggctcctgtgtctttacgtgacatccatctagagctccagacttgattatcaatgttccagacatttccctgtggatgttcctttgatctcaaattcagtttctccaaaagccttaatatcttcggagatgttttttcagtttttttgtttttattttttcttgggagtgttagtggtggaaagtagggaggattgtcttactgtttgggtgaaggaagagcccttgggctcaacttctctatttgaagattttcaagcaaactcttagttttaatcccatgtctgacactgccttaagtggttcctagtgtcttcaaatcctaagtcatttcagattgcctatgggatgattgttaggttcagagtccctttttgcagtcacttaggtagaagctttctctgcctctgtctgcttttgccttctaaaccttttctgaaatctcttgcctgctatattcagctgtttttgcattgctataaaaaaatacctgagactgggtaatttataaagaaaaggcgtttcattggcttacagttctgcaggctttacataaagcatggcaccaacatctgctcggctttggtggaaatcatagcagaaggcaaagaaggagcagacatgtcacatagcaagagcaggagcaagagagaggggaaagctgccacacacttctaaacaaccagatctcacgagaactcactcactattgcaaggacaccacaaagccatccatgagggttctgcccccatgacccagacacctcccaccaggccccacctccaacatcagggattatatttcagtgtgagggtacaaacatccaaactgtatcaccagttatatctgttctcttcctgtctttgtacttataactaaaaacaacaacaacaaaaatactcttttgctgtcattttagagtattttgttcaaaaggaaaaaatcaatgtgtatgttctatccacagtgttaaacagaatttgtatccctttgtgtgtagttgaaaaaagcaaatctcaaattaagtcacttgacacaactcccactgataatgaacagaggcaagagaattcagaggcagttatgtaccatgattcttcctattcgtgtactgaatttttaagctatattcataaacttcatttatcaaaaagaaatcctattaaaacataaaaataacagtggcagtaagtctttttccagaaatgaaccatgagctaaataagattattatatctggaccgcaggttatagattctccaacccaggcctcaatacatcaatgattattatgcatattctccatagcttggcatctgccttatatgaaatctaccactggtcccattttagaaatgctgctcatgactaatcatgcaactttgttgaaggatttagcatcttttaagaggaagtatttggtgtatgcctgtgatattcttgtaaataaaatgaaattaataagtattaacttactgcatatcaatatcagatatttatgacacattacccttatttctaataagtaaatcacttattacaaagaaccgcattttttgttgccactgtttaataattgacatgtagaaatggaagaattgtagcccaagactatttcactgaggaagaatgatcactaattgttctttacattaatgcccgtattcagaatacagaattatgtagtaagatgaatattttaaatatttgcatctgttcatattttgattttatgtagctcctctttccttattaggttttcaactctttctcagtgagagtaaaatggtagtcaaatttaaatgtgttaaatgttgtcttggttagagggaaattaattactgaaccaatttttaaaatatgtatggctttagtgtatgcttgctatctttgtttgtttgttgttgtttttttgagatggagtctcgctctgtcacccaggctggagtgagtgcagtggcgcgatctcggctcactgaaaccttcacctcctgggttcaagcgattctcctgcctcaccctcccgagtagctgggactacaggcacgtgccaccactctcggctaattttttgtatttttagtagagacaaggtttcaccgtgttagccaggatggtctcgatcttctgtcctcgtgatccgcctgcctcagcctcccaaagtgctgggattgcaggcatgagccactgcacccagcctgtttgttttctaacagacaggtcttgctatgtctgtctggcctcaaactcctgggctcaagcaattcgctcacctcagtctcctgagtagctgggactacagacaggcatacaccattgctcctggtgtctgctgtctttttttctcagcaatgcaaatagttgcagcagtatcatgtcagtttaacgtacagatttttatacgtctctttttcaaacataacagtgctcccaccccaacaataattgtacctgcaaccctgtgtataaatagattacagcacagttttccctgttgatggtgggaatgatttgcctggagcttcacagtcagccactgttctctgcccctgccattcctggcacctccttggaacagttttgaaattacatgtgtaatgatggaaagaacacagtctttgtaaccagatatgcctggacttaaatcctagatcttccaggtggtggcttggtaactttgggaaatttatttaacctctctgaatcctggtttattgatctgtagtagggcgggtccttatttcatagaggtgttttagaattaactaagataacatgttaagtactgtacaatgcctgatacagagtaggcacttggtaaaatgattgccttcttgccatataaagtctggctaaaacttagaaatactgtgaatctttgcttgaaaatggtggtgatttattctgggtgaatagtatagaaggcacatatttgaaatattgattctgcataacgtttgagaagaaggtacatacaagaaggcataccatattcaactttagctggaagtcaaaatcttgcctcttgattgcttctaaaaaaaaaaagtgagtgctactggagtgcccgaaatggaaaatgcgctgtgtgttactgtgctgtccagttgaccaaatggactgtcagggcttaagcctgtcattgtggctgatggtagtctgggcacttgacatcttgtagttattgaattgattgtgttgtaaggtatctggtttgatttgcagccacttcaactatggtatacctggaatgttcctacattgcggtatgatggaatatcttatcaaaatggaaactgaatatgaaggaacatgtatgtactctagatttttgtgagaaaatttgcctttacaggtgtcagatactgattctggaacacgagagtgagcgccagaaagctctcagagaatcaaaagcatttgttattctggcccagtgcttttgctgaaatacttatatcataacaggagggaatggctttcctgccattccttttcttgttcctttctcttctctctttgtatacctgccctggttgatttgatttctgcctgcatcttggctagtgactagctcatatatgttcctttagcccagcatatatcgtgagcttcagggtgataaagcctgctatttcacggacctctcctctcagatgtctctgagtataaagtttgacatactcaaagttgaactcattttattttagcttcctgctatttctggaagtaccaccacactacccaatcttgacacctgggaatgaatctagtgttttatctcccttcccattgaactaaggcccatcaacggcccttccttcatacgcatacccattgatactatataactcatacttttcttatttagatcagcaatttcacgcatattttttctctgatacatatgagaggtaactgttttgggtcacctgtggttaagggcacttactttaaatagtacatataactacatatctttatcaaaaattatatggatttgaaaacagtgaaagtaacacgccagatataactttaattctatactagaacatttttagaaggtaaaattttagcttttaaaataatcttggtaataagttattaattacatcctagaactgatcataacactgatgtgtgatgatataaaagttgcaaatagcttattgttttaaactataaccagctgcattaaggtaaggtagttgcctacctaccttgcctgttgtcattttctaatgaaaagaataactctgtgataacgatctaatgttatctttgaagcaaaattactttaacaataggagtataaacagttcatctttacaaatttagttgtaaaatccatttattgaaaaataatgacatgaatatatatcagtactcactgaggagttaatcagacaacccaccacgatgaaatcctttataaaggtactgattttgatttaagattttagcatcagcctgtaatcccagcactttgggaggctgaggcgggtcaatcacttgagatcaggaaatggagaccagcctggccaacatggtgaaaccctgtctctattaaaaataaaaaaattagttgggcatgatgggcgtgcgcctgtaatcccatttacttgggaggctgaggcagaagaatggcttgaatctgggaggtggaggttttggtgagccgagattgcaccactgcactccagcctgggtgacagagcgagactgtctccaaaaaaaaaaaaaaaaaaattttagcatcatttaagctgtaattcaagatagcagcaataataaactaataaagcatttttctcaaaattgtgaatttcaagtattggtggtggaatttcaacttttggcaaaatttccaagtaatacgcggcagccagatgtcttagtagaacattaactagaattatttaataaggagtgggttttagtttatgaatgccaaattttagttaccgttaataacttcagtaataatcctagtcatgatgaaagtatgtaagattattgtttacctacaccctgtggtgtcaaggcagacatatgatattagggatatacactggaagaacgtaaatgtaatttccgtcctgaaaaactggaattgtagaaggaattttccaggcaaagagagcaagggataagtcccagcagtggaaatagcattctgcaaagatacacagtagtgtgagagaaagaaaggtagggagggagagaggaaggaggagatagtgaatagtaatgcatgtgaagacagtaggcattgcaagcattgtgagtggtaagagatgaaattggagaaagccatgggggctatatccaccaagaccttgaaggcaatgccagggggcttggattttatcctgatggcaatgctcagccattggagggatttaagaatgatcatacttggcttctagaagattgctgtggtttttgtctggagaacatagtgggggataacagatgtggaagcagcaaatccggttaggccaccgataacactattctagggggcgcagttatggtgatggtgtcctgatgttttctctgactttaacaagtgggaattttaaactttatagaagaaggaagaaaggagacatagcatggccaagttcagtttggaatgttttgagtttgaggtccagtgaagcatccaggtatggagatagatgtctggttggtagtttaggagtctgagctaatctgaggatcatcatctgaatatttgagtctgtgggcaagagatttcataagagcatgaaggaaaagctgatataggctggaaattggagaagcatgttatatgagggatggctacaagaagtgaatgtgaaagagatggagaagagtattcagagagtaagaagggaaacctcagagtgatgccatggaatctaaaggaagaatggttttcaggaagagattcagtctcacattctgcagacacatcatataagatcaggacagaagaacagtccattggagtgattagtcgttagaatggtgtccctgaaaggtcatggttaggattattggggaggtagcccaattgtctggacttaggaagtgattgggagtaaaggaaaagaaacagggagggttggtaactcctttgtaacgaggttagtaatgaggacagaggagaaggctgtctctggatatacttttgacacttagattaattccatacttagctgttgtaaatagtgctgcaataaacatgggtgtgcagatatctctttgacatactgatttccttttctttagatgtatatttagaagtgggattgctggatcccatagtagtttatttttggtttttggagcaacctccatactgttttccataatgattgtaccagtttatattcgcaccaacagtgtataacagttcccttttctctacatactcaccagcatttgttactttttgtctttgtgatagtagccattctaactggggtgtgatatcgcattgtggttttgaagtgcatttcctggataattagcaatgttgagcatttttcatgtacttgttgactatttgtgtgtcatctttgataaatgtctgttcagattaattgcccatttttatttcttctaattattttaatagtttagtagcacaggtggtgtttggttatatggataagtactttagtggtgatttctgagattttggtatacccatcacccaagcagtgtacactgtacccaatgtgtagtcttttatccctcattcccctcccaccctccccccaaagtccccagagtccatttttatcattcttatgcctttgcatccttttagcttagctttcacataagtgagaacatatgatgtttggttttccattcctgagttacttctcttagaataatggtctccaactccatccaaattgctgcaaatgccattatttcattcctttttatggctgagtagtattccacagtatatgtacacacagacacacacacacatacaatacacacacacacacacacacacacacacacacgttttctttatccactcggttgatgggcatttaggctggttccatatttttgcaattgcgaattgtgctgctataaacatgtgagtgcaggtgactttttcatataatgacttcttttcctctgggtagatacccagttgtgggattgctggataaaatggtagatctacttttagttgtttaagaaatctccgtactattttccataatgattgtactagtttacagtcccaccagcagtgtaaaagtgttctcctttcactgaatccgtgtcaacatctataattttttgattttttaattatggtcattttttgccatacttaaatattgtggtatcacaatcgtggtatcacaattgtggttttgatttgcatttccctgataattagtgatgttgagcattttttcacgtttttgttagatttgcttttgggttcttagtgatgaactctctgcctaagtcaatgtctggaagagtcttatggattttatctactagaattattatggtctcagatcttagatttaagtatttgatccatcttgagttgatttttgtataaggtgagagatgaggatccagtttcattctttgacatgtggcttgccagttatcccagcacaatttgttgaataggctgtcctttcccccactttatttttgtatgctttgttgaagatcagttggctgtatttggctttatttctgggttctctattctgttcctttggtcaacatgcctatcttataccagtaccatgctgttttgttaactatagccttgtagtatagtttgaagtcaagtaaagtgatgcctccagatttgtttttttgttgttgtttgtttgttttttgcttagtcttgctttggctatgctttggctatgtgggctcttttttgttccatatgaattttaggattgttttttctagttctatgaagaatgatggtggtattttgataggaattgcattgaatctgtagattacttttggcagtatggtcgttttcacaatattaattctacccatccatgagcatgggatgtgtttccatttgtttgtgtcattgatgatttctttcagcagtgttttgtagttttctttgtagagatctttcacctcctttgttaggtatactcctaagtatttttttttttttttgcagctgttgtaaaatggattgagttcttgatttgtttctcagcttggtcgttgttggggtatagcagtgctcctgatttgtatacattgatttttttttatcctggaattttactgaattcatgtatcagatgtagaagctttttggatgagtcttcagggttctctagaaacacgatcatatcatcagccaacagtgacagtttgacttcctctatacgaatttggaccctaaatttctttctcttgtttgattgctctggctaggacttccagtactatattggataagagtagtaagagtggcatccttatcttgttccagatcttagcagaaaagttttaacttttctacttttactatgatgttacctgtggatttgtcatatatggcctttatttcattgaggtacattccttatatacctatttgttgagagtttttatcaagaagggatattaaattttattaaacgtttttctgtttcagatgatcaaaaggtttttatccttcattctgttgatgtgatgtttattgtgttgtatatgttgaattgtctttgcatcattgggataaattcaacttaattatggtatataatcttttttatgtgctgttggatttattttgctagtattttattggagatttttgcatcttgttattctagggtaatggcctgtagttttcttttgtgtgtgtttgtgtgtccatgtctgcttttgttatcagggtaatgatggccttgcatgatgaatttttgaataattctgtctcctttgattttttgaaatagtttgagaataattggtgttctttaacagtttagtagaattcagcagtgaggctgtgtagtcttgggcttttctttgttgggagactttttattacttattcaaccttggtactagttattggtctgttcaggttttctgtttcttcttgcttcaattttggtagcttgtatatgtccaggtatcggggaacctgccccgatagtcacgtagattcttttctattttccttaagcgtcagctggcttgagaaataaagggacagagtacaaaagagagaaattttaaagctgggcgtccggggaagacatcacatgtcggtaggttctgtgatgccccacaggctgcaaaaaccagcaagtttttgttagggttttcaaaaggggagggagtgtgcaaataggtgtgggtcacagacattaagtacttcacaaggtaatagagtatcacaaggcaagtggaggcagagcgagatcacaggaccacaagactggggcgaaattaaaattgcaaatgaagtttcggacaccactgtcattgacaacatcttatcaggagacagggttttgagagcaaccggtctgaccaaaaatttattaggcgggaatttcctcttcctaataagcctgggagcgctatgggagactggggtctatttcacccctacagcctcgaccataagatacgggcacacctaagggggccatttataggcctatacccccaggcacgtattctctttaccagggatgttccttgctgagaaaaagaattcagcgatatttctcccatttgcttttgaaagaagagaaatatggctctgttccgcccagctcaccagcggtcagagtttaagtttatctctcttattgcctgaacaattgctgttatcctgttcttttttcaaggtgcccagatttcatattgtttaaacacacatgctctacaatttgtgcagttaatgcaattatcacatgatgaggatggcgacatacatcctcatcagctgacagcattaagagattaaagtaaagagaggcataggaaatcacaatggtattgattggggaagtgataagtgtctatgaaatctttacaatttatgtttagagattgcagtaaagacaggcataagaaattataaaagtattaatttggagaactaataaatgtccatgaaatcttcacaatccacgttcttctgccatggcttcagccggtccctccgtttggggtccctgacttcccacaacatccaggaatgtattcatttcctctaggttttttttgtttgttggtgtatcattattcacaaaaatttctggtaagcctttgtattatggtggtatcggtcatcatgtctcctttttcaattctgattttacttgggtcttttcttttttcttagtctgactaatggtttattaattttgtttttataaaaaaccgactttatgtttcattgctcttttgtattatactttagtctgaatgtcatttatttctgctctgattattgttttcttctaatttgggggttggcttattcttgctttgctagtttcttgaggtgtactgttaggttgtttatttgaaataatttttttattttgatgtttgttgctatcagtttccctcttctgcttttgctgtatcctataggtttgtgtatgttgtgtttctactttcatttgacgaaacaaatgttttaattttcttcttttttcatcggtcattcaggagcatgttgtttaatttccatgtgtttgtacagtttccaaaatttcttttgttattgatttctagtgttattccattgtggtcaaaaaaatacttcgtatgattttgatttcttaaaaaatatgttgagacttaatttgtggcctgaaatatgatgtgttctgaagaatattccatttgctgatgagaaaaatgtgtattctgtagctattagatgaaatgttgtataaatgtttgttaggtctatagtgaaatttaatccgcgatttccttaagtttttttttttttttttggtctagatatgtccaaagttgagagtgggattttgaagttcccagctattattatattgggatctaatactatttgctttatgtatctgagtgttcccgtcttgagtgcatgtagatttacagttgttacatcgtcttgttgaatgggtccctttatccttatataatggccttctttgtctctttttgcagtttttgacttgtagtcggtttttggcttccatttgtatggaatgtctttttccatccatttactttcattctgtatgtgtctctatatgtgaagtgagtttcttttaggtagcatatagttgagttctgtttttttatccattcggctaatctatatcttttcattggggaatttaaccatttacatttacggttattattgataaataaggacttactcttgtcattttttaaattattttctgatcatttcgtatatacattgttcctttcttatggtttatctttggtggttttctatcatgatgaggtttgattactttatctcatttatgtatcttctctatgagtgagctttatacttttgtagttttatgatagtagataatgttttgcttccaaatgtggggcacccttaagcatttctttaaagtctatctagtggtgatgaattttctcagtttttgtttgtctggaagggactttatttttccttcatttctgagggatagctttgctgggtatgtttttagttgagtttttttttttttttctttcggcaacttgaatatatcagtctattcttttcttgccaataaggtttctgctaagatatatgctgttattctaatggagattcctttgtatgagacttgacatttttctctatttttagaaatatttgcttttagaaaatttgttgacttttgatagtatgactataatgtgcctcagaaaggaccttttgaggttgaatctatttggggacttttgagcttcctggatctagatgtctatattcttccaagacttagaaagtttttagctattatttcattaaataggttttctgtgccttttcccatctcttttcctcctaggctttccttattcctttttattttctgattggatcattttaaaaagcctttcttcaagttcagaagttttttctgcttcatctaatctattattgatactttccattgtatagtttattcactgaattttttcagcttcaacatttctgtttggttcttttttatgacacctatcttgttgactttatcattcatatcataaatagtttttcttattttattgaattgtctatctgtattttttcgtatcttgctgaatttacttaagatcattattgtgaattcctttttaagcatttcatagattttcttttcttggttgtctgttactggagaattactgtatttctttgtgttacatttcttgctttttcatgtttcttgtattcctacattgttacttatgcatctggtggaataagtaccttcttcaattttatggagtagcttttgtagggaaagattttttcttacagatgtgatacatggtgtctggctttggatttggttctaggtaggcaaagtagtgtagtcacaatatgtttttttgggctgtcatcaacatctgtgagtgcttcagtggcctagactatgtgggtctgtggaagcagtgatatggctttggttttgctgggggcagtatcgtcagtgacagtagtcacctaacagtcctgttcccagtttctgagtggtgtgtgtatgccattcagctccactgatgaaaggggcacagtcactggtagtgtcaggctcctggcagcctgtttttgggtcctgtggtgagggtgcacatttgatgcttagcagttccactgctcaagggggcagggcaacattgtctacatgttgatcttgtttactataccaggtgccacagcacccatcacatgctacgggctgcttaaggaggtgacaaaatactgctaattagacctgcaaaaaagttcagacatcactagaatgtaggtaccatgaaagccaggattttggtacatttttcactattgcatctaaatgcccataatagtatcttgttgattatttattgaatgaatcaatactttaaagtttacattgaacctaactgcttttttgtttacctagttttagcctgttcatttggagctgcattccccagaaacattgtttcaaattctctaaattttgagaacccaaatcctagtttcacctttttgtctctccttcagcttttctctcctttcactttactgaggtcagagccatttgttgggccatattgtcttttcacttacagaatttataaggctttagccactctccttgccactttacttggcagagaagatgtccttctctccaatgctaatactttgtctttattataagtattagaaattatattgttctcttcatatcatcacctccttcctttccttctggaacctgtcatctatctctttataccatagtcactccctttccaacaagtatagagctgattcacaaaacagtaagttctgtcctggaacttaaaatggattttgtctttccttccttctagttaaaaatctctgaaaaggtttcccatctacttatgactattcctatttccttgttagctactcactgtttagcacctcaagttttggactgaacacatgaattcttgaactgttatgactgtttctcctgcattcttaaggcttttccatttcttcatttattactctaacaaacatttgagcacctcttattatcaggcatgtttcaaggtggtagagatactgcagtgaataaaatagataaaaatcgttggccttgtggatgctacatcctaaaggaggaaacacatattaaatgttgtaggtgtgtgttgtgtgtgtatttactataatagtaagtacaagaagaaaaataaaacagaaagcggttaggcagttttacagtggaggggtctgctattttagatcatgctgagagaattttcattggtgagatggttttcaagtaaaggtctgaaggaggcgagagagagtgagtcatataggtatctgggggatgaatattgtaagtagagagaagagtaaaggcaaaattcccaaggtgggtgtgtgcctgatgtttctgaagactagtgaggaagatagtcctcatctttcttgagctcacagtggcatttggcattcttgactcctgtctgccttttgaagtgttctttgtttctttggagatctctggtattctatagagactaacctggtctggttttgacctcctctatctctttcactggtttcttcttttcattgtttttgacttgtaatcttttttttccatagggatcttttgttgtttcctctttttttcctgcgcacatcgtatattgccaaactacattcttaaattgtgcctctgtttatcagacatctcaacttttgtatcacaagggaccaaaaatttcacatttgacaactaaatagttcattgccctacctgccacttacccagagccctaattttcacctccctttctattctccatgtccattttttttggcttacctaatcaaattgttgtctaatttagagaactcagttatctgtgaccatattattcctcacccaccacttctaactggtcatcttatcaaactctttatcttctgtgctccagtcttcatcagccatatccctgccatagtaaacatatttcaaacttctgtgtctttgtgcatactatggcttgtgtctagaatactcttaacactcttcgaattaagctcaaatgttatcttctatgcaaagaaggtttctctacatccccactcgttaattatgtcttccattgtgtacatatctcttgtaagccccctacagtgatattaatataatgatgagtatgttcctagcttgtaagctccttgaagacctcagctaaatcttattaatcagtatacataatgctttcctgtattttgttgcgttgggccccaacatagcaaagagagtagatagagaaatgcatttggactaagagtactgcattacaacatattgaacatgagggaaaaacattgaaaattccaaagatacatatgccttcatcagtaacattcatatagtatacacataataccaaaatcttggagagcaactagaatgaacattttgttaatgtttgcctgagtcctgagtgctttcattctactcattcattgctacaatggtagacagtcctgttggcagacagatatagggcccgcataatgagggcctgtaggtaggctgaacttgtccaggttgagggtgaagaacaactgctttagatcaatcttaaaattttaattctataaatacataatttattgcaggtgtttactttgaatagcagtgtatttttcctgctacttttttgtttctaaattcagaaactttttgttgttgaaggtgttttaattacgaatacgcatttctcgtaagattatgagggaaaaattaagcaactaaaacatttaagggaactaaaaaatactctttagtaaacttatagggattccggaatagcaaagaagcagacagttaaggggaaggagaaacaagttttttttttaaaaaattatttactactttaaaaaggttaaatgtaaagtctttcattagtttcacaaaatgtatcttcctcatttggaaagcaacctgttatgctttgaaaagaatgagcaagtaaaaataatagggagataaatacatttttgacaaaaattactgttttgagattttaatgatgttaaaagtggtaatcttgttcattttcttcttttaaatcattgcccagattatataagactcttttgcaaatttttaaagcattttaaggatatttatgatattttaatgagcagcctgtagttcgctttcttcaagtggcgacataggatgagcagccacttcatactacttatagaaaagaattaattactgttcttttcatgttccagtgttctttttgacctggggagaaatattgtggctaaaagttacaataaaccaaattgttaacaaaaaatgtatatctttcatataaatgaccattttcaaaatgtcaattagcatatcttctactgccaaactgagaggttgtttatgctgtttatatgaggagagggcacaggtgacttatagtgccagctctcagaatgagcagaaggttggacgggtgaggtggagacaactggaatcaaattgtagttgaaactagtgaaaggtgagatgtgcagtgtctctagaatctggctggtgacattctaaatgtagaggctcacaagatgtattaaatcctaacacatcaaacaatgccatgtgcttactcagaaatcccctttgacacctgtgggaacaaatttaaaagtattgtttgcttgcaatcagtttgctgagttaataagttctaaacattttctcaacctttcatatgctaaatcttttttaaaggttagtgaaatactcctttatactaatttgaacttagatcaaaacatggaatgaggtgaaaaaatgacattataattatgatgttcttgccttctggaagatcagattcttataaaacattgtcatgtgaacctaaagtgccctaaggtggttttgccttggtgtcctgattgttttctgactcacacttgagctttccttttataagggctagtgagcataataggtgacagagactgtaggatgggcattctttttacaattacgtaagtgagcatgtttggaaggcagggtgagttggctcatgggcctaaagctttttagaatctggaaatagcatgaagtggaatgccaacatactctgatatagcagctcagtttttcctcatacagagtatgcattaatgtgagtttgctttaccagtaacttaactatgagcaggcaaaatggacttctgcaactgtttgtcttcaagtatgcccaatgctatccatggtttgaattaacattatgtatcaggacttcctgttttaccaggaaggggtcacaagtgggctctttctctgaactgaagtaccatgttactgtcttttcctcatcttcttgaataatgtttcatattgtgccagctttatgggttaacacaatgctgaaatgatgaggtctgttgaggtgttatctcaagtaccaagaacttgaaatactctcccttatctctgtaataataaaggctaaatttaaatactcataaggtttactgtggtctctttacgtctctctccatatttacctctcactcttgtcattttcgtaccctaacctccagtcatattaaactcccttaggagctgacacctcactaaaaacacacacacatgcatgagcatcacatagtcactttttctgtcctctttaaagagtgtacttcctctaggaagcatcccccaagttaccttctgtgctctcacttctaccaagtctggactagttgctcgtgctctgggctcccatgtgtgcagtacttctcccctcatgacatttaccgtatagctttttaaaggtcatgcttactgtgctcttcagtagattgtgaactgcccaaaggaacagaagccattagtcttattcacaaatgtatccctggtgtctacacagaatctgttttataatagcttatcagtctgtttcattatttaaataatgatgcttatgattgtctattttgttttcaaagattcgccaaagtgaggacaaaaggaaccatgctgagaagccagtcactcttccagtgcaggaagatcccaaaaaggcatatgatctttccagttccacttcagataccaaaataggagaaagtgacagacagccaaaagaaagcttttttcagtttcttggtaacttattcaatatctcggggaaatcatctctaggtgaagctaagcagtcttctttcaaagatgaccaggataaaactgagaaggatttacaaaatcccagtgaccatcatgaagacgggatcaaaagggagagagagattttcagtggctccctaagaacccagacacatccaacagaagaacaagactctaactcatccgaactctcagatgctttttctttggatacaacacaagacagtgaccaagaaaccactaatttgctaaagtaagtttaaaatttcattgaaccaaaaaaaattgagctttttggacctagcttttgagctttagctttaatcctagtaattggtgggattggaaaagatattctgtagtgtccctactactgggtaagaaattgtatgattctctgtaccatacaagtaatcaatcatggtacagagaaccatacaggtaatctagggcctgcaaaatttgtcttagtaaaagattctttttttccctgcatggtaatgttttctgttgcttagattcttcctgtgtcaggacaggcaatgtattcaatatgtgcattttcggggaaaatggtcctcaggtttatattcttattctgtcaatatctttgttctgtaaaatttaattaaagccattaagaaaagcaattaaatggactctgttcatgaaactagctttatgaatctttacacagctccaagaaactaaaatattgcttgaattgaaggagcattttaccaccactttcttcattgtttgattaacaaacacacatccacttgtttttccttttactctcaaatgaggtagaaggaatattttgtaattaaggaatgtttataacattgttgagtccattcaatattttgtgtgacataaaagtattcatttgtaactagtaaggttctgttttattgattttacttttacctctgctggagaatttattatttgaagaagccatcaaaaatattatagtgagatataagcactaccttataattatacagttctttatagtttccaggaagttctttatagtttccaggtgtcttcatgtaggtgctttcagttaattcctcgtagtaaacgtgtgatttaggcacagacctctcttacagctctgtgaaaattagattagagtttgtccatcaagaataatgttgtggggcttgttcaacctgatgttaaaacatattgatccagctgtggtatttgaaacagtgtcatactgatgtaatatttgctagacatttaaatcgagcagagtaggcagcctagaaatatactctcttatatgtaatttgaaccctagaatatgatggcattatgtgttcctcatctttgtactaaagtaaattaagatagagtaacaaatgttaaaaacaataaaaaagttaaattgtacatttttattttggtgagaaatgactttctaaccataatagcaatggaaggtatcaataaagagatcagtagattaaaatttattcccaattttcaaattcttttatgtcaaataacataagcaataataaatttaaatggaaaatgagaaaattatacacaaaaatgacagagaatgctttgataagcaatttagacaacaactcaccaatagaaaagtcaaacaatataaacaaatctttcaaataaaagaagtctaatctgttaataagtgaaaaaacatttattttcattatcaaggaaatgcaaactaaaatgagagttttttcccctgttaaattgataacaataataataaatgataataccctgagtgagtcagagttgataaggctgacactcatataccctgctaggaatggagtacaaattggtagcattttttagaaattcaattggcaatatatatcaagagccttaagtttgtaggttatttctgataacgtacaaaggtgttcattcaaacattataggaacatatatttggaaaccagtgtccgacagcagaaaagtggctcaattgtgctgcatccataatatgggattacgattgtctaaagcagtactattcaaagtgtggtccttggagcagcagcagcatcatcacctgggacctcattagaaatgcacattatctgatcagatccactgaagcagaatctctgcaggagtggggcccagcaatattctaacaacctctttagatgattgttttgcttgctcgcatttgacatctagcattttaaagtaatttaaaatggtgataattttgaggttgttacagtaattgggtagaatgggaagtttgtactttttctcctttgattttgattggttaggtcagattttttttctttggtactagttgattaaaaagagagaggatacttttcctcttatttattgttactaaataataacttgttagtagaataattccttgtaaatagaataattgcttaaggcaattctccaaagtctcctcaacaaataatggtggttcttgatttaggaggaaaggaaaaaaccacctgactgccagtttgactgagatgccggcttccttcaggcctagctttgaaaatcccacagtttaccaggcttagaattacagtttcagcaacttcctcctgacaactgtcaatatgcctaagaattataatttagcccaggcgcggtgactcatacctctaatctcagcactttgggaggccgaggcaggcagatcacctgaggtcgagagtttgagaccagcctgaccaacatggagaaattgtcattgtctttagtaaacttatagggattctggaatagcaaagaagcagacagttaacgggaaggagaaacaagtgatttttttttgaaaaaattatttactactttaaaaaggttaaatgtaaagtctttcattagtttcacaaaatgtatcttcctcatttggaaagcaacctgttatgctttgaagagagtgagcaagtaaaaaagggagataattgtcatattttcctaaatgtgaattagatacttttgctgtaagtttagctatgactttcaggctgctattacaggattttctttgaagaatgatacatgtctttggttgacctttgtagtatcaagtgtatcaaatttatctagaatagagcgtatccgtatgtgttacctagaggcttaataaaccttcacataatgagtaattatgtattgggctaaaatctgtaaaaccttttcagattttcaatatgtatgcctacttccttaaatatttgaaatttttagatattttacttttcttcttactgttctttggattatgtacctttggtatatagcataagctgtagatcctatgtgtaattacaaaatgcatgaagttaatactcccttttctctgtttagcttgtgaaaattcaaatgatatagaataaaaatgtgatggtaacttccttgtgaaagaaaactaagtacaaaattctcttcctcctattgttaaatacaatgtggagaaaaagatttttaatttttaattttccaccttcagcttattattagctatatacttttaggcatttctatttactagggaaaaattaaaaattaaaggacaactttatgttcttaagattatttaatttgttgggcacggcggtggctcacgcctgtaatcccagcactttgggaggccgaggcgggcggatcacgaggtcaggagatcgagaccatcctggctaacacggtgaaaccctttctctactaaaaatacaaaaaaattagccaggcacggtggtgggtgcctgtagtcccagctactcgggaggctgaggcaggagaatggcgtgaacccaggaggcagagcttgcagtgagccgagatagcaccactgcagtccgacctgggcgaaagagcgagactccatctcaaaaaaaaaaaaaaaaatattattgaattgtgtggactcaactatactccatgaaagaatgatctaaaacataatgttggcatgacttaaccttttaaaaatggaaagtttaaaaaaaggcagagggagtgtagctcattagtacctgaagggactcactataatatatgaagctgaacttgtcactttgatttcctattctttaaatatagtataattgtttagtctaaagaatgtatgttttaattacaagtatataatatttctacctccagtgcagcatattagttagaaatttaaaccagtgcatgtaacttaatataaattaacttaaccaacttcttgaaagtactcagaaagccctaaaaaatataaaacaatgattcccactgcctaccctgcaaaggaccccaataccaaaaggtattattatagtgagttgaaatttaatggactttttctgtggtctattagaagtccttttggatcaaaagttgcattgatgcaggataaaatgctttgaggtttgattaagagagagttggcagtaagaggacctaaatttactatactagaatgaatttctgatccttttctcttatttccactgaccatgaacatttcttggtattgatttcttcagaattacttctgtgatcttttgcaaaaagaaacattgtagcctgttgacagtaggttttaggtatgaaatgttaaaactttgaaaaaaaaaaacctgtcattttttcagactctgtatcttcatatgttgttctgaaaggcttttgtattttctgaataacttacatattttgatatggcgttttaccaatagcattcatttacctatttttgcttcttgcctattttcatggactggttgccttatccaacttttttctttcattgttttgttttatttttatattcgccattcattcattcattcattcattcaacttttggggttttgttggtagttacaaattaaatgtttaatcttattatcatatagcttactttgaataaaacatgatacattattaaaattggtatgaagtatcactacattatgaagcagaaaatgtttggtacaaaacatttttttccatattgcatgtaacaataggaagattcatatgtaagaacagaattttgtacttagttttcttacacatagaagttgccatcgcatttttattagatatttatgtcatagttggctctgtgcacgaggcttacatagagagattaataaaaacaatacattgggctctgtcttcataaggattagatttttaaaaaataccaatagggaaagacccaaatgtcaaataatggtatcttatccaagttttgactttgtttcataacagtccttgatctagcctgaaattcatgcagcaactaaaaccatttttggaacacaaagcttttctttatgcatctcctttagtgctttataatggacaataaaaataaatgaatataactaacataattttttacaatactggtgcattagtattttaaggggccaggagatatataggttgaaatgaattatttcagctaaaatttaagaagtatttaagagacacagttggtgaagtttttacatgtgaaaagagatatactttctcttttatcaattagacaaatctagaattcttaatgtaactgctttaaagttggcaataaaatgtattttttaggtattggaatactgataactgaatttcgaaattattcatgtgtatttcacagtaatggtttggttaatcatatgtttaatcagaaaaaaatcaagtagaacacacatcagatttttctaccatactgtttttttaaaaaataatttcaacttttattttagagttggggtgcatatgcaggtttattacatggagataaattgcatgttgtgagggtttggtgtacagattatttcgtcacccaggtaatggacatagtacctgacaggtagtattttagtcctcaccctcttcccatcctccccactcaattaggccccagtgtttattgttcccttctttgggtctatgtgtactcaacgtttaccttccacttatatgtgagaacatgtagtatttggttttcctgtgttaattcacttaggataatggcctccactgcattcatgttgttgcaaaggacacgattttcttcttttttattgctgcttagtattcaatggcatatatgtaccacattttctttatccaatctaccattgatggacatctaggttgatttcatgtttttgctattgtggatagtgctgtgatgaacatatgagtgcatgctattttttatagtcaggaaattgaaaggtaattagagttcaaaatgtaaaacattttgattatcacatataagaattaagacattcttttgaaatagattacttagcagtaagtatcattcctttacttattcattaattcatgagaaggtattaagcatatacaacttgccaaatcttgtgtggggcacttaaaaacagaaagatgattaggacacagtaccttccctcaaatagccaccaggctagtggggaaaataaataagtgcatagatctttatgatttaatgtgacaaatgttgtgctctgtgcacccagagatcaaagactaactgtccatcttagtagtagagggataggtttgcagtggaaattatttgtgtgctgagtcttagagggcattagagtttccttctgatgctggcattaaagggcagagaatgatgtgtgtaattggctataagatagtatggcgtgatgtgagaactcgtagtggtagattctccaaaggaaattgggtgctgagagcatcaggatctttatactgtggttagatttctatacttactctagacatcttttttgatttttgcatttgcccaagcagtttaatactatactaaatgaatatttgaagaactgaacacagagaattttaatgcagttttgtcatttattgagttaacaaatacatactgagtgtttactgtgggctagacattttgccatctgttttcatttaaaacgtttccaagttacgtgctaaacattgctgttcaaattcacatgtaagagtaaaggaatagaaggtcattatgatgctttaatgtggtggagaagtcagtgatgtatccctaaactcgtagtaatatgaggcccaaagtcaagctggttacttagagtcagacactcctttgagattagaactaggacccaaggcttggactcatattctgttaaccacagtcagaggtatgtatgtaatcaggtaagaaggagtaattctaaggaggtcaaacattcttcatgctgcattgacattcaggtgctacttgttaaatttttattatttttaataaaggtaaatttaaagcgttctaggatttactccccaaattggtacatattaagggaagtggtgtttaaaagatgtacttttaccacagttgctgggattagtattaagtattattaattatatttcctgatactctcatgctttctttttacagacaaatcgatggtaaaccagagaagccttcagtaacatatgcaacatatcgaggcccaagacacattgggaaatatttaaagcaacagacaggcttggcaactgtgaataccttggacagagaaaatgaaagttctgactctagtacaaacagacacattgaccctggaagtgagattgaggctggggtactgccactgttgttatcagctagtacagactcatctatgaaaggaaatctacttgaaggcccattagaagactctgattgtagcaaaacaagtttcaacaaggaaaattctttgacaaataacccagaactgcagaatattgcctcttccaataatcttttaaataaaaatgcttgggggagtattgagagaaataggtcatccccttcttctgtgactaactccagctacgatggagaatctgactcacagcaccatttaagttgtgaaccggtttctcagactaacagaaatttggtatgttcagcattgttaacaggaagtaaccatcgcaaagtcccttgcagcccagattttcagagagtaactacaacagaaaatacgataaaagaaaacagcactgtgatgagtaataggacattggtgcaaagagaggagcttgttgagcctcagggccctgctatttctgatttctcttgtagtaaatctgatgggagtgacactactgagcaggaaagtacaaatttgccaagtccaaataaatcaattaggcatgaacatctgcagttgccagagagtgagtgttctgacaagcaaaccatagatagctcatcaaagcaagctgccactcacaccaatatcattgctcttcagagacatgctgtgacagacacagaatttgtaaatgaaggaaagagattgtctgcccaagactcacagaaaaatgtggctgttagagaaatcaggcgagaaacagaaagtgcctcagctggtgaatccatagcttcaagtcatgtaaaagctccagaagataaaattgagtcattacccaaagatactgaccaatactttgaaaccaaagccaaaaagcttgattttaggtcacatgataaaattcctcatattagaatgaataaaaaagacctggcctctttaaattacatcagtgaatcagcagttgtagcaagcttaggaaatgaaaatgcacctgagttgaaatttgaacttaatagaagtcacatttcagaaactcctcttgactctgagagtcctcaacaagctgaagtatcacctgatgctaaaacatctcttagccttgactgtaaaaaactaaatttcagtatttcacctcctacctttgtttctggagttgggatgctgagcaagttggatattcctgatttaatgaatgagggttctcctgtgcccattgaaactgggaatgtcaacattgttggtatttcctatcagcctaggaagtgtaaagaagaaaatgtgaaaaaccatgttgaggctgcaggcaggaagagtcctcctccttccttttgccttgaatatacatctgcaatttttgaattcaaagaagttctttctaatagtgaaaaatgccaggttcttccaggttctgaagccagtggccctcacttaactgggttggagctattgagctttgactctggaaacctctctaaggattgcagttccattttatctcaagaccctaatagagtagagttagtgtcttcaaacactaaagcaaatatgagcataatagagaagtctgattctctttccttggaagccaaaactgctaacattgtatcaaaagctgaaattgatggtcagaacaatgttcttgtggagtcacattctggaagaggaaaaactatatccttgtccaaggtatctctttcaaaagtggagcccagaaacatttctcaggataaaatgtcttcttttccattgaaaattacccatgttccagaaaagcctattttgtcagaattaacctttctagaagttgaacagggcaaacgttttcaatcaattaatcataatgagataggagagaaatgttcagatgctggccttaaagagaattgccaagctgagctttctcctgctgcctccaaatatgaagataagccagaaccagaggtagatgccttaggctctcctcctgctcttcttaaaagtaatatatcttggattttaccacctattcatgatgaaaaaatcagtaggcaaatggcgcagaattgtgaagctcacacttgtgtgtttcatcaatctttggatatttgtgggactaaaaagatttctggtcactcagaaatggcggaactcagcttaactaatatttcccctaaattccaagaaactggcagcatgaaagtaaattcaccttttctggattctgattccagtttggaaaaaaattcttctgcatctgaggactcaagcttccttaaagtaccttctgtgctgaaattggaaaagaaatcctcatcttacagaaagaaagagaacatccattttttaaatggtggtattgatagtgtgtcatcttcctctagttaccctgaagaagttagcatgatagtaaattcacataagccccaaaataatttggattctatacaagttaccaaagatctcacacatgaaggtacctctgtaactaacctgttgtaccctactacctcttatttggaatttgaaacgtctgtctcaattgggacagaagtaaccccatttcaggaacattttgggatttatactgggaagatatccattgatttcccaactgctgcccaatttgacaatctcgtggaagcagagactggagcagttgctgggcctgcagcgtcagttaacagctcaggccaacagtgttctgaagcctctgctgagcacatagaagccaggagaagagcacatgaccaacttttggacctcaaaagtagtttactcaaaaaggccgatacattgattggtgagatttttaattctgtcagggaagaactaaaattcaaacacacagtgagtacctgccaggagcatatagccatagaaggtataatgaatctgggtaccctgaaagaagacatctctgagaaaaacccatcagaagtgacactaacagaaatacaacagacagagggtttggaagagcaaggcatggaaaacatgtcagaagtcaaagagaagccctgtgtttcaccaacagttggtgagaagaatcttcttgttgatcctaatagtatgaatgtatcttgtttgttagaagataaagctagggaattagtcaatgagattatttatgtagcccaagaaaaattgagaaatgatacttttgaagatactgaggatacttgggattctgaacttcaggctaatacttcaaaaattctgaacagtgatagtgttaagccacatgatgtagttagagagttcttggtttcagaacagccagt

SEQ ID NO: 810 - DNA, 3243 bp, Homo sapiens
gccagggctgagatcccgaaggcgggcgaggtctgggatggggcggggcctatgggagcggggctgaagccctgggcccggcagaggaaggtcgagatggaccatgttgggccccttctctccccgcccccaggccgcagttcgggggccacgccccggcgtgctcgggtcaccgcgggaagcccttgaaccccctggcgcccggcacccacgtgcggtaaccgcggctcctcgagagctccagggatgcggatctacagtaagggctgtggccagatgaatgaatgcacattttttagtgggcagaaagatgttagaattcatgaattagaataagcacaaaggagggcgagaggggaggccgtggaagccgcattcctccccttgccttgggcgcccacccccgaaggggcgcgtcccctccctgctccactgcacgtgggtgtttaaccaggggatatccagtgcctcaagcaccacgacccgggagaaaactgagttgagaaggtaacttttagaattctccccatttgaccttttgctctgtaagcaaatcaagtaattttaaaagtgttcatgggttggaggggcgtggtggcttacgcctgtaatctcagcactttgggaggccaaggcgggtggatcaccaggtcaggagatcgagaccatcctggccaatatgatgaaaccctgtctctactaaaaatacaaaaattagccgggcgtggtcgcctgcgcctgtaatcccagctactcaggaggctgaagcaggagaggcgctcgaactcgagaggtggaggttgcatctgggcgacagagcgtgattccgtctcaaaaaaaaaaaaaaagtctccattggcaaacattgttattcgaattatttttaaaccacttttctttaattttcttaaggtcttctaacaagccttttgcacacctgccatgtattttgtcaggccttggggatgaaggtgagaaattcgagaatccccggagataacacatcagcaaatagtgcgcaggcagaacaagctgttggaggtgagagacacagagcagagaagcacccgcacctggagagtcaggagggcctcacatcagaacgcctgagcaaatacagttttgaaggatactaattttttaaaaagttcattcacatgagttagacaaagagaaagaagcaggacattctaggaagaaggaacggcccaggcaaaagcgacgcgtacattggcgtggtaagttgtgttcctctgtgaaatcgaagaacatctttttttttttttttttttttttttaaacagagtcttgctgtgtcgcccaggctggagtgcagtggcacgatgcacgattggggctcactgcaacctccacctcccgggttcaagcatttctcctgcctcagcctcccaagtagctgggattacaggcgcccgccatcacgcctggctaatttttatgtatttttagtagaaacagagtttcaccatgttggcccggctggttgcgaactcctgacctcaagtgatccgcctgcctcagcctcccaaagtgctaggattacaggcattagccactgtgcctggccaaagaacatcaattttaaacatttcagctttcctaattttaatttaaattggccatagctttcattcctcattcctacctattgcacttcaagacggattcttattttaaaataaaaagacacacacagctgtccctaaagtccatttatgactgatcatcctacccttgtgtagatatctgaggaagcccagagatgcccgggaaggctctcaggatgacctgacagctgcccccacctcgtcagcatatctgagggttgacctaccaagggcttgcttttctgtgcccactggctggtcctgtatcacaaggactcatcttccctgagaagtcctaggttggaattacctgaggacgcttgcaggatcatccacatgactttccacagtgccaaaaccctctctcttccttcttccttccttccttccttccttccttccttccttccttccttccttcttctttccttctttcgtcttttcttcctttgttctcttttctttctcctttctttctttcttttcttgtttctttcttttctttccttttcttctttctttattttcttttcttttttttccgggtcctactccaacgcccaggctagagtgcagtggcatgatcttggctcactgcaacctctgcctcctgggttcaagcgattctcctgcctcagcctcccgagtagctgggattacaggcatgcgccaccacgcccagctgatttttgtatttttagagacaagttttcaccatgttggtgaggctggtcttgaactcctgacctcaagtgatttgcccacctcggcctcccaaagtgttggaattacaggcatgagccaccacgcccggctgccaaaactatttattttgacttttcattgactggttactcctgaaaatctttttttatcttaatctctggctcatagaaatataggacatttcttatcctgagcaaacactggatcagaaatcagaagatgagtgtatatgtggtctcagtcacttagctcctttgaaacttaattttctctactgaaaaaaaaaaatgggagtgataattcccactgcaaaaggcttttgttttgaggatgagattttagatgaaataataaatgtatgcatagcctattcctgacacatgacataaactcaaataaaagtcactattgccattatctattatactctgtaaattaggaataacaaaaccatttctgcttatttctcagggtccattcaagaattgtgcccacaatataccaggcacttgtccagacctgcatcgtccaatgcccacctcgacctcccaaagtgttgggattagaggcgtgagccaccgcgccctgcctgcatgtggctattgagatgtgctgtatgatacacaccggactttgaagactcagtgtgaaaaataaaaagaattttaagaggggtgggggtcgaggggaggcagagcagtaggacaaatagctaatgcacgcagggcttaaaacctagacaacaggttgatgggtgcagcaaaccaccatgacacatgtttatctatatagcacctacatgttctgcacttgtatcctggaacttaaaattagaaaaaaaaaataataaaagccaacatggcattcattactgccaaaaaaattaaaa

SEQ ID NO: 811 - DNA, 41672 bp, Homo sapiens
actctcaaactatcaatttaacaagtaaactcacattttcctactctatgctggtggatatgaataatcaggaaggagacatagatgctggacttttcccctagatgctggacttttcccctaggagagaaagattcatttatgacctgcttttttttttggaaaagcagaagaaacccaaattataatccataaggtattcacctgagcacatgctgacttcatgtaagtatttttgtgcttatttcagtttacaacagtcagtgcaatctcacacggcatatatttctatattctttatttgtggctatttgaattattcatatgtttaatttttagtctctttatccttgattcttcaagattctggaaatgataatttgttcttttctcacctggtttatgatgatttcaaatgccctacttggtctcattgaatttagctataaatttcaaaattgaattgcagaaaacaatgtatactatttgaaatcaatcttggataagtcataattacccaaatatttattaatttgatgaatttctatatgccttttttggtcttcacagagagagtatcaattgctaagtgtttttagtcagtggctctttgtaaatgaaatacctaaattcacaatacttcatacaaaatgtgttacattagagtatttgcattaaagatgttttactctgcaataaaattttgtacaatctaacattcatgaaagagggaaataagtggattttgcaaagaatattcaccaagacctttgtttaatagaggggagaaaaagaaataattaaatactagcagaaaacagggttgcctctttgggaaatgtactcattcaggtagcccctggaacattgggtaagtatctcctcttgtctgggtaggtgacagtgtgtggagaagctaatgaatgcagggccaaattgcacctctttgtttggtggatttttctccatctccattagctctcgagaagaaaacacttatttgaccttttaagtagctagacttcaaaataattttagaatttgcatattttacgcatttttttctgaaccctgagcacatataatgcaaatatatagtcataattcttactctgttgccttgttctaaataatgaaagtattagagtcaactctttgagacaaggcccatcttacattgacatcccaaaaatgggaatagtgctccatagtaaacagtttaaaaatattatttggattataaaatgaattaattatataaagagaaaatgtgttcacaaatgtaattgggaataaatgtgttaaatattacatagaatctggttttaatccaaaaacgactcaaacttattaattcgatttgtattttaattcaaccatttagtttttttctttaaatatttcagagtgttagtaatatactagctggaagatgtagctagatggtaaattgtcagaatgaacatagaaatcttggaaaagacagacacagatgaaacaaatatatcttgcctggtccctgaatagggggacatgctattatcgaaagttttaagtagctgtgaattacttataatagcaagtactgaagattgtaatttatgttattatgttattaagcaaattgcctgacagaaaatattgcagtatattaaaacaacttctactgcatctaacataaattcaatagattaaaatatatactgtatatactgtaaataatacttaagcagaaatacctatagaatacaatatataaataggcacctttgtttcccttcacacttcatttaaaagcccagacccccttttaacaatatatcttgctaaaagcaatgtgccctttttggtgaaacaggtaccatataatgaagctcaaatctaatagtcataaattgacttactgttgttaatgcattagcaagtaataaatccaagtccatgccatcaatacaggaattctgttcctgccttaaaatttgaggacaatttaagtctacagagtttttcttggaataacagttaatgctgaaatgaaagtggcatgcaaatctcccaattcaggaagaaaaataatcacaatatgcttctgctgaatctaaacagccctacttcctttcacagtaccttgtgagcagtcctcttaggtgtcagtagtaggcctagtaaacattttttgtccaaggctgtccctatgtggccccacttatgctcacattatgacttcaggataataattaataaagcccactttcactctccaaagtgtctcggtctacataataaattacatagttattatattataggttaatgtaatacatatgaaattgtattaatgatatggattcattactaatgagatttaactaagaaagtttaaattatatggtaactttccatgaagtaatctgaattttaaaggtgcagataaatgctttattaaatgaaatgctttttgatattgtacagctttttccagaaactgcaagcttaaaaaaaaaaaagccattggatatgaaaaaagaagcattcttgagaaaattccctaaggagaatttattttttcttaaaaaggggctttatttgaggtgtcaagctaagattgtgctccttcccacctggagaataacattcgacatcaaatatttggccagaattttgctatagacattagcaagtcattcctttcatctgtgattgtatacgaagtgttagctctagagtgtgagctgccatccatcagagacaacgtttgcttctcctgtgtaacaatgtcacaacactgtaagttcaataacattgcctaagtagtcaggcaatgaaaccaatatgcatgaaatgctatcattgtcgttggcttaaaggcaaaatatgttgaaccaaggctattttcttattcaattaacatttacagaaaacctattatgtgccacgcatcttgacacaaattttttatttgttcctaataacaacctgtgaggtatgtgttactttccagatggggaaatagaaagccagagagattaagtgacttttttaaagttacttagctggtaattgatggaaggttgattcaaatcaaggctgattgattcaacatgtgagctctttccgccccatttctgcttacatctctggctccagactttgatgtttggccaagaagagacttttcagagtggtagaaagccatttcctactaatctaaaataaggattcctgcatggagataaaattgaatattattttttcctattatttttgatagccatttcctactattctaaaataagaatccctgcatggagataaaattgaatatttttttcctattatttttgaaacatcttcaacactttccttagggaaaaaaagtgggtagacagcatcactcgtatctttttttttttttcttctatcatctgcccttcacaattcaatggaggaaactgtacatttcagtgggaagattctattattctactactgcaagacagccttatcttctgcatatcatttatttttgaagctgtaaactggctgaattctttagtctttccaactttaaaactagaaattttgctccgaaatgaaagagtatcaggaatacaaaggagaacaggaaaatctgagacttttttcatttaagatcaatgaattatttggttatacagatatttgaagtatagttaacagatatcaaaaagaagtcctgggttgcattcagtcatggctgccacagatgtcaaaacttcacatgtgggatgaaagattgtccacagtatggaacaagagagtttgcagtttttaaggattctgcagtcttactactaagcaaaagcctggcattttagatctcctatagctgttgagcagaattgaacagtcattcttgaatcatatttactacattgctagctgatgactaaagtaaaggctcaaaacttcagctgtatctaggaaggttttgggatcctcagttccccgaactttttgaactacaaagtgtatattattcccatccaccagaatttagctctggggagacaaactctggagaaggagttttcatgaaatagattttccatgtgaattacttgaactgctgtataaagaactcagaaaaaaaaatgtgtatgcatacaaaccatacattttaaaaacctagtgactactgatcatggggcgagaacacagaaagacagataagagaggtctataggcttcccatgtatacctcaacacctggcctctgggccctgtgatgagaaggctgaaacacaaaggaatctgaacagggacactgcatacaaatactgaattatatgctacataaaggttttaaaatgcaccaggcctgggaagaaccccaactagaatacaaactgtagcaaatgtatctaactgtattaaaaatgagtaacagaacactacaggaggtgtaaaagaagaactaacttattttggaaaacaatattttgattgaatagtatgaggctaaagacaaaaagaactgcacacaaataatatactttccttagtaaatttgttcccaaatgggtacagattcatatttcagaagctattttctttgtatgctagggttgaaaaaaatacatgcatatattgaagaaaatgagagtcagttttctctttgtctataatagaaaagttatatataagaaaagggatagctagaataaaccctgtagtattggattggaattgtagatatcaatatgaattcatcatttttaaagataaatactgacataaacttagacatatgtgtatgcaataaccagtataatatatgtattctgaaaccatgttcactgacaggtactaaaagtagtgacactctgttagtagtaagcacacctgtcacccagatttttgtttctaatacctttatctaataaaaggaaccagaactccttggagatatagttgattccaaggctggcacagaaaatatacaagataagactttagccccatgcagcagcaggaagtacgacagtgctcaaaaaagaatagggcatgttgaaagggcacaggagccaaatggaaaagatcccaatgcccaaagctagaaaaatttacaaaaagaaaaaatgtaattggattataatccatagaataaagtaaatatctgtggtgccatagtgataaagataagtatttgagtagatacataaatgtaggagaagaggcagctcttctttagaaaaagattccaattaataagtaaagaaggaatgagggaaatggaaaatcaccattagaacaccactaatgaatgctgaaattgttgggtaaaagtttgaggagaaataatatttgcatttgaaagtaactcttacaaaatatttattaattaaaaaagaaatatagtaactttagagtagagaaaactgggagacaccacttttagaaagtgatccaggtcaacataaccaataattagatacattgacatcatacatgatatacatatattgacatgatacactgagaggggcatatcacttctgtagtattcttgccaaaaatgcataatctcaatctaatcatgagaaacatcaaatagaaccaaattgatggaaattctacaaaatagctgaccaggactcttcagaagtgtctgttgtatctgatgtaacagatcagaggaaaccataaagacatcacaactaaatgagatgtgagatcctgactaggactctggaacataaacataacattaaaagaaaaattggtgaaatttgaaaaatgtctgtaatttaattaatagtattgtaccaatgttaacttcttggttttgaccattaaagcaactgtatttttctatttttataacttttctgtaagtaatgttcttacaaaacaagaagtttttaaaaattgaaataaaatgtactagaatattgagaatagctatctttggaaagtgaaagtgcagacgatttttattttttccttaattttgttttccaaaatctctacaatgagcatgtgatatttagaaaatgcattactatttttatttttggccaggaaatcccttatgtatggctttagttgtaaaaaaattaacaaatcgtgttttaattttaaaagataatgcaaaaatgtttatatgacgtattagaaagtgtctgtaagctttaatagcaaaggacattccacaccagttaatgctgttttttgcatagatacttaaattgtcattaagtcatcctttatgttttaattacaagcatactgcttaccatttttgaaagccgagatgatccagatataatgggtataggtggaaaatgctactttctcttgagtaattgaagaatgtcatgatgttctcttttaatatcatgctcaatcacacctgccagataacgatttttaattttcaaaatattatgagactatcaaatgtacttgttaaaaacttacttctttcttggaagatttggaaggcttcagagtcattattttgacatgtcatgatataattctgcagctgtgatagatggcactgaaagtaagcctccttctttttaagcttctggacaaatgctgaggaacagtcaaaattagcagaagtaggctttcactgctactggtgaaatccctggaacctgaaggatccactgtaaaaacagatggagatcttagtttctaaataatttgaaaaaacaaaacaaaacaacatttaaagtagaagtaaatgtactctcagaagagttacagaaaaactgagcaggtattcagagaattaatggaaggcttatgtgatagaaagctttctaagtcattattttatcctgcttccctccaaccccttcacatccagaactacttttcacaggatacattttaaagatatctacttattgtgtgtgtgtgtgtgtgtgtgtgtgtaaacatacattcagcatctgcaaagcacaataaagcaaaacacaataaaatgaagtacatgtactcacttaaaatggcacaatgaccttttaacataagaatgtttggtattgtcatttttatttaaactagtcaagcttgaacgccggcaggatctctgaacaatagttctcaggtaaataaaaaatgtaattttattgttctttaaaaatagcaatgaacatagcattacagtgctgcttttttgcctcatatttcatctcaccttgaccacatgtggttaataaaagagtacttattattattttttaaattttatttcaatcgttttcggagaatagatggtgtttggatatacgcataagtcttttagtggtgatttctgagattttggtgcacccattacctgagcagcatacactgtacccaatgtgtagtcttttatcccttactaccctcccacactttcccatgagtctccaaagtccgttatatcattcttatgcctttgcgtccttctggcttagttctcacttataagtgagaagagaagatatttggtttaacatttgtgacttacttcacttacaataacagtctctgactccatccaggttcctgcgaatgcccttattttgttcccttttatggctgagatatatctatatctatctatatctatatctcaatcacattttctttggatactccaacctgagctcttgtatcttccttgttagtcagtcataatctggatgaagtttcgtctactgtgcacagatctttcagcatcaaagatgttggaggggctgggtacggtggctcatgcttgtaatctcagcactttgggaagtcgaggcaggcagattacttgaggccaggagtttgagatcagcctggccatcgtggtgaaaccctgtctctactatacatatgcagaattagcagggcatggggcaggcacctctagttttttgcctgccagtctaagtcactatttagccttcattggctttgttacagaatgcattctaattagataaaccccaaacagatggtacagattacgggtagtagctctgtataagtgaaactaatttgagaaaaaataaaaaattggtttataaatgaatcctcatattttaaattatttacttaataggatttaaggattagaataaaaaccctgtactttgaccatttactcacttctatctggcacaagattcagacctcagctctccgtttctctctctctagctcttattcttggccacgggaccaaccctcacaggggcactctatgcagaagcttccttcctaaattggaactcccactttgaccactctcctttgtaaacagaaataaaactgaattctgcatgttgtcccagaggccagatgcttgtgtcaatcttccattcttccagcttgaaaacatatctgacactttctttaatgaccaccccatcatatttattgaccagaacctgtggagtctttctttgtgacggtttcattgaatcctttacctgattatatgccacttgcccacttaggaaccttcaattcccctacgtgtacaggctcaaattcaagctccttactagcatctgaggccataatctaatgtttcttttacttaaactctctgtcctagactggttgttattgtctcaaaatgtggcatctgcaactttgtttcttttttttttttccagacagggtgtcactctgttgcccaggttggagtgcagtggcatgattggcttaccacagcctccacctctgaggctaaatgatcctcccatctctcagcctccccatagctgggactaaaggcatgtaccatgatgcccggttaattttgtatttttttgtcgagaggggttttgctatgtggcccagtctggtctggagctcctgggctcaagcaatctgcccaccttggcctcccaaagtgctggcattataggagtgagccactgtgcctggcctgcaatctcatttttaagtctttgctcagatcagcacttccacttggaaagatctctctggttctcttcatctatctccttcctgcatttcctatacaatattgcccacgtttcatttcccccttgatgcatttctcattacattatcatacattgttagagtttctgaactctgtaagaatttgcctttactagtctgttggcttgtttgactattttcatatgcttcctttttctatttaatatcttgtttaaattttcagtttatagattacttaaagtaaaaaactatgtgcccatttcccaagttttagtaatttaaaaattactgtaatatgcaaacttacatcatgaaaattaggatatcagtcagagtttgatgttagaaaaaatggctttgacaaacttttacagaaaatgaatctgtttgaagggagtccacacattcattctggaagcttggagatcaagaataaaaaatagataaggacaaatgaaggttggccagagaataagaagtatagctggtcatggttcaagagcacccaatcactggagctgccactagtggacacttaagctactgtcttctcgtgtctaccagactgttcagcactaaatgctcaaggcctctgccactggatgccacacctatccctgcaaaataattgatgctgctgcttctgccactgatagtttttcagattcctgaatctttggaagtccagttggtggtatccaattggtcaagtctgcattctgagcctacatctggctttcaggaagacaggaagggagtatcttcaatccctttggcttctggagtgggaagggatacacacacaactagggaatgtctcataataggaaggattgtctggatgctgggtacataaaaataaccaatgtctaacacacaggcctagctgtgccactgttcagtgcaatggcagggatttaccaccaacttaaaatgttttatacatacttttgtataaaagtatatttttatttcctgaaagcagtgacattttcccataagtgtcatatcataaattagtgaactttaacattctatcctaatttgcataaccttgtctgcctttaaacatgactgcaagatgggaatggtagtgtcagcaagaaccttccttctccccatgacacatcagcaaccacatatgaaccaattctttttgtgagaacttcagaaactaactgagggactcctgcactccagcaagcatgagaccggcacattgaagccagtaagaaaattcgactctctttctcaccataatccccacccccagcatactgccatatgattgggaggaagtttccatctcccagcttctccctggggagttaaggaaaggactggatcatatatccaatgttctaattcttctgagggttgctcagggaactggcttctgtctcactggccttaggttctgactagactcaatgtactctagatgctgggagccactgagaaagaacaaaaacagtgatttagtgcagcccacatgcacttgccatcgcccctccacctggcttggtgcagagcaagtggtcaaaaaaacccagattccagcttctccctggggagggaaagagttgggccatgtgagcaacattccaaattttcctacctacaagaaatagataaattcctagaaacctacagtctaccaatactgaatcatgaagaaatggaaaacctgaacagatctataacttgtaaagagattgaatcaagaatcagaaatctcccaacaaagaaaagcccaggaccagatggcttcactggtgaactctaccaacatttaaagaattaatgtcaatccttctcaaactccctcagaaaactgaataggaggaaggcttccaaatccattttgcaggaccagcattatcctgacaccaaagcccaagacactattttttaacaacaacaacaacaaacaactataggccaataatcctgaagatcatagatgcaaaatttctcaccaaaaacctagcaaattaaatttaacagcatattaaaagaaccatacaccaggatcaagtgaaatttatccttgggattcaagggtggttcaacatacaaaaatcaattaacctgatacacagtattaccaagatgaaggataaaaatcacatgagaaaagcatttgataaaatttaacacacttccataataactctcaaagaactagcagtagaaataaattgcttcaacataataaaggccatacatggaaagcccacagccagcattatattcaatgggaaaagttgaaatattttcctttaggacccagaacaaggccaggatacccaccatcgccacttctattcaacatagtactggaagtcctagcgagagcaatcaggcaaggaaaaatttttaaacgcatccatatcagaaaggaagaagtaaaactgtctgtgtttgctgatgatgtgatcttatatatgttggagttctcattttaccatttttttttctttgaagtgaaaggcaaagaagtttttattgcaaagcgaaagtacacaagagttcaagtgtaattgggaaagtcgccatttacgtatcttagtatcacttttagttttctgttttttgtctctgggctttattttagacagtttcttcaattctgccatctggagatttccccttgtttcatttattcctatatgaattttttgttaatatttgtagtattttatctgtcatttctatgtgtttgctgttgggggtgtttctacacaaattcagcctacctttgtaaatttctcctaactgcttttcacagtgaccaactcttcctggtctgcccaggattttcccagtttcagcactggaagtctcatgccctgggaaatccctcagtcctctacagactgggatgatttgtcattgaattgctttttatcattccacattgtgagagaagcaaaaggtcattaattgtttacattacttcagtagtgggttgtctatgaattcttataaatagcaaaaagctatcatgttctcccaagtaaaatcttttccaagtactgttttggcccacacttcctgaaaaacaaagcctgattcaaaagcttattgggaagtaaatttggggaaaacagcagcaaggcagagaagaaaggggaccaaaatgcaaagagagcatactacttaagctgtccacagcctcaaaggaaaaacagtaggttgctgattctcatataaattctccagaagggcaattcctggaattcaagtaatgtatcagctggctgctgctgtctctttgtctttcattggttgaagtcctcctaggagtcattaaatccattgtacttccaggtagcattcccgggcagccactggagaagtaacaccttctcttggtccaatctggtgatggagcagacattgcagtcagtagtgccaatgggaactggtccaagggtgtgcatggcagtggcagaagtcacggcattaaactataagaccagtgggcagtgccaggatccttccagctgggaagcaaagaaagcggaggattgtggggagagtggataggcgaagctgagtagctctggtatgacacagagtctggatctgatacagatattaaataaaagctactccctcatcccaccacacacctatttgcacctgctttattgcttaattgtagtgatgaatgtaaacatctttagctatgtcataatctgctaaaggcaggattttatatgtatttttctatgatatctagtagactattggcagaagcttaataaatattttatgaaatcatggcacactgcttgaaatatagatatatagatcagtctataattatgaagctcattgtactatgtgactttctagcaaatagaaacatagtataagatgatagttccaatggtcttggaagccaggaattctctcactctgccatcccattataattgacaactctcagtcataaacaaatttacctatctgggtgtctagaactctgtaatttggtgattctggttcagctgccccttactttatgaacttatttgctcattcagtccattgagtttctactatgtgccagatactatgttgggcttggataataaagattaaatgtgtatacatcctgtccttgccctcaagagactgaaggtatggttgggaatttattctccacctggaattctccgtgtctttgtgcccatcaaatgtccttcttcttgtaaggacattagtccttggattagagctcaccctaatccagtgtggcttcatcttaactagattatatctccaaagacactatttccaaataaggtcacattttgaggttctgggtacacaagaaataataataattctgaacaaataatacagaattttgtcccttatctccaagaaaggggatagttttgcttgtttgttcaaattgtgcttaatactatcaacacctctacatatttcagtaagaatagttatttttattctgcttgagaaaagagtatgtacatttctcataatacgaaggttctgatgttctttagcactgacgtaattgaccctacactagggaaagaacagggcagataaggcattcttcagacaattccctcttctagatccaaagttgatcctgatgccaaaaaatcagtaccagaagaccagaggtggcccaggccaggaaataagagagtctgggagattcccattttagcattcactcaatgattaaggcatgacccatggcttgttgattatttttgacctgtcattgtctattttcctatcactgatagaaaaaggtatttggtgtcacattattcttcccaattctagttggaacacatcctccctttcacttcttcatggagtacgtctctattaattatttcttcatgccatgacaagatcaactcttgtctttaaaatattattgcattggtggttcacctcaatatattgaattccctaaaaagacatgaactggtctctgattcatgggggaaaatctccaaaagttgcaatattttaggggattaaaatttataataattcctctgtgtttaaggacacataacatgttttctgcatcaatggttaagtttgatatacattcatggacctaaaaaaattttaggaccaaattaagatgagccatgactctgtacaaaattgtagtgggaaaaaaatgcttacagaattacactatatcaattggaaagggttagtgtcttattagtggctcctcatttcagaatattttccttgatttcagcctcattcaggttgctgcttctactaatctgggtgcattatttacccaattcaattcttcagtcatgcattgcaaaaaagaaaaaaaaaggaaaagaaataaagtcttttgagcaaatattccctagaatatccacagagcttgactgcattggcaatagctggcacttaggagaatgtggtagccagagccctgtattttgctgtctagaatctcactcttgtgcatctggattttcatcccaggcactcctaggcaacccatgatgctgcaatgactgatgtcttagtttcctagggactctaacaaattggtagctgaaaacaacagaaattgattatcccacaattcaggaggctagaacttcaaaatcaagatgttggcaaggccatgctctttctgagagctcatgggtaggatcctttcttgccttctcctagcttcaggtggttgctggcaatccttggtgttgctttgcttgtaggcatattgctcaatctctgcctctgtctccacagggcattttctgtgtctctgtgcccatcaaatgtccttcctcttgtaaggacattagtcattgtattagggctcaccctaacccagtgtggcttgatcttacctagattatatctgcaatgatgctatttccaaataaggtcatattttgaggttctgggtgtacatgaatctttaggaactattattcaactcagtacatttgagaagagttggtggacaactacgtcaaaccttttagtactgttacaatgtcattctgccaaataggtgaacattaattgtaagttatttgagatgaaattccttctactgaagaaggccactttctttcctggaaattggatgaaccagaaacaaagataaatgtcgtgggttaaaaaaaaaaatgttgtaattaggtggcaaaacagcactgattagcttatcattctttccttttgtgcttcagtatgcctacttgtataatgaactacagaatagcctccagattgtgtttgcaaatgcttgatggaaatttaaatcagagcactataaagcattgcgtgatttaaaaaaaagtcttcaaagaaaattcagatataaatatggctaaatgaataaatatttctccctagaaaacttagtcatgtattagtactataatcctcacaggacaaaagaaaatgtcagatatcatggagttacacagatttctttatgtctagtacagtctctagccaaattcaactgctgatttacaaatcaaattcagaagctaggagattaaaatagtttgctttttcagaagctataaagaatatatattctcactctatattttgaaaattcagaatttttaatcaggctcaattcctagcaaaacagtcttactatcccattctctcacctctatatctctgccctcccccacactgtctctgctaccttccctaaccatgctcccaactccagaaagttagaaatatggctactgttgctggtcctctttcaacttcataatctaccttgagtctgggaagactttctataaagtttcatgctgagctacaaaaacaatgctgtgtgtgattaagaatgcaggctttggagacagactgcctgaattccaaactttatgtgactttcggttgtttaatggctctgggccagaattttatgtgtaacataaggctattactaatactcaccttaaggatattatgcaggttaaatgagctaggttacataaagtgttcagaactgtctctcacccaataaatggttattattattaatctgtgtgatgctggtatataacagaataattcaaactaaataatgcattcaaactaaactattcaaactaaatagtggagagttcatattcaaactaaactgtattgtaatgtattcaaactatattgtaatgtattcaaactgtattgtaatgtattcaaactaaactgtgttcaaaccaaataatggagagttttaagtacagaacatcacctcatatacttaatataaatgtgcttttaacagagcaatgatccagctcttgtgaatggtaggttgagctcagtggaataggacccaatgaatatggacactccaactaaatttcaggttcagattgtcccacaataagacacaatcattcaaacaacaccctccaagctgataagcaattaagggatcaaggcagaaacacacagccaaggacctagagcatcttagagttggtggttgtaaagttagaaacggaccacagtggtcctcctgtgatactgagatttaaatgtttttatcttttttcctgctcccctcaccccattcttctttccttaccatttctgttatcgtctcagctaaagttaatggttagaaataatgagagttgatggtagccagaccagaaaaacaaatctgttcggtttttgttattcgacctatgtgcatcctcttgattcaattagttctcaagtatctctcaattatacctgtgaacatgtgcaggacagaaacttgaatttataaaataatgtttgaattaaatggtatctcatttgcaattcaaaattctataatccagggaatagactggaaagttttagctctgaaaatccatggtagacctaaagagctgagtttctaagttgctaatatttatcacttgcctttcacaaatgagaatggattgcctgttctgaaagttggaaacaaaaactcttttctctgattcccttatatcagcataacaaacatgaagaaaggtaatgactgcatcatcaatggcagcaaaatgtgaactacccacagatactaagctaactaggtgtgcctaattgccaacagtagggatatgccccgcctgtcacttgaatacgttcttaatttatgtgccactgaaattccctggtaagatgtcaccacttacattgtgggctaagtggattacacatcttgctgtagggctttgagtgaaatgcagacttcttggctaaggtcaacaatggaaaacatatataatggtggtcccatcagattaactggagctgaaaaattcctatcccctagtgatgttgtagccattgtaacattgcaaaaattcctataatctagtgatgtagctattgtaacatcacagtgcaatgcattaccttttctatgattagatgtgttcagatacacaaatacttcccactgtgttacaattgcctacactattccgtatagtacatgctatacaggtttgtagcctggaagcaatggggtacacctcatagcctaagtgtacagtagaacataccatgtaggtttgtgtacgcacactctaggatgttctcataaggacaaaatcaatcacctaacaatgcatttctcagaatgtgtttctgaaacagacatagaaaaaaaaaaaagggtttttttgtttttgttttttgtttttttaatctaggctttcaggaatgaaatgcctaactcaccggatcgacttgggtcagagatactgataaacctctcatgccttgaaattgcagtggaaagcaagttcagccacttgccgcttgagaagccgaatacacaagaggtgaggtatagtggaaggaaagcagctttattaatcaaatgccggcagttgaggaaatggctaggtttatgcctctacaaaaccatttcaaatttttgggctgactgtaggggtttaaaaagagaaacttgcaggagttgtgcaaggtgcagttctgcatgtcttgttccaatggctatcttgaattattgtctacctggacagaatccaagctggcatcatcttcactgtggctgggtcatagattatcccctctgaggtaatttctaggtgggggagagttctacaactgggtttccgtatctggtttgcttctagagtagccccgggagcttctaaacaagcatatcattgaataagtgtgcatggtgctagggagtgtctggtgggaaagggagagaaacagagttgtaaagtgcatttcaaggctatattctgagtttagagaaaaaaagtttttaagtgcattttaaagctaagatacttgattacaaaatgtgaattttgatggaagaggaagaatattaaacagctttcctcagttgttcttccacttgtgcctaagtggcatccatacttgaccctgtagacatggcattcaattttaactcatcttccctcagctttaaagtagcgaaaatcataagaagaattttaatttagcaataatttttggtccccaattaatctaatggctaaaatattgtacctctaatacttaaagaagctcagctagtaagtaaacttggtatgttattaatcaagccatatatttttattaggggccttttatggtctcagcactggaattttagtgagaggtgattaaaaagatatgttctctagcagaaaagatgaaaaccaaagcatcaatttattcagcaaacacttgttgggatctactactgtgccaagtgcttaatggaaaacacaggtgtttaacataaggtcctttatgttgatacacaccaaatatgtctttcctaaatgaattttatgttctttattattaggaattcatatctctaaaagaattgaaacactgtttatgtgcataggccatcaaacaccacagagatatcttttgaagacgttaacagtttaaaattcctcactggtgaagaaaaacatgagttttacatagcagatgctacagtttaagatggatgtatgtgtataacctctctagggaagtactagaacaaaaatttaagtcatgagtaaatatgcatgcttatattaagaaaacccatcttgagtttacctggcatggattagtaccagtaggaattgtttaattagtaattaattaaattttctgaaaacatacatcatttcattactagaaacaagagcaaaactgcatgttgaataaagcaacactcgtacacttaattaaaaagcaaataagttaacatataatattttcatactgcccatctgcccttagaaggtctacatcctccggaaaaagctgaatataatttaggtaaaagactatattaatacaaaaaggactgaagtttaactttctcctgtctctccttccttccttttcatttttgccaacacacatttcacttatattaaaacttattccaccacaacttccttgtgattaattctaagacacacagtggtagaaaaaagttaagcaaatatatatataaacatataaatatatatatatacatatataaaagatatataaatatataaaatatatatatatatactgttgttgttgttgtttgtttttttgagacggagtcactctgtcacccaggctggagtgcagtggtgcgatctcggctcactgcaacctctgcctcctgggttcaagcagttctcctgtctcagcctcccgagtagctgggattacagatgcccgccaccacgcctggctaatttttgtatttttagtagacacggggtttcatcatgttggccagactggtcttgaactactgacctcaagtgatccatctacctcggccttccaaagtgctgggattacaggcgtaagccaccgtgccaggccgaagcaagtatattaaaatcactcttaaattcaaatattagaatgctgttattctatgaaatagatttgtagtttcttttttaaaaaaaaataaatttaagttttttaaagtttagagagaggattctgtgaaactgccctagggtggttgctagccatgcccaaaaggtagattcagattacactgtgtgtaagtgcaagtgaactaaactttgcaatttgtcttgtcccatctgttacaaacttcacagtagggagcctggcattgtcagttgccttaagtgaccggttgtgaatgcaaacaaaatttgtgtgtacttttctagttttttgctagagtcaaaaatacatcacgttcttggtgctcagttttcactgagcctgtggaaatagggtttatggcaattttgaagacaaaagagtgtgtaaccaatagaaagaatgttttctatatccccattgatctggtttaaaatgctctctgtgtgaatctaaaactattttagaaatagtttaaaattaaatttaaattatttagccatgagaaataaatgcagacaaagagtttaaggaagctgactagctcataccattcagaagtttgtctttcaagcagtaacctagaagataatccattaattatgaaaataattttaatcatgtggtatggatatctttaatagacatcatcataacatatttggactccttgaaattgtcttgtgtgtgaacaaaacaaactcaatttgccttttacagattttaaataattttgaaataagttaaatataaatatatattaatgtaaaattaacatattaaaagatctttgaagaaactaagcattaaatctgtgtataatcagactaaagcattttattccagtaacttttctgaaatacaaattacctcacataaaactcatgttctactttccttaaaaataagacactttatcttatgtgctttaaagcaaatggattattaaataatgtaaaagcttaataaattaccagctggtcgaactatttattaattaatgagataaacttgaggagaaagcaataattataaatattcttttaaaatgtaaattgatgacctgacaaggtttttcattataaatatattaatatctgttgtatatagacatttttatgctatgtatttcattttctcctgctcatttctaaattaattacaggcattagagaagctataaatactaaaagtcagattcagctgtctgctttcaagtgtatcacaccaaaatcatcgatctttgagaaaacatagtaggacaattctttacataattgtataattataacccatgttgaaattagcaaagtcaaaagaaaacattaaacagtttttcttttctaaatgtcataaagactttgtagaatacttatatttataatgggtaatgtggttacattttgcattacacttcagctactaatgttataaatgattaagcttgaatgaattttggagtctcacatctagtatatgcttgttttttttttcggtcagaaacattttatgcttatttctttctcttcattttgaagattaaggaaagattactttaagacttgaacttggcactttgcatatctctttggttcatgcaatagtctttccaaggcttgtgaaaaattcttctaaaaggacaaggtgaattacttggctaagatacagatgccaatatatatacaaagagaacaaagctctatgaaatgtacagaaggatcctgctctcctgcttgaacatttaactgaaaggaaaagaacggaggaagccagagtaacaataaccacatgccttttccataaatgattcttgcacaggatttcaaataccagaagatggaaggttaataaatgtaggaagattttatccatacaagttgagaaaaagttaacatatgtaaaatatggaaatgatcttctaagtgtctattgcctttgaaaggtatcattctcaagttaattcaccagttaatttcatgtcatctgaagtttctctattaaaatttaagtaagagattctcatttgggaaacaacttctaaatatttcagaaacacttaccaacataaccacagtgtactgaatttagcttgtaccaactcaagagagctaattgtgcatgtatattcacaactcttgtgtttcagtgctgtcacaatagtgcttggaatcgagtgtggtgggagattttacaacacagaaataaaaaattactatttttaaatattttatttaattattcctatcagcctatgagtatatttctatatttttatacaatttttattcctgttttacaaacagagaaactgagatggagaggtcatcagcccaaagtcatagtgtgaatggtggagccaggatttatgctcaggcagtgtaacttcatagcctttggtcttagccacaatgctactctgcttcccaataaatatttagtcaaagtttattcatcagtatagaatgatgacattatttattatttattgactgcataaacccaaattatcaaacactttttcaacattctctcaaagaagtaaattcaatatatctaacttgaaatttaggagcattaaaaaattaggaaaactattttatagaaccagagtttttcatggggacaggtgctagggttctctgctccagaattctgatgcttaaaatgttgcatatttgttttagatggaaaaagagggtgctggcagaaggatccctggttgggcagcgacatgccagtgtgtccagaggagttccctgcctgccaggaatctcagcagacacagtgatgtgaaggagcaagacaaaatgccaggtagagacctactttaaatagtacttagaaataaaaatcataagaaatgttgaaccatgcagtgatgagaatcacttttataccacccaaaatcccttttcctgaaatctctatctgcttgatgatactgtccacattaaaatttttaaatattttacaaagtactttcataaaatagctaaacaatcctgaaatccatccttctcttgccatcattggttttcctaaggctttgatatcctctacttccattgttgattctcctgttttcatttttaagtcattttctttggccttctgctcttcccgtttttcacaactttaattattgacaatgatttctgaatctcccgtgagctctggtgtcacatacttgacacaaagtacagttaaaaacttcttgaatgaatgagtcactctccaattgcctgatgaaaatacctacttggaggtatttcatcaccttgaagcctgaaaacaacctattgtcttgtccttaaaataactaccttttctgagaatttctgttaatggtagtgagaaccaacatttattgagtgattatcgcataccaggcactttacaacatattatctacttctcacaactatcctatgaaatagatggtgtaatgaagaaatcaaggacaaaagcagtgagcaagttaaggaatagagatatgaacccaggtcatctaactcaaaccagtgcctctcccatcacacgtcaggcttatctgtttaagtcccttaaccacactcagttccggtggttttaacctgtcaggtagaggcccaaataatgacgaatgaagccagaaaaaatagaacccaaactgacaggttattagggatgaacaaaaagaattgaaaactcagtaaaatccaagaaaatacattcataacccaaaatataaagaattaaagagatttttgaaatagagtcaagatttgcttatttgtttgaatcaagttccaacaatacaaatattaactttgcttgatttgggttggaatctgagttgtcaggaccatttctcagattctactgagaatgtaaaagagacttaaagaagtaacacagtcgactaatatattttatttaaaaatttacttttgaagcctataaatggataaattccaaaatacagaatatttaacaatatttaatattttttactcaacagtctgcctttgtgtttttctttccataaacaaatacactggattaaagcaataatactcttatcttcaagttcaatgcctgagtttcttgcatactatttccatttaaagttcagtaattacttaacttcacattattctgtcacaaatgataaatgtgctacctatgtagtaaaaatcataaaactattataagccaagtcaagagaattcataaagttaatatgaaataataactatactgatacacatgtgcaatgggccctaccagaaatatgccaaaataacaagttttatttaaagaatgaggtctttgggcagaaagaaatgaggggtcattatcatcaaaaattattaggaagattgtaggtaaaaagaaatcagcctacaattttaactaaataaaggaggagaagggagtatatcattacagttgatgcagttaggaaaattcaattaccattttaccacaaactggctgactacttcaagagctcagagtcaggctctccaggcattctgttactctcccactaagtttccttacatgggacataaacctgcatttatgattacaacaaaatattataatgctatttaatctgacagttggcaaacaatagaaaaacaaactggaaattagtggagccacaccctctcactacccctgaaaataggggctaaaatgagtcattaagaaacagtattcaaagaccactgtattaactaatgtgatttataaaataagcaaaattcagcaattttcaatggaaaatgccacagtatttgaacactaggaatgttttgatgctgatttttatcaaagtggtactgcaagccattaagttggaacaaattccaaattcacaattacatgcatcacctcagtttaataatccaataaatgataaaaaagacaaataaagaaaacagcatcatatagcacagcagctttgtttggctccctctggataaaatcttcagtttgcccatagttttacctagaaatccagttgtggaatcaaattgtgaatcctatcagagataaaggcaaataaaatatcacagttagattctaagagtctacatatgcatatccaagtaattgaataactgttaccatagtacatttgtaatgacagttttgtgtttaatcaattcaggagcctgttgataaccttggataatcagcctgatttctccatgcaaaatacagtaatactctcagcgaataaaaagctctttcattgtccaataaacacttctttcagctccacagagtaattcaacaactcaaaactatttaggtgttattccaattatgtggataaaaaaaattaacaataaatgtaagtactttgtgcattatcacacagatttttttccccactttttgttgtgccattgctctccaaggtcaaatggttgactgctacccaagtagaggatttcatccaaaatgtaatacggttagcagttaaatgtacttttatttacttatttatttatttagagacggagtctcgctcgttgcccaggctggagtgcagtggtgcaatctcagctcactgcaatctctgcctcccaggttcaagtgattctcctgcctcagcctcccaagtagctgggactacaggcgcacgccaccacgcccagctaatttttttgtatttttagtagagatggggtttcaccatgttggccagggtggtcttgaactactgacctcaggtaatccgcccacctcatcctcccaaaatgttgggagtataggcgtgagctaccatgctaggccttggacctttacttttaatatccttttgtttagacagctgactttgaagtagagtctattaagttaagagaatatcatatagaggtagtaaaatgtgataaggactataaatatggatggggaaaaactaacgtattaaaacatagctggaaaatcctaaagatgagagaggcttaggtagggactagaaatattacacatactttcatagaaattataatatcctgagatgtaaaagccctggcataataataaatatcctttgtatagctcagtgtctatgtggctcatatactttagatctatggatcttcaccatggttatgcatcagaatcaccggagatgctttttcatggttatgcatcagaatcaccagagatgcttttttcaaaatatttacatctagatccctcctcacgaaattctaaatcagtatatttaaagacagaatcaggcatatacatttttaaagaggtccctagcttattatagcgcacaagcttagcaagaacattgcttttgatgccaaattcatttttgaatagcacaattttaaaagcacatggaaccagagaaggttcagagaagcttgacattcaagataaacgttaacaaatggaaggggactctaacaagaaaaggtatatgttgttagagagaaaaggctctgggctgttcaaatgtatgagcacttttttcataagtgatccttaggaaatcaagcaaaagagtaagtatccattaagtgaacgacatttagttggttggatatcaagtgccttttgattgcttggttaataaattactagtagtctctactattgagacttctaagactactcaaaatagtcatttgtcttgtttttaacaatcattctaaaaacaggattaaagatatattggcttccacttgttcctcccacttacatgcgtaagacgagatgaaaaatgcaaaagcatggcaaaataaaccttatagttattccaaacacattagatacaaatggacgggaatcaaggacttacgatctctgtatttcaaaatgaataaaagttgaaattctattatttgcgaatattagatcaaatttcttaaagttaaaatcataaccacttaccatttcagctaataatttattctgggttttaacttcatggcctatttcaatggaaagctataaagaagaaggtatacacaggattactcacataaaagtattcaagtgttataaagtaaaaataatgtcattctaagcatacacattttctgaaatgaaacggtcttctagacacataaactctctttttctgatactttttctaccaagatcaataaaaaataaatttggaatttctactcctcccaattatggacatttcttctttcctctttattttaatttcatcttaatattcaattccatcttttaatttggtatgtactacttctctctgattctcttaaccttgtatgcttttatatctttattatattcctacaaaagctacaaattcctacaaatatctgtatatttccttcttacattttatttattatattttataaattatatatatatattttaacttattttaggtttgggggtacaggtgaaggtttgttatacagttaaactcatgtcacatggatttgttgtacggattatttcgtcaaccaagaattaagcctagtacccaaccttattacattttgaaagatctagaagtacccatacaaccaattcaaatctagacagaagtatttaatattttcctaatgaaatgttacattactttaaatatgtctaaactgatttttccttagtttaaaggtttttgctttaaaatatgataataaattgaaaaaaataaatattagtgttacttacttcctgaagctctgaagaaaagagccatagcttacaaaatacaatactatagctaattatgacaactattcaaaccaaaatctatctaatactttataggacagattcatcaaaggcttcacttccaagatatttaaataaatagaatcatctactgaaaatcttggtaaatcactgcaaatattgttcttcatctgtgtgaaagcacatgggataatactgatacaaaaccatactagaattctatagatcagaacatgagctttcctcccagatttaacaactcagagataataaagtaactataaagctagactgcccacattactcaacttctatcactgtcattcatgccaaggaaaaatatttccaggacatcacaactttcttctaacaagtaatctaaattatctacattgggggggtttttaaaggcatttaattcttaagtccttccaagtgttgtatttttaaaattaacattatacaatattacttagttcataaatcaactttagtttaatatgactttgaaaacaatcctgtttcaaaatctaaaggtctccagactgaatgtaattcgattttccaaagactatattgaaataccaattaagttttatcaacatgggcttctactgaatgctttataagtgaacgtcatgttcattataatgcagtatcaatcacatatattattaaaatcatcttcgtgtaattctttggttcaatacaaatttactcaacaccattgataaggaattatgctaagtgctatatagaatataaagtaagtacaatagaaaacctgcattctggtaaattccttttacatacaaataatgccaatgcaaatcactatgaataagtgctacagaaatggcacaaatggtcttatgttcataagaagaaaagttacttttggatgtggtaatcaggtaaaagtttggagggagggggtgcaatgaagtggggcggatgtggataagcagcacttcagttgatctaagaaggaagtggaggcttaaggcaaagggatagtgtgatatgggggtgggaaagtgacagcatacagaggacacaaagtgtaatttgtctagcaggaagcacatacagattctggaagtgtgagagataagatctcaaaagctaaggccaatttttgaaagatctatctgatttaatcaagctacgaagcatgaactttattaaatcatggaaggacgctgaagacttctgggagtgcaggatgcaagttttaaaatattctaaacgaggactgtggcaatgattatatagctcagatcataatgtgcaaaaaaacaggaacagataggttaagatgttcttccaatagttcaactaagaaaaccaggggataggccaggtgcggtggctcacacctataatcccagcactttgggaggccaaggcgggcggatcacctgagataaagagttcaagaccagcctggccaacatggtaaaaccctgtctctgctaaaaatacaaaaattagccgggtgtggtggcgggcacctgcaatcgcagctatttgggaggctgagacagggggattgctttaacctaggaggcagaggttgcagtgagccaaaactgcaccattgcactccagcctgggcaacaagagcaaaactccatctcaaaaaaaaagaaaagaaaagaaaaccaggggatagtattagaaatagaaaggcaaagatagaaacatcagaaagacagtgtaagactcagtgactgaaatgaagtacaaaggtagaaataagaaagaccaagatttatagcttagaaggctagattaaaaaaagcagaagagctacttgggggtggaagatggacagctctgtttgagacattacagcagacagcatacagtatacaaaaaagagctggagatttttcttaagtattaaaaaaaatctatcttttgatgtgccacattttttaacttactcaaagcacagtctaaattttgagtgtactttgacctcacaaaaccacagtatctgagtaaatgaattccttaggatgacgtcaataagaatatatagtttataattatatgtatagaaatatatgaattaaaacacatataatatttgttatatacttacagattttatagcagttactttgcttctcagactttcagtgagcctctcattttcttcttcacaggcactatacccactattagcatagccatagttcccatagttgccaggaggtactccttcacctgcaaggatcagagtcacaaaggtggttctagagaagccacttttgaaacactgttagttaggaaagaactgaaaaagacccctggagggccttgcaaaccacatatgtctctaatattcatactccaaatgaatttaaaaaataaataaccaaacagagatcagaccaattctttccattactctctgttaaccaaagaatattcagttcagttcattttgatacacatttctggattgcttattgattgtccagaagatacaaaaataggtactaatacacaagaatattcaggatacattccctgctcaagagaaacatatattttaatgaaagttctaaaagcagtaacatcatctacccattgaaaaagcgtggctgtgaagaggaagggaaaagtggttaatacagaaggacgggagctcatagcggcgagggttctttactggcatctctttctcttaaatagacagttggacaggaaagagccaaagcagggagggggcaaactgaagctctaggaaagagacacaataacttatgcagaatgctagctgagagtcaagagggagattcatttattcttcaacatatatttgaagaattaccatgtatcagatccactgttctttctaggtgctacttttatggaactctaagggataagaatgtacacctccctgcctaatatagtacttcatagtcatcaggctatcaaacaacagatggagtgggccttagtgaatacatatataaatatgttgggcgattaacaggaaacggcatagttcagggtgttagttaactatactttttttttttttttgaggtggagtctcgctctgtcgcccaagctggagtgcagtggcgcgatctcggctcactgcaagctccgcctcccaggttcaggccattctcctgcctcagcctcccgagcagctgggactacaggtgcccgccatcacacctggctaattttttttttttttgtattttttagcagagacagggtttcaccctgttagccaggatggtctcgatctcctgacctcatgatccatccgcctcggccccccaaagtgctgggattacaggcgtgaacttttttttaacataattgttgccatcaattttctcagtaaagggagaaaacgggctatctgctgaagaatgggtgatcattcagaatatacagtaaggagaatgatggaggaaagggaccgggactgcacaggattactaaagataaaacaaacttgtttgaggcaatatactacggtggcttcaatcgtcccaggtgtgtggtttttttctgcagaagagttcatcggcctgagttagtccaggagaaggtggatggttggactaatctatagttggaagcttataatattgaggttgcagaaaaacggagccccaagaggttgagactgcttgccaaaagagcggttgaagatctggattatggggattagattggacagatattaaagcagattcaacagtgacttgagaatgtggggaaaggaatgatatcaaaactagaagtctcagagcctgctgcacacagttgcttgcacctataatcccagctacttgggaagctgagggaggcaggatcacttgaggccaggaatttgagaccagcctgggcaacacagcaagacctcatctattaaaaacaaacaaaactagaagtctccatatgctcaatgagcagatgcagcagcagtgacaggaggtaacagcactgatcactgaaggacagtcaaggtgtgaataggaacttctttcaaggcacaatagaaatttcattttccctatgaagcaaaactctcactgatttcttacagctctgattgtatgtaacactaatattgcactctgtacagtactataagggaagagaataagtttgtttgactcaacactgtatgtccccccataaacctacaaacacatacacactgtaaggcacactcaatgaatacatgatgtgaactaattaatgaaaagaatctgagttcactgttattgaactttgaatgtgcatacctttgtccagaatggaatcatatgcttctctgaaggcaaagacagtatctcatgcttccatatcctccctgtacctaatgagtactttatatgcagcagatacctatgcaatctccaccaccacaaaaaccacaacaaaatattgaagaagtattttccaaacagaagagagttgtactatctgaattttgctgctgacacactatccatgacacactatccatgaagctctccacatgttttattataaaagaactcaaggagtgggcatatttttccgctcagtcaaatattaaaatcaccatttaaaaatgcattcttactctgttaaccaatgatactctgtgcaaactgtagtttaataagggccaagatacttaaagaaagaatgtcttcttattttgtgtggctgaggttctgagtatataacatttacccaataagtaattactgactggttgaattcaaacatttgacaacttcaccaaggaattcattataaattaactgctattttttctttcctttgtttagttgcttttgcctatcttaattttaattttagagttcttccatgctgttccatttattcaaagtgaaattcttgttgtatttatcgtccagaaatatatcaatgcacattcctattaaagagttgatcttccctcaaactatgacccatcccaaatacaatgacaaaagtaaaaaccaaataaaatgctagaattgctattccaaacaaagccacttctcttctggtggtgtactgctatgaaaagttgtaaaaaagctagtgagtactgaagatcatcctcagcctttgtttatttagataaacgctacttttttggataggttctatcagtaagctaacaaaaccatttagagattcatgtgaagtgtggcagcttctgcctatggatatgtatcagattcactatgatcccaaatttaaaatttcaggtcaatatgcattcatactttaaaaaaaaagaaaagaaaaaatgtgtaacaaaagcctttgtcacttcacaccaatgtaaattatagcaatagtagttacctaggtaattacttctcctctcaatcacagaagagcttttttttaaaaaaaaaaaaaaaagaaagaaaaaaaaaggaaaaaaggagaaggtagtgggctctaaattggagaaattctaattttactggctgagctgaggtccaggtaacaatactttaaaaacttcccaagggattctaatgtacagtcagggctgagaaccattactcaagtcactttcctgcaatttaacatggcacactgcagcaggaaaatactcaaaagggcctaggggcctactgatgaaatccaaactctttggcctcgcatgcaaagatctccacagtgtgatcccgaatcccctacttcacccaaactggcttaatcataatcccttacttcttttgagttcctcctatctggaactcacttcccccactctccattattcaaggtctacttcaaattcctatgtctccaccaaatacacaaagatcttccccacaaagtacacagtgatctatctctgaaatctctgagaccatcccttatatgtagaacttatctggtatttggatgtatagcgacactttgtactacaatttatctttgcacatattcctactccccacctagactggaagctttggggatcacaaacagggcaacaaacaactgtatacctagagcttactcaagcacacaataaatcttttttggtattaaggatgatgaacaagaaaaacatttagacatataaagctaaacttgctcaaaattatttcttttttttttctcttcaatttacctggccccattttctatgatctaagtattcataaaaacttcattaaaaaaacaaaaaactttctcatactacaatttattgatcaataaacaagtctacggttattggcaactttcactgactttaaatatctgacactttggggattttttttttcttttttcaatcttataatgactgagaaaggtaatatcttttttcaaatgtttcatttattttctgaagtatactgcactctaatttagcggggtcttctttaaaaaaaaaatcgtgtcctaagagaaagcttcagaaccagaaaatgccgttctagtagctgtgcgttactataagggtccattaaaattccttgtgtctaacttattcttgctgatgagccagtttcctaaccccaaaggtaaagatcaaatgttaagtcgccaaaccttaaccacgttctactgccttaaccgtggcacaaggttcagattaagaaatcgcctttgacccagaagttccagttccaggacctttaacaataatgacacatacatttacctttgtaactcactgttaccagattaacgaccattactagcgtgctttgggtgcaaccacccactcttcaaattccgcttctgaagaaactaagatccagggccagtagggaaacagaaaccggagtcgggctttggaaaacatagcagcgtccataaccacgctcagtcaataacactaaaacactcgaccactgagatgccacctgtacacacccacccctagtccactactttctctagcctaccatccaaacttgaatctgactcaaacttaaggaaattccaaagatctgggacaaatggtgtgtttccactcgacatggaccccaaagatcccctctagacatcctgttttttggaccaaatgccaggaacataagacaggttcgatttcctcccgcgccccagcgctcccggttctagggccccgaacttcgaacctcagccctcttcttacccaggcctgcacgcctcatcctgccagaggagagagagaaaaggcgggtgcggggctttgggtgagtaggaaacagctaggggcgacccggaccgcgtcttcagtaccagggcccagcgaaacaccaacttcttcccctaaagcgccacgacatcagtggagtctaaacaccgcgccggatgatggcgtcaccacggcgctcattggagccctgggaagaaggttgaaaggcattctgggaaatgtagttcaccaacgcataacgtgttgctgagggcgtgatgtgaacccggttccaggagcggacggggcgtccggaaaagggggcggcttcgactgcggctctgattctgggtctctgatccaacgttcccgctgttccgctcgcagcccgcgggtcgctgctttcagtttgttgaccaccaagtttaacccagcagatctgctcctccccacccacaagaggatggttggggtatctttcctgatttagcctcgaactccctctcacctccagagacgattcagggaaagttagagaaaactttgtccaggtttctcagtttacaaacaagtaatccgacacccacagaagtaaccgatttgtgccttgtagtatccagtaaaggaaagaaaaccaggttcctttgagtaggactcctgctcagatgagagcagactaggaaaggctgcgggatctggtcagaggcactgaatagttagttccctgttactgcatctgttgtacttctagaaagaaccaagacttttagttgttatggggaccaaaggacccctaaacgctctcccacttttttttttttaacttacacaaagcttattgaaatactgcttacacaaggcagtgtgccaattaggggtttaaaacttgttggcgagttggaggtgttactggtatcgaggttaatcctagaatttcattttatctcagaggatttatcgtgagaatacgatgaaatcgtggtttttgaagggaaaacaaaaaaacctgatacacagtaggtgatcaaaattcactgggtgtctgcggttttgttgttgctgctgtatatatggcagtggaatcgtctccacactagagatttccgaatatgtgatctttgatcatttagcgtttcctcatagtttcccaggacattattaacattgactataatactggcataagtctctgcgttaagttgcttttgtaaaaaacacatgaaaacaatttttaataagagttattaacctgggaaggaggctttatccaatagtgttttgatagaaaaaaatcattaaaataaaaccgccattttctaaaagcaatgaaattaaataagcataatatcagggacaattattacaaataaaagatggagattcaataaaagaaatgatagctaggtatccctttataacttaaaatctgtgacagtcctttggttaaaaaaatgcatgttctataattaaaacgtttaaaaattgccttacagaaggcttgctgatggaaatgtagaaatcgttatttttgaaaatatggtaatatttactagaactaatcatttagattacataaaatatactgcttcctttacatggtaggaagacataagaatgaaatgtagttaaaaggaaaacatatataatgtactaagaatataactgaagtaaggcaaagctagttcatattgaagttgttacctaaaaaatccaattattgtttttagctaacgttgctagtatcaaattaggataatgtcatctgaaaaaaatttgcactcaaaggaagaggcaggaaaaatgaactcaatgtgcagaaaaagaattattaaatgtgaccatagttgacattagcgatcagagggaatcattttcacttttctcgttgtgctttttcctttttaaattaaaatccttaacttttcttactgattgaaagcaaataaatttcacagagatgaatagcatttagaacctcttctctattctcacaggatagtctcacagaaaacatctaatgtttgtaggtctctaggagataaaggactaaaaattacttaaaataatattaagtattccttctagtaattacaaaagcaagaataaaagcaggaaatgtctgaatcgaggtgcaaaattggaacttttctttctcctatctgtctgcttcctgcctgcccatttgtcctacctcttcctgaccaaatttcaagtccaatccaagggaaaagagcataccaagctctcaaaactggttcaataaacattaacacatttttcaatcatgaagcaaattcagtatctcgggtatcatatttgaactgtcacaaaatgtaaactagaaacaaaaagctcttgatttacaaacaagctatgggacaaagtttgtttctaagtttgttgtttggtatttaaagcacattttccctgaagactgaaatgatggtcaggttcccaactcagcccagaaaacacatggctgttagagttactatgctggccaatcaaagtctgtgtaacccataggacagcagaaataccgcgtattttcaagaccaatagaaggaaaataatgttgtaatacttgtgataaaataaagcaaagccattaaagaagaaatagagtgtttaaaaattattttggttattcatgtttgagaaagaatgagttttacttaaaagttttaagaatgcgaagaatattttcaaggagtttgcaaaaagtcaccaatttgatctgtcttttccataatttgggaatattactagcactgatggcaagcttttcagccatagtttgtaaaaattaggcacacaattccaaccttaaagtcctcagcagagccagacacataatttgtggggctcagggcaaaatgaaaatgttgtgcctctagttcagaaaacaggggaaaagttcagttaaaggtattaagatacaaaacttctctttcttctgttttcttctgtaatctccctaccatcgttcctcccctccccacaccaacttgtcatggtgtttttatttgctatttaatattcttctgagtaaagaaaaaaataaattattagcattaattttacccttgatctttatattgtgcaatgacagttttaaatgcaaacataagagcacgctactcgtgaaatcactaaaattacacatttggtattttgtactttgatatggtttggatatttgtcccaactaaacatcatgttgaaatgtaatccccagtgttggaagtaagtcctggtgggaaatgtttggatcatggaggcagatcccacatgaataacttagcaccatccccttgagtgagttcacacgagatctgatgtctaaaagtatgtggcaccacctcctgtctctctgggtcccactctcaccaagtaacctgccctctcccgcttcaccttctgctatgagtaagagctccttgaggcattaccagaagctgagcagatgctggcactatgcttcctgtactgcctgcagaaacatgtgtcaattaaacctcttttctttataaattacccagtctcaggtacgtctttataaaaatgcaagaatggcctaaatagatacctcacacatgaatctgtatttcattcttaccatggcagagcagtcaaaacactgcatcaaaactaagtcaacagattttatttcatgtcttgacaggcacatactctaccaacattctaccttcagcctactgatgagttaggagggacttaaaagaaagagagcaaggggttgccttatctattcttttccttttatgccatcatttttaatacaattggctaacacaacaatgtaagataaaaaagtatgtgatagagttccttggtcattttcttctttctgtggaagaagttctggttcaagcagagcacgtggccttttggggctgtcagtgtccatacttattctgacacaaacttaacacaccttttgtactctttttgagtgtttctgaactcccatgcgtcatgggtccactggcattctgtgttcctgggtcactgcaaatgtaatattcaaatgaagtggcaaagaacaatgaaaatgcatgttgtacatatctcctgcaatcgtgggcactatctcttgttccataagactttatatacaaaacttaaggccaaaggtaaaattattaagaatttcaagacagtgaccacagagcattaagccaagtttgggggccttctgattaaggaaccttatgcaactgcaaaggttgcaggcccctgaacctggccctggtcctcagaaagaaattttcaaaggaaatagggccataattggtagagaaaaaggagggaatgagtgaatacagaggacatatatatccacagatagaattaaaatgaaacatttaaattgagcagtgaaattcacagggaagcaagagagtagagtatacaggtactgccccaagagaaaggaaagaagaaagggaagaggtggtaagttgcgcacttctctcaaaccactgaccaagccagtttctgtctgaagtaaattattattgtggttgacgagccatagatgagtaaaactctagtgtgtataagcagtaagaaaaactgtcctcaaggtgggcatgatgccagcaaacatgagtgatggggcataacttcagggatgaggctttttctgtgtttcatggcacaatgtttcacacttccagcaattctaatgtattactaagttctcattctgggaaatgattccttccttaatatcagttaatcagtagctgtgattttttttgtctgaatatccggccccacagcagaacagtactataaagataaattttaaaatgagtactttgcataggctgcccttttaatattccaattttgaagacatctttgacatttctaaaacataatttgagattaaagaagataggtttaattttcattgcctagaatatgtcggtgttgtatatttttaaattctctgcattatctatcattcaagactaatttagtcaagttgatagtcattttattttaatagcatttattattcaataagtatattgaattatcatagtgatacatttaaactacaaaatgaaaaatgaagtatacaacttagttttattcctacagcactgttagacactttgacagacatgttacactactgacttgttttttttcccagtggtgattagttgagtttatatcatagacaaaacacttcaatgttattcagatatgaaaatatgctatccacttttatgtagtagacattcacttcacctaattttcctgttttactaaagctaatgatctcatgacttttgatttctagaattaggccaagactgtgtcacagatgtatgcaagtcatctcatttcaatttgccttggctattgacacagaaccactccttggagcctaaacgatccagttttctcaccttgcctgttaaccataatcccacactcagctgaaatgatccaattttttatctttaatattttgggtttttttcttataggttgaatttaactgctttggaatatcagatagcattaaaatgatttaattattgcaccaagaatcattattattttacatccacattccaggaggatggaatctggtatatcctttaaaacacatttgtgcttgagtaaagttttcctgtaactaatttgtactgacttcctcttcttgatttactttatggtacatctatatcaggatatatagatcgcaatactttgctcactcattatgggcagtaattctgaaatcagatacatgcttcagattttaatgtaatggagcattttcttaatttaaaattcttctctagcaaggttttgctttttacttttccacagggaaaccatttctgatggcacaaaacttgagtcataatgtataagctttgcagttataaaataactgccatctttgttttatggtttactcacctgtaaaagctgtttattgtcaaataggagacactatgaatcaaatttcttctcttgctgcagtgcttcccccactaaaaaatctctattaatagggccccccaagatcaaaaaggtagtttgatcactgttagcaaggagttatgcggagataagaattgttacaaggagaattagaaaactggttttataagaacagacaggagagaatttgccactactgctctggctgctcaacctttattaaagtattaatatggcacttttgggcacttagcttggatgccttattctaggccagtgtgaattttatggctcagttagaaaactttgcaaagaggaaaaaagaagtttttaaataataatatgtgacattaatattcatgcttatacaatcctatgaaatctgggtttgatttcttttctttccttccttccttccttttttcttccaggtgccacccacagaatatttaccctgtactataaagaattaaaaaaaaaaaaaaaacgagttgggaagatgctttaattctctcccagatcacgaatgtcctcccttatcccaagtgaaggagttaagtagatgggtcatccagtatgtcaccatagtactctactagtctaatgggtgagggttaagtttactgatgaaacagacaacctgacagactctaatgctagtgaaataatggagtagcttgtcaagagtatattgagacatctctttatccagaaggccttaagacaaggttagttcaattttgctcaatattctgtttgacttaagggttacaggcatgcctctgcagatgtcagtctctattaatatcaacacttgtcccttctccttcattgcaaagccagcttagttacctgctaagaagatggcaccacgatggtaatgcaacgaatggatgtgggagaaatgagacagaca

SEQ ID NO: 812 - DNA, 3298 bp, Homo sapiens
aggacttctccagctccatttacagtctggctcctgggcctttggatcccagcagtgtccgagcaggagctcaaaggacagccccaccatgggggatcagccctagaagctgtcactacatctccaacggacgcaactattttccaggtaataaagctgcagtgaatgccacctgtcaactagttcctttcaaattctgacttggtttggtaagtctgtggcttgttgtcataccactggcagaaaaggccccttccctgtagtcagactgtagaggccacaggggctcttctgaaagaggaagcaagctcttttccaagcgttatttttatttgttgtacattttagcagattaagcacttagggttgggattttaaaaatatttcttctttgggccaaggagtgttttcacacagctaagttctttgtataaagctgctccaaatccctgactaattaattcctaaagaagcagcacgtggctcacaatgactggcaccccctctttataaacaggaacaccgggggagagagccaacaacagcacagtggccccggaccgtgacccttggactgaaggaacctacagatgtggttttttttggtgacattttacatgcaactccagatttcaaactcttttggagaagcaggcaatctggcaacagtcgttttggattctcagaaggcaataaagaacagctgccaccttccgaggggcacggtggatgccctgttctgccagaattgccaacacgtttatcgtcttagacttgcccaaggtgtcgcagttagagactgcctcccttattcacgctcctgcctggtgcccgtgggcttgaatttgctccccttggagtggggtgaggctctgcagacacttctcatacacctcccctgcagacagcaagctcctggaacacaagtcacatgcatttcatttcctgctctcttgctaccacccaacatgggctctcaatacatgttgaaagcaaggatcaatgaataaatgggcaactatcagctgtagacttgtatgtgccaggtatggtgctaggcatgctaggcaccaaaagggccacagaggtgttacatgccaggatatcagggagttcatgacatagtgagggaaagaaaaagcttatgcagtgtgtgtgtgaaactttaagcaaacatggtgcataacaataacaggaatgactttgcctgcccctgatgaaacttcagcagggctatgccctgtcttgccacctttaggaaacagcagtcttatagtcctttgcccctctgagttacaaccactgtctcctttcaggagaatgcccagtgttatatcataatcaaggctttgaacttgatgtggcattacatgttcttccatctccccagccacctgagaagggagatggggtagcttttctctctcactctctctcccccaacccctccttttcccaccggcaggtgaatgagcttcctgcccataggagaaagggtaaaatcacaaggtggtgcccttgtctccaaatctcaaggtcctctggatggcaggtgagtaaaggtgactcttgtgattatgggtgttttgggtgttcctcagagatcccccaaactggggtcttgtccaccattcccaggactctgccatgtggagccatgggaatgtgaagttcacctcacacttcctttcagctgaggtcaccacacagcccctaccagcccggctatattgggtgggatttcagatgcccccacaatggctgccttggagactttccactggtcctcaagaagcaacaacgctccccttgctctgcctttggtggagggcaattcctcctctctctctgcctggccccaggctgcttccactgtctcagaaactggtccccggattcccccagttacagagaaccctcatcaagctctcaagtggccactgaaacccaggctctctaggctctggagtatggaagtgacagctccatttaatttctcctttcctcttgtaggcttacagcatagcactctcccaagaaatcatccaaaaattacctcaaccattctatagaccccaagctgaccaggggagggaggaccaagaatcttgaaacgtaaatactacatttgatggtctccttcagacttattttgggatctgatatctctttaacaaaaattataaaaattgaggcaaagagagccccattttttatatactgttctaataaataacaggtacccttagaagaatgcagacaaacactcctatggaaatttaaaggagcataagacttcttgcagtatagggagagaaccaaggaagacttcctggaggaaatggccattgaactgggccttggacatgtggaggtgagggatgagagtattccagatgaagagtccagcatagggaaggcccacaggaaggaattgtgctgtattaatgctgtcttagaggcatttccattgccagacacagatactcaaattacttcagagagagagagagagagtattgaaagggtttctgtgaatacctccacaactgtggttctcaaagtgtaatccctgggccagcagcatcggcatcacctgggaacttgttagaaatgcagattcccaggctgggtgcagtggctcacgcctgtaaccctagcactttgggagtccgaggtgggtggatcacctgaggttgggagtttgagaccagcctgaccaacatggagaaaccctgtctctactaaaaatacaaaaagccaggtgtggtggcgcatgcctgtaatcccagctgcttgggaggctgaggcaggagaatcgcttgaacccgggaggcagaggttgcggtgagccgagattgcaccactgcactccagcctgggtaacaagagcgaaactccaccgaagaaagaagagagagagagagggagaaagaaagaaaggagaaagagagaaagaaagaaaaagaaagaaagaaaagaaaagaaaaaagaaaggaaaagaaaaggcaaattcaccagagcctttgaatcagaaaagaacccccaggggctggtggtagcagtccttgcacaggccctccaggtgattctcatccagggaagcctgcgagcccttgaggtggaatattctcaggaatccctgagatatgtgaagaactgatggcataggctatttctagggaggaaatggggctgctgggtgcacagatgaggggaggtgggagacctctgtaattgtgtaccatgtgcatatattacctattcagagaataataaaacaatgcgtttaatcccc

SEQ ID NO: 813 - DNA, 407 bp, Homo sapiens
gcacctgaaatggctggactgtagggaactgctccagtttccccatcaagaggaataggcagacacacagcaccgaatccaataaactgaaggccggcaactcctttggttacaactaactgattcactgaaactcctgttaaaactgactgtgggtgtggagccaacagcaaaggtgttgtggtggtcatgaaggtgataaactgcccaacaaaagcaaaccacctcctatatgcaaatcgccaccaccaagaactccggggccactctcaacagcatccagcacatgctccacaagaagtaccatcacccagatctatgcatggcagcttccacagagccagcaccagtctgcatagccagaagcctgtgaggatgaagaggaaggggacctgccccaccaatcc

SEQ ID NO: 814 - DNA, 145164 bp, Homo sapiens
atgactcagtctgtagactccaacagagggaacaggaacgaaaaaaggtaaaagatcatttagataatgaggcatataattcttgcatctttattatcatattattagcaattgcttttgatcagaaaattctctgaatgcagtgagttttacatattttaaaatggctgattcattgaagatgtgttgaggaggtgtggtcataccatcaatatttttataattgaaattgcagaactctcttttttccttttcaacatttccatcttttccctgaaagtggtatttgtctcctggaggagagagaaattaggacttttacatggaacaacaaataaccaccagattggagatataaatctttcctctgagcctgaagtattgagtatattctgtatatttcttctagaaagggaagcattcatgcctgtgtaggttatttaatgaatagccataggagtatttgaatcatttgctgggcagtgctttgcttatttgaattatatgttaactaaattcagatgtggaaaaatagcacaagaatttaagttcctgtgataatttggtggtattcacttgcaattttcataaagtgtttttgtaacttattcattgctctaaactaatgaatatacatcttacacttattaagaaacattgaaaagactaagtcactgaaaataatgcccttttgcttgtatgtgtgtgtatcgacaaatgttactgtctccatttatctggaatgtgttgtggttaatccacaataatagttcacatctgtcactgtataaaaatataatggaatgaaccttctcagagtttcagtttctgtaccctctgctcaaatctaaatgttgatgtaaattttgaaaattcaacaatgtgataattgaaaggacttgacatttaagacagatgggaatgctgcccaaggatagtgggaccccgcaggccagtcaggaagcagggccacagctgagctcctggatgaagtggcaaggcagagctgtggtcagggaagtttgtgtcaggatggggtgcttgcacagcgtgcagagagtgctggaaaggcaggcagggctggggacgtaagtggaccatgccaggctggacagcagatatatttttaattcctctactttgctaggtgccacaggggatgatcgattttgttaactttagggctgttcctacacttaaggagctaaaagtcttggagtcccaaagcactaacactataataatagaggataaagtaagaactatgatcattactaagaactttttgggatcttggcaaataaagtgtaatttattaggaagataatggcattcaagcctgaccttgagcagaaggaacttaaattataatttgaagagtttctcttgtcactttgaagtatttctacatgtggtgtattagccctgtgtatagtaggaagatgaccagattgggtaagaaatacctggcttcttttatgtctggtgttgcttccctgtactagctagctataagcccttggacaaatccttgagcttccagctcctcgtttgcaaactaatgatctattctacttatctgatagattgatgggtaaattgcattataaaaattatttgaaatgactttgaaaattgttatcttactatcaaaatgtagggcagcatttttttcctgccagctcactgtttgtttaagatgcgagcggtcaccgtgtgggtaagatccctgctgtagtctgttagagtctgtgaagcacttgagaatccttcccattgatgattttgcaaattgaaaagtgctgtctgtcccatggtttaaaaagcagtggccacaagaaataagaatattttaatatttaatatgaagtacatttctttttttttttttttttttttgagatggagtctcactccgtcacccaggctggagggcagtggtgcagtggctcactgcaatcgctgcctcccaggttcaagctattctcctgcctcagcttcccaagtagctgggattacacctataatcctagctaatttttgtatttttagtagagacagggatttgccatgttggccaggctggtctcgaactcctgacctcggatgatccacccgcctcggcctcccaaagtgctgggattacaggcgtgagccactgtgtctggcctgaaggacatttcttatagatattatgtctggggatattttcaaactaatttttatagaatatatattaaaaattagtattttaaaatatactgaaatgttgtttcaccagaagttggtaagtctgtgagacttaagtttgtaagcagacttagatttgttaccctaattttcttttctgaagataatttaataaattaaccaacttaaagtcataaacagatccacttctctgctcaaagtaaaaattctttacattcttattggagcaataaacttttagtcctgtctttatttcttttttctttttctttttctgttttactgccatatgtagcttcttctgaatctgtgacatggcagaggtttcaaaccccacacatacacatgtgcacatatacacatgtgcacatatacacatgtgcacgcacacacacgtatgtcataaaggtaaagtttaatttctcatctagccaatgtaaacaaagcaaaagacctgacctgtagctgcattttacaacctaatgttaattgttgcccttggttatactattgcatacattttgtatatttgaaaggttctcagaacaaagatgggagtagtaatgagataaaatagactattgccattactcattaattcttttttttttttgagatggagtctcactccgtcacccaggatggagtgcagtggcacgatctcagctcactgcaatctctgcctcccgggttcaagtgattctcctgcctcagcctcctaagtagctgggattacaggcgcacgccaccacacacggctaatttttgtgtttttagtagaaacggggtttcaccatgttggtcaggctggtcttgagttcattaattcttttatgtcaagacaatttgtggatttctgtaggaagtaaactgataaacgtcattcatacaaatcatatttcccacaattgatatctaaaagtacattcagaagaacaataaatgcacattccctagttatttgacatgtcttcaaaactaccactagtacaaagttgcattttgggtattagcaataggaatagtgaaatgaaaatattattgccttataaaattcactggctcttaaaaatatgccaccggtggagatgagatggttaataatatctgtcaataatttaaatttaggttcatgcacaggtggtgtcaacttttgaagccctattcaaccagactggaagtaattatgaagtaaatatgaatgcttttaattcaccttgtccacaaatatttattagatccagttatctgtctttatgattactttcatgagagcaacaagttcacatggcttgtacattgttttaaatagagtttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaagaaaaaaaaaaaagaaaaaaaaaatagagtttgaaaatagagtaacatataggtacatattgttctatataaaatcatttttggcagttgttatactgacactccttatcaaaggaaatagtttttcctatgtctctgtaaggcatatataaaattaatggcatgcatattactggcagatgctctaaaagaccttttacaccttagttgggtttttcagagttttcccgtagaccaggttttctcaacctcagcactgttggcactttggacctgataattccttattgtgggtgctgtcctgtgcattgcaggatgtttagcagcatccttgacctctgcctactagatgccagtagcacctccccacaacctgtgttataataaccaacaatctcctggggaagaggggtgtaaaatgccctcccctgccccccattgaaaatcactgacttagacgaatctctgcagaagtgtggttttattttgtaatccagacttcttttatagacctggttctagatgccgatcttcaggattggtttctatttcaaattatctctatttcaaattatctttaattggtggagagcagtgagtgtgtgcctgcatgcgtgccggtttattatttctttctctgttgtaacttaatgtatacattttactaagtagaaagagataacaccattatagttcattacttttggtatgtggttataggttattaataaattctcttcattttcttttaaagttggtattttctaagtttatcttgaagagtgcaattgatttcatttaagaagagcccactgaaacttgatttaaattttttttattgtggcaaaattcatataatataacatttaccttcataaccattttaaaatgtacatttcagtggcattatctatattcacattgttgttcaaccatcaccaccatccatccacggaactttttttttctaaatttatttattactatttttttgagatggagttttgcttttgtcacccagggtggagtgcagtggtgcgatctcggctcactgcaacctctgcctcccaggttcaagggattctcccacctcagcctaccgagtagctgggacaacaggtgcccgccatcatgcccagctaatttttgtattttcagtaaagacagggtttcgccatgttggccaggctggtctcgaactcctgacctcaggtgatccacccacctcagcttcccaaagtgctggaattacaggcgtgagccaccgcacccggcccacagaactcgttcatattgcaaaactgaaactctgtacccagtaaacggtaactcctcattcccctttctctccacccctggaaaccaccattctactttccagctctatgaatttgactgctctaggttcatcgtgtaagtagactcatataacatttgtctcttttctgactggcctgtttctttagtgtaatgtcatcgagattcgtccatgccgtagcatgtgtcagaattttcttcttttttaaggctgaataatattccattgtatgtgtagactgtattctgtttatctgttcatctgtctatggacgtttaggttctcccacctttggctattatgcataacattgctgtaaacatgggtgtacaaatagctgttcaggttcctacttttaatttttttggatatatgcccaacagtagaattgctgctttgtatggtaattctatgtaaaagccaaggttttcatcttctttaagcacaatgctcttataactttagccactttttttgttgtttttctaatttctttatttttaaagggcagtttccaagtcattttattcagaattttatgtttcttgaatcaataaatactatacaaaacaatgccagtgtaaaaatggctaccattttctctcctctgcttcccctacatgggtacaatctgctgggcagcctcactcagaagttttaggggctctccctccagatttgttccagcaaatgaagttgagtgacatagtcccttgaatgatttccagagaaactcagctggggtggggagagcctctggaatctggaggtaactagcttagggaaatgaattagtgttttgggggagaagaactggcccctagggcaagagcctaccccaaagaaaagggtgtctgacatgttcacagttaacttcttttgccttagaaagtggtatttgttcagagaaaaaagcgacaagatgtccatgccatacccccacacctgctgctcctctgcccctagctggggccaggtagcagaacagcctctcagacgaggtcagcagtattgaggggcatctccttaatggagatgttgtaggtctccatgtctcgaagggtcttcttgtcttctgtcaccatgactttgattactttggatggaaatctttaaaaagatattctatacttttatgttatttaaaaaatttattaaatgttacagaataattttgtaggaatcaggcgttactgagaatatcagattttatattatggtgaatatggtgatgtcattagggaatgagaaagagagacactgtgctatgtttctgtaccaactgccctcagatactgtgtgttttaagtttttgtatctgcctcctcttttgctataaggctgatgcctgttattcttcccttattatcagccttttcattttctaacttgtgactttttcatagggtgtcgtcttagaaaccagttaactaagctggttagaattgtatgtaatgtaggtcaagtaggctcggaatcagaagggcttttcatgtgcagtatttgtaaatggactttgtagcatcttcttcgtttgcatgacttaaaggtcttagcacattctcaactaaggttcagataaatgttatttccaggtagctgggttttatttgtatgtaaagactgcagtattgtcaatacatgaatgtataggcgcccccccccccttttttctttactgattgttgtaaagaatgtaagaatgggccgggcgccggtggctcatgcctgtaatcccagcactttgggaggcggaggtgggcggatcacctgaggtcaggagttcaagaccagcctggccagtgtggtgaaaccttgtctttactaaaaatacaaaaattgtccaggtgtggtggtggttgcctgtaatcccagctacttgagaggctgaggcatgagaattgcttgaacccgggaggcagaggttgcagtgagctaagattgtgccattgcactccagcctgggcaacaggagggaaactccatctcaaaaaaaaaaaaaaaagtaagaatgcctagcagttactattacaagtgggaaactaggaaacgatagcgtggagtgactgtaagaacttcttgataagggagcaaaactagatttttatttggatttggaagttgtcatcttttagcttattttcactcggcctacaaggccaataagcgatatgcctgatgtgaacaggctacttgaatatgtttgtctttattcataatattctgaaactacacaatagaaatactgatctttggcagtatcttattcactaatatattgcagcgtcttaaagactgttcttgtagccaaatggttaataatggttacatccaggattaaattgaatctaggaatggaggggaaagtctcttgctcttgagttgtctctattgtttgaattattacaataatctgttgctaaaagtaaattattaaaattaaagaacagaaactgaaatggcaaggggataaaagtggagtgatctgccttctagatgcttcgcttgtgatttgtataatatttaccttttattaagttcctcaggcactgagctaggaacttgacatgttctacctgtagtctttataaatattatttatggatgcggagtatttattttcctcattttaaagttaaagaaactttaagttgctcagcatcatgcaactagtgacaggtagaccagaatttgaagcgaggttggtatgcctgccaaagctccgtttttctttattgggctgtactggataaaatgcgttctggttgggaaggggaacacgggctgttgcctggtgatccacatcacaaggtcagctgagccaatgatgactttccatttacaaagaaatgaacaaattaaataacatctgagtatgcatgtttaacattctctgtatttattaaaacacaactaaagctaaatatcattttgatgaagtttatctgcattttttctttttctagtctgactgtggcttttctcttagactgtaacagtttttgcaaaagttccatcagaagatttaataaactcttcatgcatcttttggagagttctaatctataaggctgaaaagttaaaaagtaacgcattggattttgtttaacctgtttaaccaatttattggatgagtaaactcctccctaatcctctctccctaccactgtaatatctgttcagatcccaagtgtccgtaggacatattttagagcaaagtttgactgacattttagaagaatgttcgaccaagaattttcaattggaaagaagttgacgtgagtctgaagttgaacagtcttggtgctggggagcttcagatcagcctagcaaaaagactctcagaagaccgtttgtcttgtgaaagggatttttagctacctacgtaaaacttcctctggaaagatctgatttgcactctgtgatagaaaaggcgtaggtttgggtgtcagaaagacctaaatttgaatctacaaccaagctattaggtgagtgaccatggaggataaaagtgtccttaagccttaatttctttgtctgtaaaatgagaataatgtcgtcttaaaggagaggcttttagaagtagctatgcaaaacaactagcagaagtttgcatttcatgggtacttagagcacattggcttattcagcccttcatcctgtttgtcatcctgacccaaatgagagagaaaatagaacaggaagaacgtgatgaacagcctgaagatggtctctttttcctagtagctgtttttctggtggctgacatctgagttaaccagcatctgagtacgctgcgtgtccctttttcattcaagtgctggaattaacatgccaaaattaacagtgacttcgggtgctttgtaggtgtgtgtgtgtgtgtgtgtgtttgtttttgagacggagtctcgctctgttacccaggctggagttcagtggtgcagtctcggctcactgcaacctccgcctctcaggttcaagcaattcgaacttctaggtttttctagtttgcatatcccagtttttgtttgtttaatagaacctaatctgtatcaaaacttaactgctaatgacatacatgtagaatagttgaaatagggatataaagttattttttcatactctatttagatttttattgtacgtattcaaagttaatcattgaaattgtactttggaaggggggagaaaactaaattcataccttttttatttatacagcattttatctatattactgtggtgctagaaagaaaaagaaaaaacctttcatccttatatagcaatattaaggaacatctcaagaactgagacatttgacacagatgtttgagatgttgatttgctttaaggactagaactgacccagaggagatttctttttttttttttttttttgagatagagtatcactgtcacccaggctggagtgcaatggcgtgctcatctcactgcaacctctgtctcctgggttcaagcagttcttccgcctcagtttcccgagtagctgggatcacaggccctgggatcacaggtgcacgccaccacaccggctaatttttatatttttagtagagacggggttctgccatgttggccagactggacttgaactcctgacctcaggtgatctgcccgcctcagcttcccaaaatgctgggattacaggtgcgagccactctgcccatcccagaagagatttctcgagttctcttctagtgactaataatttatgattctttctaatgcacttaaaaatattttatgtaagacattttgatttcttacagcaatgattcttttagcatatatttttttaaaattggttttaaaatatctgcagtgaaatgggatttgaggagaaatagaaatatgaaaaaatacttggattgtgtttgattttatcatgtgaagatactagacgctttaaaaaaaatttttttttttttgagacggagtctcactctgtcacccaggctagagtgcagtggtgccatctcagctcactgcaacctctgccttctgggttcaggcgattcttccacctcagcctcccgagtagctggaactacagccatgtgccaccacgcccagctaatttttgtatttttagtagagacggagttttgccatgttggccaggctggtctcaaactccttacttgaggtgatccaccggcttcggcctcccagaatgctgggattacaggcattagccactgtgcccagcccacttttaaaatttaagaaatgagaatatccatgtttaattttaatgagagaagccttagatgtttctaatgtgtcatctttttttggatattataacacaactttttccttgtgacttaccagctgattgttacggtaaccaagtatcaagagataacgttatgaaataattgtctggaaaatgtcgtgtgactttctaattttcttttctcagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctataatcttgcccatagtatttacctcatttttgtgtctgttttgctgtgggtaagctttataagataaataatgtctatacatgtttcgactgtttaatgagtaatcaacaaaatctgccagagagtccctctggaaccatataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggtgaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaataagtatttgagatttttttcaataacactgaacttctgccaactttctctatccgctactgtaggcttgacaggctcatcaatcatttgctggtacctggactaaaaagcgcacttgctgacaccaaggcatgttggaattttcttaattcagtggatggaaaaagaaatacttccaaaaatatcccacacatgaaaagggaggggagccttaaatgaaaattccctttgtaccgtagacactttttggaatgcgattaattgccaacacatcattgaacgaatgctgtaaccaagaaattaagattgtgtgtgtgaagggaatatattcttaactgtggctacccaacttgtatagcaaagatttctgatagtttgtgttcatctcatgtgaataataaatactttaccctataagtttgtttattattccataaatacctaagggacttcctaaaccaaaatgaattgatgggctttttgagctttagacattaagatactcaattgtttcttgtaacatttttaactattcaacatagcttctataagagttggtttatttaccttccttttgatattcgacatagcttctataagagttggtttatttaccttccttttgatatttttagtggtgaacgcttttgcttctgtttcctagttgccaaatcactttttatatatattttatttatatgtaaaaaacaattttaataactacataatttgtaacatttctttccttttttttttttttttttgcgcgacagagtctcactgtgtcacccaggctggagtgcagtggcgcgatctcggctcactgcaaactttgcctcctgggttcaagcaattcttgttcctcagcctcctgagtagctgatattacaggcatgtacaaccatgcccagctaatttttatatttttagtagagaaggggtttcaccatgttggccaggctggtctcgaactcttgacctcaagtgatctgcccacttcagcctcccaaagtgctgggattacaggcatgagccactgtgcctagccagtttgtaacatttctgctgtgtttgtgctgttgagcagagatattgtgggttctatgtagctcataggattattgcaatgatcaaatgaaataatgttttataattttaaagcaccatagaaagatttgttaagttctatgtatttttaatttttaattatgatttctttctcgactaacatatgtatgaggcttttttttcccatttcctagcgtgtatatttttaaattctgtgtttattgattcctgttttaattgaatttgaattgtggacagaaaataggtacatgttaagactgatctgttaatatttgttgagatttgctttatgacctagattataacctgtttttgtaaatgtttcatgattgcttgaaaagtatgcttgttttttagttgttggatgtccattagaccaaagttgttaattttgtagttcaaattttttccattttactattcttttgtcttctacttgatctctcagactctgagatgtgttgaaattttctattctagtgaacttaccaatttctccctgtaattctgtcaattttagttttatatatttttatatattttgaagtcttgttataaataaataattataaatatatacataaatataaaaatacataaactatatattatatttatatggattatgccagctagctggatttataggatatatcttttttcatccttctgttaaaccttgctgttatgttttagatatgccctttaaaaactgtgtgactggggccggggacggtggctcacgcctgtaatcccagcactttgggagggcgaggcgggcagatcacgaggtcaggagattgagaccatcctggccaacatggtgaaatcccatctctactaaaaatacaaaaattagctgggcgtggtggtgtgcacctgtagtcccagctactcaggaggctgaggcaggagaattgcttgagcccaggaggcagaggttgcagtgagccgagattgcgccactgcactccagccttggttacagagcgagactctgtcttaaaaaaaaaaaaaactgtgtggctggatgtttttctttctttctgatcatttgtcaactaaggagttcaatccatttacatttgtcaaagttactgatatattaagatttatttgtatcatcttattttgtgctttttgtcccaccttttctgtttcttgacttctttcagcttgagtttgttttgtttcatttttccatctacttttcttctgctgctttcaaagttaaacatttcccagtttccaaatcagttttgatatgtattttatttatatgtaaaaattaacttttaatgaagtgcttagtaggaaatttaacttgcgtagttaacagaatctaaaattaacatctttactctcttcctattctttagagatttttgtacaaagtctgatttatctcttcaacttacaaattgttgtctagaattctagttctatctcgattttactacaaaagtagttattttgtatagtcagtgtttatgtagatttacctagaagtttgctattttattatccttgaaagttagctaggtatacgattataggttgacagctgttttctcaaataatattctactgtcttcttgcttccattgctgcttctgaaatgacagttgtcagtctgatcagtatttgtagctaatctgccttctttctcaggtcatatttaagatctttatctttggtgttctacagtcaaatgtggccatgctacagtatgtttagctgtatatttcttttcattgtcctgttgggattgattgagattcctgaatctgagaattggtacttttcataaattctgaaaaattcccagctactgtctctttgaatattgtatctccctcattctctctattctctcctttaggaaataaaattaagacttctgttttatgatctcactgtcctctccatatctcttaatccctgttttatatttcccatctctctgtctctaggtgttgaattctggataatttctttaaatctatttcattaatactgtcttcactctatctctaacctattttacccatctgttgttaattatagttattattttttttattttcaaaagagttgtttggttctttcttaaactttcctgggttgtctgggatggttccattattccttctttttcttttctttaaacatattaaaagtacttattttacattctgtacgtggtaatttcagtattttttgtggatccagatttatagtttgttgcttgtttttgctgaaacaagtttatggtgacgagtttcctaatgtgatcagtcattttttattttaagtttgcattcctctgaactttcttttgggagatttttttttttaatttcaaatatagtcctacagagaagattttttttccctgcagcaccaatttgtttattgtgacactacaaaccacagaccacttcaaaatcagttttcatcttggattccctgtctctcccttttctactccttaagcttttgcacccacacacacatgtgtgtatgtatacgcactcacaaaatgtggatttcagccctaaacacctgtgactgttggcttcgttgaggcattcccagaggagacgtttttcttcctttatatctcttcttgaataatgaagaagggtaaatttaggtgttttcctagttcactcctgaggacagtgtcctctgaggctttacaagtcctcctgctcatccagctcagtccctgttatggactgaattttgtctcccctgaattcatcaagtaaagctgtaaccacattgtgacggtatttggagacagggcctttaaagaggtaattaaggttaaatgaggtcatagggcggagaagagagaccccagagctcttcctgcacatagaggaaaagtcctgagatcacagcaggaaggcagccatctgcaagccaggaagaggcgcctcataggaaccacatttttcaggaccttggccttagacttcttgccagcacatctttaagaaaattaatttttatttaagccaccaagcttgtggtattttgttatggcaggtggagaagactgagaaagtccctcactttgattcctgtccctcacgcaggtatggctcctaacaactggggccttcctaggctgcagggatggggatgcctttagggcagttatccagagctgaattaccctatagaatgtcccagtctcctgagctgccttcagttgttttcactaatttgccataaattcagtcaagaataataaataaagtttaaatttttttctagcatttctggtgttcagtggccagacagatttctctgtacagaaatggcatgttatacaagtacatggtgattttatcatattctccaaaaaagaacacgcccatattctagtgtaaacgatacctttttactttttcaatattacactaaatcttttatattagattatttcctgttatccatgaactaatatgattgtctctattgcttctattggattgatcttttactgtttatgagctaatgaaggcaaataagagttcagtagtgttctaaacctgcgtaactcttacctgaatacctgattttggaatttttaatctttaggacattattgtgctttgtgaaaatgtctcaggctactattatgggcatgaaaatagagggggcttgatctgtgctattaaacccaaagtgccatgaaaatctggaggagtcacagatgcctccaagatacatagtgaattctcttctttgcttttataatacataaactttgtatctgaacatttccatgtactgtttgaacagtttcctactgtgcatgggttttctggttgccattgcaaatgaaaaggtagcgggttttattgctttggaatttagcataatgtctgcctttcctgaaattgtacccgggaggctttttatttttatttatttatttatttattttttgccatttggggctgtaagtctctcaggatgaaaaataccagaaaaatattttaaacattaattcagtcaaaatatttgaagctcccattacagacgatatattttctagtagtttgttcttagactttcagaaaggttttgtaattatttcataattttcaaccccaataaaatgttaatattttattgacttggtgcaaatcaaggtcatagaatgaatggagaatggaaatcagtcatagcgtatcacctactgcctgctcttcctcattctgctctttcttttttctttttttttttttgagacggagtttcgctcttgttgcccaggctggagtgcaatggcgcaaccttggctcactgcaacctgcgcctcctggattcaagcgattctcctgcctcagcctcccaggtagctgggattacaagtgcctgcctccacacccagctaatttttgtatttttaggagagatgaggttttaccatgttaaagttattatacatttttattttcagaagagtcgtttggttctttcttaaacgccaggctggtctcaaacacctgacctcaggtgatccacccacctcggcctcccaaagtgctgggattataggcataaaccaccgtgcccagccctctgttcatttttgaatcttaactgctacaaataatgctttcttgtgactggtctggcaatgatagcaaaacagcatttcctctggtattttcctatttatgttccataagcaagagaaaacaaacttggattttcagatgtgatacacttcaaagagcagtaagttagtaagtacgctaacatttgatcctcacaaaaactcaagcttcaaattatctctgaagaaatagtccaaattaatttaaggtaagtaaatacagtactcatatttgtataacataacttagagcctactttttaagtgccttatatgtagtttaatcttatttcatcattataaccaagaaatacccattatattcttttagaggaagagcaaaacagcacagaaatacaaggaatatagtgttttgcccacccaatgttgagctagcaacaacacatcagatagactaaataatactttcatggtttttaaaaaaatccataagtgataccatgaaaatccatagtacagatggatccaaaaatttttctttatcattacatcgctttctaaaatgatagtctgatgtactacaaacattaataagtcaatatgtgaaattctgctctaaaatattctgaatcattaaaggtatttactattatttcatcattcgctgtgtggtcaggctttgccataggttaaaatataacatgagatgatagatatgttaattagcctgattggatcattccacaatgtatgcatatatcaacccatcacattgtacctaataaatatatacaattatttatcaatttaaaaaaggagccaagcacagtggctcacacctgtaatcccagcactttgggaggctggggcaggaggatcacttgaggccaggaattcaagaccagcctgggcaacatggtgagactttgtctctaaaaaaaaaataggaaaaaagaaaaagaatataacatgaatgtaggtaagattaagatagaaagtgccaccctgggaagaggccagtaaagtgccaccctgggaagaggccagtgcatgattcaaggacatttagaacagacaacaccaagctcaagtggtgcagcatttactgatagcaagagaggagagagtgtgtacacaagatccagccgtttgcgtcagtgccctgtggccagcaggtccactctgcagaccatgtggtcagtactgtatttttttaaaacttgaaatgaatgaggatatgtgcattccatcattccttggagcaattgttttccccttttaactttaaaaaagaaaagtttggttgagacctggcaggcattgaaagttagcctccattgcaagtattatcaccatttatgagtgtgaggttttaccataatagaagtcagtgtacgaggttatctgtgttgtgcttaaaattttctctacatagacctgatttttgacttttgtgaaattgtttatattgctaacatttatcattcagagaaaatattctgtaaatgttgatttaatgtaatagtttcccttaaaatagaatttatagagaatttgaaaagaaaaccacaagttaattcactttttaaaaaacttcatgtcatctgaatacttaagctgctttgtttggaaagtgtctttttaaagaaaatagttaataaaattacagtaagataattgtcacaaaataaaaatcttaggtggccagttgtgtattacagagatttggttttaacaattatacaagttatttaagtgggaaacattaatattaaattttattaagaaaaattttgacaccaaaaaatctgtccttcacttagaatataaaatgtatagctgaacaccagcaggtgtcactgtgataacatgttttccccccctgaacagttttatgtggatgggtgcataccatctatggacaaagatatttaggagataataaatgtaagttatatagctgaataaaaataccaaaatgtaggaaaagcctatgagttccatgatggttaggaatgctgtatttttttttttttaggattgctgtatttttaggagaattgtatttttttctcgctttcttcatgtcataaacatacagtcttccattatgtaagtgatgtgctgttttattagcaataaaagtagagtaaaaatccctttatatttgggctatgttgaagtatagaatggtacaaaaatcattaagttacaccttgtataaccaaagccaaattaagaaacagaacattcctaataatgtttttatatgggttttgaaaaacttggccaggcgctgtggctcacgcgtgtagtcccagcggtttgggaggccgaggcaggtggatcacttgaggtcaggagttccaacctggccaatgtggcgaaaccctgtctctactaaaaataccaaaaaagagttagttgggcatggtggcgcgcacctgtagtcccaactactcaagaggctgaggcaggagaatcgcttgaacccaggaggtgggaggttgcagtgaaccgagatcgtgccattacactccaggctgggtgacagagcgagactccacctccaaaaaaaaaaaaaaaaaaggaagaaaagaaaagaaaaaaactcttggttcattcctccaaattaaggcagttataatttttaagttaatgtttaaaggcacaaaaatatagcaattggtcgaaaatagaaatttaagagctagttgtcagtatttttttccccacctagcatggaagccagagtaggatttaataaacatatgagcattgttctgtgtcaggattatattccaaaaggcagatagtcagaaatagcactctatcttaaaggaatttataattgagttgtgcacatgtaacaataaagtagaaaaccaagaccgtaacgttacataataccacatcaaagactatgatatgctaagcaggcagcgtatgactaaaataagtgagtcccaagtaggaactgtctttgtgagttgtggtcagggaatcatttgtagtaaagataaaacttgaatgcaataggatttgcgttatgaaaaggatggcagaatctttccagctcagtctagttcagtaagcacctgtgttccaggaactagggctaagaagctgactaaagcttggtttctgcccttgtttatcaaaaacacaggtggacatacttttgggaaatttagacaataatccatagacttctttgatgttgaagcagtagtggatcagtctggaaattggaaagtgcactggaaattggaaatgagagaagacttgcattttggtcatgcttccatcactaaatttgtacagagactttaaacacatcacatagatggttttcacatcatttccaactttaataatttgtgcttatcctgtaggtaatgggactcttactgtaagtggcacgatgaaagtgttacaggaaggttactctgtggactcagatgtatgactgataggttgaggaaattattagcctgcattaggattttttttttagaaagtagctgaaaatagcaatttctagtctagacagggcagggatagagatgaagatcttggcttggaagttaagattatgggaatttttaacatccatatatagatatgtctatggactgtttgtgttacttatgacaattactggcatggcttcagatttagataatctctatttctcttttatgtaaaattgtaattcttagcccaaagtgactgaatttttgcttttgagaacaccattactataagtaggaaatcaagaaagttattaaatggcctttgtcttttaggtaagtattttgctttttataatcagtgcgaaaatacatcaggttttattaagcagctacctctatttaaggatttcccatttcctttcccagaagactgaattattcaaggaaaagaatgttttatgctgttttatatcccatgcataggacatgtgctgaccacatattaaaaaggggagttcgtgggggctatgaggatgcaaaggcataagaatgatatcatggattttgggggctcgggaggaaggatgtaaaggggtgagagatagaagactacacattgggtgcagtgtacactgctcaggtgatgggtgcaccaaaatctcagaaaccaccactaaagaacttctccagttccccaacaactattgaaataaagagaaaagaaaagggaagttcttgctgtattacaaggctgaccatgagttagtttggttaaggaagatttgagttatccttgctatttacattgcatttgtgttttacaataattgaatatgaagaaataaagactagatgaatgtgtttcattgtttttaatcaaaactgtcaggcttgtcaatagtctgtcatcacctggtttataataattgctatttctctctggaaaggcttaagcttttaaagtaagctatatactgcaaagtagaaacttgaaattttacctttttggaaaaaagttacccccgttaacagtattttcccccaaaacctcatttagatcatttgtttgggacttggaatgcatctcccaatagaaacaatgatgtacatggtgattaggcttttagctggcccacaaacacggtatcatgcctcaaaataccatagtaccagtagtgatacgtaatgctctaagctaataatgagccactatatttgatgatttttttttttaaagaacggtattcagagccttgacttgtgggacctgggatgtaccccatttggctgcagctctgaaagtcatattgccaggtgggaaagcaaagcagaatctcttagctcccggtccctgaaggaggtatctgctgtttaggaccattccctctgcggctgcagccccaacctcccactggcctgcttccctttctgtttacttgctgccttgcctcaaaacagtttgttcttcaactcactttcagaaaaagcctcacagtttcccttttatctggtgttgaagagattctgaggtttttactaaggtttttgacaataaggagaagcagatgagaagcacccctttccatcaccactagacacacacacagctttaagagtgcttaggtgacactgatggttccctaaacgcatcactggataaaagcatctccttgtgcagattaaacgagctcctgtaacattttgttcttggtttccttagcgcgggacgttctgtggggtaaatcggctctgaggttgctgcctacgggattacactagggctgaacaaatgactagtgaaagtgcagagcagtccccaagggtttattttcatcccttccttcttgccccgactggcccctggctatcacagacctaggtatcttatgaagtgaattcggctcccacttggagatcccaggtcccagtggtatctgcaatcatgagagcataacaaaatccctcttctcttctgtatctggggtgtgtgtgtgtatgtgtgtgtgtcttatatggatgttgggtttactgtgttaaaatcttatgtaggccacagaataagactaattaaggccacagaataagactatacttaagtcctgaaatgaatagaccttactaatgttaatcacctgagaaagtggtgcgttcttaaagaggactaggtgggtgtgagaacctacctctctcaccctctctctccccctaccccttttctttcttctctctctccctccacagtgggcaggggttacagataacctctgcctcacagaagtggactacaggtcacgcagtcatctttgtaggagcacctgaaccagagatgagtgagttatgttttgtaaaccagattctctatattgtattgtgtggccatttccatgttgtaacccccaaattctccatgaaacttcgtttaaatgttccaacatgatctcagctatgtagaggaagttaagcaaggcactgtccctcaacaccaaaagtattggatagtggtggtggcagggagaaatctcaaagaaggtagatgttgtcccgtgaggtctagttactactctccatgtggacgtttccccctccattgcccacctaggagcatctagactaaattttcatgaagaaaaaagcaagttccctctgcaagttcctaacacttacagtgttagggatagcaaaattgcaggctatagcaactgaaaagtaacctggaacactcattgctgaggctgactgactggctgaaccaagtgtagacaacgatgtgtaacctatcctgcttcttgcaaaacaaaacatggattaaatgtgtgcagaacagaaatgcatgttttgaacattaattatcaaactaattttatttttttcagaagatgaagaaaatttagattatgcaaaatcattaattcagcatattataaatgcgttataaactgccacctaaccccaagaagccttccctatgctccccattttccctttagctactgctccatttatctgctcacgtttatagcaaaatgcctggaaggagctgccagtatttgctgctgtgtccacttaccgcattctgtattctcccttgaaccctttccagcttggctttcagtaccactcctcccctgaaaccaccagccacctccattgggccaaatccaatggtcctgagttttcaccttatttttcaacggcagtaggtacaatcgattactctctccttctagaaacactttcttcacttggctttttgatgaccagctattcctggtttgctttctgcctctctgggtgttcctcctctttccaacctctaattattgatatgcctcaaggccagacctccagctatctcttccctgcagatacttccctgcagccagtcttaggatgattaactatcaactccccaatttgtatctccagccctgtttttttcctcacatatttgaccacctgattaacatctgcactgagatgcctaataggcatctcaaacctcaatatctgtgcctcagtttccccacctgtaaaatacgggtggtaaaaagaccaatacttaacctcgtaagtttgttttgaggattaaatgagttaatatatgtaaaatagaacctcacatgtgctatatttaatgtttcctttataacaatgattatcattatcatcaattctagatgtccatttgggaatttgctctgtgtaatccatccattaaaaggtcaacaggtcatgatcataagaaatttaagcttcttagaatgaagtccataacagttccccttggaccacttagttggattagacttttttctgtggtcttaaaatacatattaaaccaaagaaatactagtttagtaaatccttagatggcacacccatacagctggtaccacaaatgatgtcacatttcaggaagatcagctaatatattccatggaatcaaaggtatttttcaggatgaaatgtgttttacttctagttcccatgctggtctttgactcagacccaaatcagagaaaaatttagcctttcaaataggtctctgctgaacccattttgatagcacttaatttgtcgaagttatttattaccacatttagtaattttggtaaaaatttctcacttcttaaaacaaattttgcttacaccctttcaaaagaatgttattggtatgtgggtaggttgtctggggccagcctcttatctagagaccagattttaaaagtctgagttgagtgaagtgacttagactgcatgccttttgttttgttttgttttcatatgcatgtatgggtcttgctaaaacacattgctcccctcatctaggaacaatgccgcacacatcatttcctgaaataatggagttggaaggcaattatctactcacaaaacaggctgaaacaacagttcctgatattcttctcaaatactttaacttcccaaggaatccggaaaaaataattccatgagacagtgttgtgaatgaaggtatgacattccagtttccttcactgcagtccagggaccagaggtaataaattaccaagcactcggcgctattgacaggggctctggccatggtgagctgtttgtctttgtactgccttacagcctcttgggagatgatggccctgggttcctttttgtacacttttgggaagcatcccagagattacttgcagtttattgaactattcttattttacaacattgttttccttttactcctaaagagaatttgggacttctgtttcagactttccagataagaaatgcaaacttttagaaagaatgaatattggccaggtgcggtggctcacgcctataatcccagcactttgggaggccgaggcaggcagatcacgaggtcaggagattgagaccatcctggctaacatggtgaaaccccgtctctactaaaaatacaaaaaattagccaggcgtggtggtacatgcctgtagccccagttacttgggaggctgaggcaggagaattgcttgaacctgggaggcggaggttgcagtgagcccagatcgtgccattgcactccagcctggcaacagagcaagactccgtctcaaaaaaaaaaaagaagaatgaatatctatttcagcaaaacatgttttggggtagtgtgagagttttttgggccccttgaatgtggattggtagatactcctatgaagaggcatctttataatccttagcaatctaaacatcaccaaggtagcctgatggtacccatggcaaagaataacaattaggaagattgctaatgtttagacattgctttctggaattctcatttgaaaggaagtcggtactgtatttaatcagggatgagaaaaaaattgagaatagtcatctggctgttgagcctgtacaaggccaactagaaagctgtttggaaactaggttgtgttttacatttcatctgaatgtttgcatttgcctctgtgttgacatatcctcccccatgagtgaaaggtgtaataaattggatataagagtcacagggaggaacactgagcagattgaagagggacttgagacactgcagcattacttagggggtttcatcggctgcctctgggcatttttcccggaaagatagaccattctctgtctggctttctgggtcttcgtaaatcctcttccctgtgtggaagcttaggtatcgatgtcgtgtctcttcattccgcctcaaaatcaacttgtttgacatttgctctagtgaaatgtataacttttacaagtatagtgtgaaactggcatttaaaactacttatttcaggcagccggatatggtggctctagcctcaggaggccaaggcaggattacttgagcccaagagtttgagaccagcctgagcaacatagtgagaccccatctccacaaaacaattaaaaaataaaaatgcttatttctgattgtatcagaaatttaccaattcctcataaattatggaaatcgctaaattgaggttttctttctttaaggcatctttccatttggcctggccactgcctggccgaacgatgtggttggccacacatccatgttagaaaatccattacctttctcattgttccttgattcccactggctcttttcaagccaggagactcaaattgagaagctataggtggaatgagtcaatttgttttattaaaaaggtaatgggtcaaattacctcttgaagaagagtcagtgacaaaagctaaaagcagaagtagggtttgtgccaccatgccccaagggacagcgagtggggctgtgcagcctgcggtgtggggaaagcagtcctgggtggaggagggccaggcataggccttggcacatcgttcattccgtggaatattttggagccagatttcagtggtctaggcctagttaagaacttgagaatgaacagtgtctggagtcttaaatcagttgtcttcattgtttggctttagtttatagcagtggaatcatttttggctttcttatcttggctcactcccaggattggcttaacacactagttacccaattctataaattccagttaccttactagtcttcatagctacctcagagggaaatcgccagccatgaatactcaactcgatgaagctgtctgtgacgcacttaagccctaatgggctgctgtttatatttaaggataagtgttattaatgttttctggaatggtcattattttcttggtaatattgaaatttggcaagatatagtatagcttggtaagcaaataccaattgtctgttagtcttcaatgactaggcatagcacagacttacacaggtaggaaagttaaattcaagtctgtgaatttttaattcattgttacttatactggacaagtgatagattatgaatttatatttgccatatacttttttataagcattgttaaatatagaatgaaatttttctaaagcaacatctgtcttagactgcatgcagggactgtatcactaggccagtcaacatgtatccagtacttggctaattacagggagtgtaaatgaggtatataatatgtgattactgccctgtaaaaaaacttttgttgaggaagcaaaggctaagttaaatgaaatagttgggaaacagtttaaaactacattttagaacgcttggattttacaggaggaagaaatcactgtaggctgaaataggtcattgcgtcttccaaagaggcttcatggaagaggcaggatgtaaaagatgaatggaatgtaaatgggcagaaaagagacaagacagaaacatttgtggagcctcttttgaatgccagactctttgatagcaactttatacacataatctcattaatcctgctgagtagacatttatatccctgtttatactgagaatattaaagactggagaggttaagcagtttgctcaagtttatacaactagtgagatgctcctaagtcatggttaagacgattggctctgaattccaggcagttttagatttgaatctcagctcctcactgactggctgcccttcgtctccttgtgcttccattgtttcatctgtaaaccgggaacttaataatagtgacctcacaggtatagagtgatgaataaattacttaatgagacaaagaacttcacacagtttttcatatgctgtaaccactcagtatgtgtttaaatatatatagaaagagagacagataatctgactgagagtcatagcgacatcttgtctgactccaaagtctacattctttgtagtatattaccctgtagagggagcaggtagaaaattccagatgggagaataagaataagcattttgtctgctaaagaaaggtgacgtcccctgcatgcctgaagtagggttgggttgatgaagtcatgaaaaattaattggctaaagcagatggaagctaattatgtaggaccttgaagggagaacttcagaccagatgccacagagaccaggaaagccagctagttcctagacggagaatagcatgatgaaagcattgctctaggcggcaaagaggggaagggtgggggtgctggaagtttacttgggaaactgccaagtaaagtatgaggtaatgtagtcttgtgctgcggggagcaaaaccagaacgtccaaagaaaggacgcacatggaggatgctggtgctggccgtgccaccacacacggctgctggactctggatgctgccgtttctactagcagcccctgccctggcactaatgccacaatgtatttctctgctgtagacatgctaaagctgaaagccaatgttaactaaaaacgattctgccttctgtaaaataaaaagtaggtgatgttttattctaaataaatcacaaaataaaatgtatgagaaaaatatagtgtaccacagagtcacttaaggtgtaagttttcagctcagcaagcctcatatactgttttaatgcatgtgtacaatttactaaagatttagcaaattcattacacttctcaaaaggcttgacatttctgattgtatatctcattttcctcctattttttttacatctttacccaatgacatgtttccagcttgagcgcaataatgcccaatcgtttttcttagcaatgtagactagcactctacctgctagggcatgtaattatctacagaggttaatatctgaacataaaaagtggcatctattagctgaatggatcctgagcaaatcctttgtttattaagctgaaagctatcatctggaggtcttgctgacttagaagggcctgagtctgacaaattgttaattaatattgcatgttcagccagtagctacagtattcagccagtagcatacgagaattgcaatgatataattatatcactaattacgaaagagtatatcagaatgattaagaatatggaattaggccttgtgtggtggctcatgcctgtaatcccagcacttcaggaggccaaggcggatggatcatctgaggtcaggagttcgcgagcagcctggccaacatggcaaaaccccttctctactaaaaatacaaaaattagccaggtgcagtggcgggtgcctgtagtctcagctactagggaggctgaggcaggagaattgcttgaacccaggagtcggagattacagtgaaccgagattgtaccagtgcactccagcctgggcaacagagagagatcctgtctcaaaaaacaaaaaacaaaaaaaaaatggaattgcaaccagacagtcatggggtccattcctgaccttattcctcactaactgtatgaacttggcatattctttatcctctctgagcctcagtttccttacttggctgccaaaaaggctggacgggataccatttgggaagcatttagaacagcatctggcactttaaaaatgcttgataaatgttagtacttaatcattatattaagcatgatagtttacaaaaaaacttgctcacatattgaatttctttgaacctgtcagtcctgtgaaatagacaggaaaggtgttattcttatctgatattaagaactgaagttcatagaaggattcagtaactgaagttaattagcggcaaatccagaactgaaaattaggggctgtctcctctagatttctaaactacacacataaaatacaagacagaggcaagaatccctggcctttatgaatttaagcaaaggttcctgatagcagtagttttcaaatgccagtccacggacagtgatcctacaggacagagttttcccgtgtgtgtcatttggattctcagactggatggtgaaatgagaacatgagggttagagcagtgaacttgagatagagttaaatttatccaccttaaggaactgccttttactatcatgttatagcttttctactttttggtattgaaattgccttatgaaatgatgacagatcatggtagctattttttggttaatgtctctatctgaagtaagagaactttgacaaagaccactttgggtcgcaggttttgttttagaaatgtttctagtccaaaatcggagaatcactgccctagagtcatttcattattttacatattagtagttaagtataccgtaatacttagtttatctacattaagccataaaatcagggatttggatttttatgcagttttttttttccttcttttttgtttttagagacaaggtcttgctctgttgcctgggctagagtgcggtggtgtgatcatagctcattgcagccttgaattcctggccttaagcgatcctcctgctgcagccttccaagtagctgggactgcaggcacatgccatgacacccagctaatttatttttgtgtagagacaggggtcttgctgtgttgcccagactgctcttgaactcctggcctcaagcaatcctcccacctcggcttcccaaagtgctgcgatgacaagcgtgagccactgcatccagccctccaattttaattttctcttgctctctttttaattacatagatcactgatgcttatcttttttaagtagcaatcgcagaccgttttaggaatcttttggtaactccatcccccaaaacacatacacaaacagttataggtgcaaattggctagttcacgaatttggtggtacagaagcccagggacgtgtaggtggcgctggttcgttagtttatgtaacccgttttctttgttttttttcatcttgcttgttttccctattagatgttagggcttatacaggtgagagtggtgttacaggagactgggcaaaaggcttaatgtcaggacctgatggttacgtagaggtcactgcatcttgtgtggtttttcaggcagaacagtcatatgatggaagattgtaaaatattattagttatttgttatagttaatatatatgttagcaaagaagtgaggaagaggactcctacatactcctacatactctcaaaggagagtataaattgatgtaacctctttggagggcgatctgaaaatatctatcaacatttaaaatgcacatactggctggtatgtgcttaacaaggtatggcacatacttgttaagatgtgtacagaggtctttgttgtagcttttcatatgagaaaaatactagaaacaacataaatatccattaatatggaactggttaatcaattgtgtggtatatttgaatgggaatactatgcagccatgaaaaaggatgggttagcactaaacatgataatatggaatgatctccaagatgttattatgtgaaaaagaaagatacattttaaaaggagaaaatgcacacatgcttgcatttggatatttctagagtgtataccagcagctggtactgatgactgcctcagggtagggtctgaggaatcaagggtctgcaggtctgcaatgggagggatacttacttttcctttttctatttattgtagtgcctaaatctttttttttttttcgagatggagtctcgctctatcgcccaggctggagtgcagtggtgcgatctcggctcactgcaaactccatctcccaggttcacgccattcaccggcttcagcctcccgagtagctgggactacaggcacccgccaccgcgcccagctaattttttgtatttttagtagagatggggtttcactgtgttagccaggatggtctcgatctgacctcgtgatctgctagcctcagcctcccaaagtgctgggattacaggcgtgagccactgcacccagcctgtagtgcctaaatcttttaatcaggtccttgtattacttattcaattaaaaaaaagagctagttaaaaggagttaattttaaaaattactgtgcaatatgagcaaaagaggttagtggatatttacatttcctaactgcaaggagataaggcaaaatgaacagacttcttttttccttttctttttttgcctcattctctaatgtgagatcaagggggcacctgatggagttaagaactgggaaatgaataaatcaaaggaaatagctttttgcacagcatgtagctagtctaaggaatttaccgccagaggcagtcatagagtcaaatactgtggctggatttttttttggaagtctggtcactatgaccagtcataacatttgtagttatgcaagaaaagataaggataatcaaatctgatggtgcaggatgtaagctgatcattgcaaaggaaggaatttctccccagcctcccttcttttttggcttctcccagtgcctcagaataacattacacaattagctaggtctgctttgaagagttgacagtacttcctctgaatcattaggtattatccacagccaagggaaggattccaggcctgccagagcagcaaagctcagaactctttttttgcacccagagcgatggccccttcagttccaagttcagcgttttggcaggacagccctcctgctgctctgctcctcctgccattcccggtgaagaacatgttcaaagggaaataatgggtttcagctcttctcccgttgagctggcactctcgtataaacaacaaacccaagattattgagggactgaatagatgttcaggaaataattcatgcttttttctctttctctttccttctttggctctgactagtaatgaatccctccaccagggggtagacagaagacataaaagaaaccagcactgaccaatctcatttaggccccagtaacaggtttcatattgttctaggtctcattcatccaaataacccaagaaatactgcacccatttactgtcttatattttaagatcaagagtaggatgtatcaaattgacttcgatttgagcaagtaagtagagtgtagaatagtatagtatgtcaacatgagccagataaattgcattaactaaaatctactgcagatgaggccattctgtttctccatgtgactagttcaaaggcaaaactttagtcacataaatgagaggaccttcttttttaaaagtttctcccccatgttatggaagctggcaacaggcaggcagggtatgtctgtgtgcatgtatatgcatgcagggtgaatgcccttcccttttctgtcagccaacagctggatgactccaagacaacacagtcagtgatcccaggtccatctggtggccacacacaggggcacggcctcttgcttgtcccacagacaagattcaaaacagtcacccaaacacccaaagttccaggagaaaatttgtatcatttttgtttggctaaattatgtctttaaaagttccaacagaatttttaaaaatatctcttattacatttaattataattttaaaataatttctttgctactcaaactcatcgacaccatgtacaaccttacctttgaagctttttaggagacccatttcacttccagcattgtccagtagaactttctgcagtgggggaagtgttctttatctgtgttgtccaatatggtagccactagccgtatgtaactattgagtactcggaatgtggctaatgtgtctaaggaactgaatgtttaatgtgacttaattttcattgacttataagcaacaatgccacctgaactttagcatttcttatatcctcagcccatttttactttagcatcctagcaaacattcagaagtgacatggtcattttcttccttctgggatggagcgttggctctctttattgtcattaagatctttgaaagcaataagaagatataattagccgggcatggtggctcacgcctgtaatctcagcactttgggaggccaaggagggtggatcacctgaggtcaggagttcaagaccagcctggccaacatggtgaaaccccatctctactaaaaatgcaaaaaattagccgggcctggtggtgcgcgcttgtaatcccagctacttggggggctgaggcaggataatctcttgaacctaggaggtggaggttgcagtgagtcgagactatgccattgcactccagcctggacaacaagaccaagactagtctcaaaaaaaaaaaaaaaaaaaaaagaagaagatgtaatttttctgttttcacacagttttaggaaaagtgacacagacttgtcattatgcaaaggctacggtttttactcaaatcctgtcatggggcctgtgttgatacctaatatcccaatggtaacctcaacctgcaacagtagtgaggcttttttctctaaatggtataacccataattttagacaataataaaagtttaaaaatctaatttttgcacagccaagaataacatggggtactaggaaattccatcagcaaggcaggcaacttcttggcatcagggattgtgtcttttatctgtttccttagttctagcataaattttaataagtgcttctcaaatgagtgctttagtatatgagtggatgaataaatgtgtctcagaagtcatgctagtaacataacattaaagaagcctctcattaaagctcctggtgccctagcaggtatctttattggcagataagttatggaaagacacaatgtaagaaatagtattttggactcatgaaagaactcatataaaaacattgaaaactcatccatgactagtttagatagtttgaagaataagtggtaccctgtgtttataaagtatatgggtccgttcgttttcacaaaaaaaaattatttctctctgcatttatttatgacaatgcatgtcatctttcctggtcatgccttttcacctcgctctgcctttgccttatgctgacagacacatggcatcgtcagctgcctcccttccttgactcctgccttgttttacaattattacagtcaggtgtattaaattacaaactaagagccttgctttctgctttaagatgctttacaggataacctcaacttttccttgttcctgtctcctttcttcattgttgtcaaaatgatccatcggtttcttttctttttctaaataactgataaaagtttattacattaaaaccatatatcacttttatattgcatttgccttttccgaatgatacaaagtagaagcaaatagagacacttcattaaaatgttgattccctattcctttccctaagacccagccctccctcaaatattctctcccaccccttacagaactctgtccttaataaaacacttaaatacatcataaatagtaaattatgaaaaaaatagcaagaattgtttctttccttcttgtaaaaaagaacatggcagcaaagacaggcagccagaaactggctgggggtgtctaatatagaaagttatttggggtatgggctaacctactgtcaaggcagggtgggatagagaagggatagaacaggaattcaacaatatgcctgagataccaggcccccttcttctcctgacaacagtggaaggatcagatggaaaaccacaactcttgtaggtggggaggagagggcatatgtagcccccatttccaacttctctgcatgaagacgggggtaggacatatggcatagcaatgacctcaccgaggcaagaatccactgtctccccatgaatttaagaaaatatttgctggcctcacagatacggactgcctgttaaacagacagaggtgtcccctcttcaccttagcaccacaaacaggagaacactgttggaaaagatgggaagagcaaaaaaatctcctttggagaatgatctaaaattcatttggtaagtcttcatatttagaaaagcaaccagaatatatttcaaattgcaaaacagtaataatcattatagcctggcagtgaataggattctgcccaggaagggctatgatctcccaacccatggctgcctcatgttttaacaaaagtggtaaagattaccccacgtcccactctctccattccttcagccttaagaaattcatcaagagatgaggagtttaaagaggagctgcttctggcagagcaatcactacttttcccttcacaaacaccgtggctcttctgagggaaccctacggataggcatctcgtcaacacttctggatttttgatctgaaactggcttgaaatttggtgctgtgcgctttttccttttttcaggaaaaaaaaaaaaacaaagttgggaggtggttaaacacccttatcccccaaaaacctatacagagattacaggggttttcttccagggatcagagagaaagaactaaggtggggataatgtggcagctagtctgtcctgaggaaatgaagagtccagttcctggtgaaagatgaggggaaagaaaactgccaagtccagtaatctcatttccagcatgaagaatgggggtctgaaaaaaattcagttgtggaaaccaaggttagccagttgaaaatccgtgccacccaactctggagtggaggggatgctgtggagaggatggagtggtcctcaactgtccaaggcactaatgcccatttatgaggacagagaagaataggaggctcttcttcaggaagaagatggagagtgcacctcgcttcttttacactccttttttgatgaccaagtagaagaaaattcaacattgctggggcaagggctgacatcttgggatcacagagaagcagaatcttgttccaggtcttctgaggctttgcgcttaatgggtgaactctgactctgtacattcaagtttttccaaggttatacttgtagttagcatatgcaaagtctttccaactacaggtgagaaactgtggtcagtaatagtgagccctcactgatttcctccaaaggtggattctgaggtctgaggtaaaacatcagaacgaccaaggtgaacacctggctccacttgcacctttatcacttgtgacttgtgttcctcagagaccaatggctggtaagtaatgcaggagttgccactggagcccgtatgcagagagaaagataagccagaccgaaactttttggaaggagaaggcttcaaggggatcttcttaaatactgcgttgcacatgaagtgctggaaccgttcagcgtagaagcctgggcgatgcactgagacagcgtccccatcatgtaccacggctttccaagagtgctccaacttcttaagaaacgtgtaagactgtagaatgtcaatgatgccaatataaagcagaagcctttcccctttactattctgagcagggatgccacccatatggtcatcggcctccatggtgtcgcccagccgagcctctccctggatgaattccatggctgtggaatacagagccttttggggagccagtctttgagtgtcgattgacacttgaagagtgtcgctgcttaagggctctcgttgtgcatgatctatattgtggattgacagccagaggctatagtccattatcttgaagctctgcagcaccaaacagtcacgctgcagggtcttacagagagcattgtacgtgtcagcatccaaaaaaagaccatcagggatgtcttgtaagaagtctagatctttaaatgtgggaagaggcttctctcgctctttctgggaagcccggcgtttgtaggttgagcctttgaggtcatatttgatatgcattttgacggatcttggtaaaagattgttcatcaccacaatccgaatgttcttgccacctgtctgcacacagtacagtccaaagaatttaggcagcaaagtccgagggttctggctgaggttcaagtagtatcctggaagcagcttctgcagaaactccgcctctttatgttggagtgtcttaataatgagttcatcgtcgctggacacatagaacagggaaccactagctccagagctacagagttcaatcagcggctcactgcagagggagcacaagtaatcatcgggcgggataccaaatagctcccgaaagtagcggaaggcaaccggcgcataggtcttgaaacggaaggcattgtagtgatgagcaggggtcaggttgctcccttcactggggaagaagatactctccaccacgtagaaatcttgcatgaggacatcacgctctggtttggtactcaggctccccacagtgtaagtaatgcctaactggatggcacctttcaaggctgttgaggttgtctttttatatgttgtctctcctgaggaatcgacacctcgatggcctgttttcttgatgggcatgccagaggcataaggcacctcagatgccgtggggctcaagattccagatgctgaggacgcggtacaggaaggggccccgggatcaaaggatgaaaaaccgaccgccaacgacggttgggaggaggccgacgccatcttggcagcccccttcccggcagccgcctggctgtctttccatccgcctcttcctgttctcggaatcgaatcttctccacgtgtctttacagaacccgcgttctgcgggccaccttcccgccgcctctggggcctccctcagacctgtcatcgagccggctgctggaccagctcaaggccgcaccattcgcctggcatgggggagaacgcccgtctcgcacgccctccacaagttcaaccgctttcctcagaggagactttccgctttcacagaagagtaagctcaagctgactgcttggaccctgcgtcaggaaaaagccacatctgaagaaaaaaaacaaaacgaggcgtgaaaagtcccagaggagcgaacgccgcctctctgtcctccctacccacggcctgtttaccgcccaacccagccgcttcgatccgtcagtttccttctttttttctttttttctttttttttttttgagacggagtttccctcttgttgcccaggctagagtgctgtggcacgatctcaggtcaccgcaaccttcatctcccgggttcaagcgattctcctgcctcagcctcccaagtagctgggattacaggcacgcgccaccacgccctagctaattttgtatttttagtagagatgggggtttcaccatgttggtcaggctggtctcgaactcccgaactcaggtgatccgccctcttcggcctcccaaagttctgggattacaggcgtgagccactgtgcccagccgatccatcagtttatttacgtgatcaacccattcctacctaagcctttttttttttttttcaagttgcacctaatgactcgaatgccctatcatctcgggtcctctagcctcacttctctcttagtatcagaaacatacttgaaactccaattcatgtatagaagctttctcaaacaacaccagtgtgttatggaagaaagacctcagcgctctagaagtgtgataactgatttaagaatctgcttgtgccactagctgattgtttgatcttggataagtcactcaacatccctggggctctattgctgcctctatgaaatgggaagggaggagtttaggtaaatttacatgatccctccatactctaaaacctatggaattaaggaataatatttattccctaccatcctgtcaaaacctatgataatgacatgctaacaaataatgccgcaaatatgttctctaatgagacagaaaaattgtacactttatttatatgaaatttattatgtgtgctgctatgcccccagcatactaccatgaatggacaagtatttgtgataataaaatatttataaatggggattggcttttgtttatggcagaatagtccatttaaaccaacctccctcagagaacaaatttttttaaaaatttggtcggatacattggagtcctaagaagttagtgaataattatagtactgagatctgggaaaagaaagaagtacagagaggtgagcatttgggcccactgtttccttagggacctctgcatgttccattagaggtagctgagagtctgataagcttagcagagtttttgacaaactcagtggattagggaacaaaaaactgagtttggggtctgatacagcaattgtctgctaaacttcccaaaacttcggattgagaccctgaaaggctatatagcatgggagtaaatgtgtatagaaatagaccgttcctcacagacactgcaattcagctgcgaatcacctcaatccctggtgggatcaagataattgagatgggtaatatccctagatgtctataaagagcaaatttatattcctctttggagaaatatattaataacattgtcctagcccttaaattctctctcattttttatgtgtaatgtccagaattcaggcagtcattattatgtacataaggagtcaagacaatgtgactgaataccaagagaaatgatagacaatagaaatggactcacaggggatcctgccatatctcagtaatatcattctcttatacagattttaaagtaacactgattaatatatttaaagaaataaatgacaagattggcaacttaagcagagaactagaaatgctataaaagaacaaagttctacaactaaaaattatgataaaagaaaaactcaatggataagatttatggcagattagagacagctaaagagagaaggagtggagtaggaaaatctgaagaaaatatctagaatgaagcatagaaaaataaaagtttagaaaatacataaaagaggctgggcgtggtgactcatgcctgtaatcccagcactttgggaggctgaggtgggtggatcaccgaaggttggaatttgagaccagcctagccaacatggtgaaaccctgtctctactgaaaatacaaaaattagccaggcgtggtggcaggcacctgtaatctcagctactctggaggctgaggcaggaaaatcgctagaacctgggaggcagaggttgcagtgagccaagattgctccatggcactctagcctacgcgacagagcaaggctccatctcaaaaaaaaaaaaaaaaaaaaaaaaaagacaggaagaaaacaaagaaaatacataaaaaagaaaagatagggaatacagtgaaagaatgtaacatttagtcctggaaggaaaggagagagaaaatgagacagaagcaacatttcaagggataatggctgagaatttttcaaaattgatgaaagacttaaagtcatagttttaagagtcattgtaatcctcaagtaagataaataaaaacaaaaatgatagtaaaattctgctgaaaggcagacagaaaatttaaagcaaagaaagtgaggtggtaggtgaggagagattatcctcatagaatgaatcataagactgacagctaacttctttacagaaataatagaagacagaagaataaaatctttgaattttggaattctatccctagcaaaaagaactaccaagattgacaaggaaacaaaggcattttcaggtaaacaacaactgagagaatttaccagaggcatctttgtaataaagggaacaccaaagaacattctcaggcaagagaaaagtgactctaattttttagagatgggggatgaaatggagagcgagagaaatggggtaaataaatgagtaaatccaaatgaatgttgttcttcaaaaaatgatattaatgctatgctttggagtttaaaaacataattgtttaaagtctcaacagaaatgaaggatctaaacaaaattaaagtattataaagtcctttgcattttgaagtaaaagtgttaatgatgttagcttcgttttttaaaattaatttttttttttttttgagtaggagtcttgctctgttgcccaggctggagtgcagtggtctgatctcggctcactgcaacctctgcctcccaaattcaagcgattcacctgcctcagcctccaagtagctgggattacaggcgcccgccaccacacctggctaatttttgggttttcagtagagatgggtttcaccacgttggccaggctggtctcaaattcctggactcaagtgatctgcccaccttggcctcccaaagtgctgggattacaggcatgagccaccatgcctggcctgaatgctgtaatttctgtaactaaaaagtaattaaagattgtaaaatgccaaattaacgggagaaaattattttaaaataccaagttaattcaaaaagaaagcaaaatggaaggggggaggaggtacaggagaaggaactagaataggcaagagaagcatgaagcctaggaggatgtaaaccccaatatatcaagacatacgttaactacatagcaactaaatgcttttattaaaatattaatagctggatttatttatttattttaatttttttttttgagatggagtttcacgcttgttgcccaggctagagtgcaacggcatgatgtctgctcaccacaacctccgccctctgggttcaagcgattctcctgcctcagcctcccaagtagttgggattacaggcatgcgccaccacgcccagctaattttgtatttttagtagagatggggtttctccgtgttggtcaggctggtctcgaactcccaacctcaggtgatctgtctgccttggcctcccaaagttctgggattacaggcatgagccaccgtgcccagcctgaatttatttttaaaacaattttatgctttagaagagacacatttaaattttgagaacacagaaagatggaaagtaaatgaatggaaaagatatagtgtacaaacactaatgaaaataaaactggtgtaatttaatatcacatcacaaagattaatatcagagaaagttcactgaggtaacaggtattcctagacataaaaagagatacttcataataattaaatatttacttcaacaataaggtataagaattctaaattttcagcaaataacatagcttcctcaataattgatagaaaaagcactttaaatatagaagctttgaacaagacaattaacaagcttaattcaaattggcatatacagaacagtgtacttactattacataatgttcataatgcaaataatttttaagtacacaggaatatgtataaaacgtgatcccatgctgggccataaaacaagactcaactaatttcaaaatgttaagattatacagagtatgttctgatgacagtagaattaagctagaaatcattaagtaaaatattactagaaaaaactcaaatatacctctacataagtcctgggccaaggagaaatcacagcggaggttagaagatattgcaaactgaaaaaggattacagtatgacattgaaattttggggatgcaactaaatccatgcttcaaggaaaatgtatgattttaaataaactttaagaatgttttaactgtacatttaaatttacaaaaaattacaaaaataagtttaaaatttaaatttacaaaaaataaatttggaaaggaaatgctttagggaaaaacagcaaagtaaacctaaagaaagtagaagaaaaggataaatagatgaaataaattaataaaaatagagaggacttacaaagccaaaagtggtttctttgaaaagactaataacattgacaagctcctggtaagactggtgcaggaaaaagtgatggcataaataaccagtatcaagaatgtggaagggaacatacttcagatcctacagatcttacaatgagaatcttaattatcataaagatagtaagattttagacacaactctatgccggtaaatgtgaaaatgtagagaaatggacaaattcctagaaaaataaaacttaacaaaactaagtgaaagaaatggaaaatctaaatagtactataattattaaactaaatatgtaattaaaggtctgtccataaagaagactccaagattaaatgattttaccagtgaattctttcaaacatttaaaagaaaaataatggtaattatattgattattgctgcaaaacacagtatcccaaaacttagtaactttaaacaacatttattatctcacagtttctatgggtcaggaatccaggtgtggcctacccagatgactctgatccaaggtttttccacagggaagctcttggctggggctgcagtcttatctgaaagtttgattggtaaagtgtgtacttccaagctcacttatgtggttgttgacaggcttcagtttttcacaggctgttgactgaaggtgttacttcttcctttgctgttggccagagaccttactcagtttcttaccatgtgggtctctccataaggctgttcacaacatgacagatggcttcctcagactgagcaagggatggtgagcactgaagactgaagctacagtctttttgtaccctaatcttgaaggtgacatcccttcatccctgatagattatattcttagaaatgagtcactaaatctggcccacactaaaggggggttattacacaagggcatgaataccaggataatagaatttttgggatatgatcttagagactgcctaccatagtaatcttacacaaattattccagagattaaaagaaaaaatacatcccaatttggggttgtattattatgggaccagaataagttagcatcagattatgacaattgtattactagaaagaaaaattatagacaatgccattatgaacatagatgcaaaaactgaacaaaatattaaaaaacaatgtagtaatgcatcaagaaaagaataatacatcacaaataagtctggattattttatgaatccaagattggattaccatttgaaaatcaaataaaaggccagaaagcctaatagaaattatgagcaacacagatttgaacaggaaactcataaaagagagtatccaaatggccaataaaaatgttaaaaagttctcaagctcactaatcatggggaaaacagattaaaaccacaatgtaatactattacacagacatacacacataccacacatgccagagtgtctataatttaaaagactgataatatcaagtgttggtcaaaatccacagcaatgggaacatacatagtacagttgggagtataaactggcataacattttgaaaaaaatgttttgcattatctactaaagctgaacagagctgtgcccaaagacctggaaaattcatttctaacagaaattgtgtccatgtatattataaaacacatataagactttataagagcataatatataaaagcctcaaattggaaataaatatccaacaggagtcaagtagataaattgtggtgtattcatccaatggaatactatacagcctcccaaaatgaactaactcagctgcctacaataatataaatatatatatatagatagataatatataacataatattgagtgaaagaagttgaatgtaaaattaaatatactatatggtttcctttatataatgcttaaaatagtaaaactaatacctggtagtggtagaagacaaaatagcagctaccttgaagagatggaagcatgcagggattggaagatgggtcaaggtggcgcttctggggtgctgctagttttctaactcttgacgtgggtgatagttacacaggtatattctctctggataattcattgcgctgtgcactttttaaaactatgattatgtttatccaaactcgtgtttaatatttactgaactctatgttaaatgctagaattagaaaaatgaatcagaaacagtgcttggcttccaagaattcagagtctaactgtggacaatgacttatagacaattcactaacagattacaagtgctatcaaggattaatatacagaataagattaggaccagtcctgcctcgtgggatcagggattggttttttttaaggagtcgacctgtgaattggtctcatgatttgccattgtgaaagttgtcaggatcaaaatggagtcatttgtgttaaaagccctgacaaatagagctgaggaaggccatgaatgcagggcactcatgcatgaatgcctgataacaagaactaccacaaaagactttgcaaaaaccacaaccttgtacaaaggcccttgcaaccctaacacacacaaaaacacttctgtgaagacgtctgcctagcaactgcctgtctagcctcagactggcactatccttgctattaatccttgtagccatggataattatctcaaaacaattatgtaatcctcattttcctttaaaagccttttaaattaatctccctgaattcgcacacacttgactatggcgtgcatattcccattacaacgccctattcccaaataaacgtaattgtcttttagagagtctccctctctgtttgttctttggattggcacctttcaacaagtgaaaaagagggagagggatgttgtattagtctgttctcgcattgctgtaaagaaatacctgagactgggtaattgatcaagaaaagaggcttaattggcccacagttgcacagagcatgatgctggcatccactcagcttctggggaagcctcaggaaacttacgattatggcagaaggcaaagcgggagcaggcatgtcttacatggccagaacaggagcaagagagagaagggggaggtgccacacacttttaaacaaccagatctcatgagcactcactattgcaacaaaagcactaagggccctgtggtgttaaaccatgagaaaccacccccatgatccaatcacctcctgccaggccctacctccagcattggggattacatttcaacatgagatttgagtggggacatggagccaaaccatatcagatgttctacgtagaaagtgcatgaaatgaacaaagcttaaaaatgcaggcatgtccacgcagccactcaaaagataatgagaaaactcaatactttacaaattttgcatcagtgctaaagactgctgagaggagggtctgcctccagtggacatgggtaaaaatagaatcagcagaagttttcctttctaatcctaaactccatgcctagtgctatggtctgaatatttgcatccctttttctgcaatatgtggataggtttgttttgacatgttggtaatttaaatcccctgaagagagggacctcatcagagtgtgagtcttacctcgatcaaagtcatgttcactgactgtcatacacatactttcagcgagtttttggctggctagggtaaggtttagctagattctttaggcttgggtaaggactgcatgctttgattgtagcagttttgtcattagtctcttggtcacatgttgcattcacaagttgaaatcctaagcccctggccaggagaggtggctcacacctgtaatcccagcactttgggaggccaacatgggtggatcacctgaggtcaggagttcgagactagcctgcccaacatggtgaaaccctgtctctactgaaaatacaaaaattagccaggcatggtggcgcatggctgtagacctagctacttgggaggctgagacaggagaatcgcttaaacacaggaggcagaggttgcagtgacctgagttcgcaccactgcactccagcctggccaacagaatgagactctatctcaaaaaaaaaaaaaaaaaagaaaaggaaagaaaaaccctaagccccaaggtgacagtatgaggaggtagggcctttggaagataattagattacaagggtggagacctcatgaatgggattaatgcccttataaaagagagctgccttcccccttccaccacatgaggacacagtgagaaggtgccatctgtaaaccacaaagcagccctcaccagataccaaatctgccagggccttgatcttggacttcccagcctccagaactgtaagcaataaatttctgtattctataagccacccaaatcatagtttcctgtcatagcagcttaaattgactaagacacctggatcttagcttctttagagtggatttattttgcattctgtagtagctaagcactaacagaagtaaatatttaaattacaaaattgtgcatatctttaggggaaaaagtgagcacttctgtgtccccgtttacactctgctctccagatgctgatgacgcttcccaaagcacagcaagaaacacgcctactccatggctttctgagtttctgtctgctcacactgctgatgccagcactgctgtccccacttgcaagctgggacatcccctagataactctccaagtgagcggatggtaaactgacgttgaggggagacactgcggtcctattttgtgcgtgcctctgctgtcacatttaacacagggctgtgtagtcatctattgaggtgtctgtctctctgactagactaaggcttgtggtgaggaccatctattcatgttgtcctgtttgccaagcacagtgggaggcaaagggatgccccacgggtgcttaacaggcatttgctgaaacaaagtgcaggtggaaagtggccctaatagtgcagctgtggcatcagtgaagctgatcgttagttccatgagggagtggactgacaagaggagcatttgtcatccacatgaaaacaccttttgagcatgaaagtgggtgtcactaatacatacagtaggacaaaaccaggattttctggaggaaacagaggtacggtcaccttcttatgactgtcaacacaggattattacaaggtgtctgtgagtcaccctaggaagtcctgtgtcccttgcgttccatccagagcaagcttagggaacactcttgtgcatttgggatctctggaagcaaaagttgccctgggactagagttggcttcctccacctgcatttccccaagaatcctaatggcgacacactgtgttttcaacagttgagctcccgcctcatgtggaatctgtgggttcctgctaaatcaccagagtgaggtgttggtgcacctggtgtgagccatcacagtgacccacgcaggtgctgagaggcagggctttgctgctgcttggttgctgtggccagtgtttacttgacagcaccacgctgtgcttgcagggaacacatgtgtggtacagcatgctctccctctgccctggtcttctgcttcagagacaggaccttccccagagcagggtttccatcctgcttctctgtctacattaggggaaagcttgctgttttttatctcactccgggaactgccgagccaccgtcggggtggtttccctgatggcatggggataagttcaggagacaataaacctcttggtagacagaagacttcctaaaatatgtagtctgacaaaaagggagatgaatgacaaagatataaatttgcaatgaaagaaaacagtacccccagcaccaaaaaatactttccgtgctatgtaagttatgcataaacactacagccgattcacatttgataaactattaacttccccatttctttgataggaaggctgtggagtgagataaagcaggattgcaccatggaggacaaacatctcggcatccagtacacttcaaaatgtttctttttttttgttttcaagactggctgctatttcctccatgcctcttgtttattagcgtgttgactcatctagagcccagcgccttgttccacaccagagagatggacttgtgcctctgccaagtggagtcggctcgagagataacagccagccacaacaatggtcttcctcagtccctcggccaaaaagacctttggcacagtgagctgagaatgactcatccccagtgccctggaaggctccgaagttctgggagcacggagtggttgtttgccagacagagataacaggcaggatgccgcagagagccagacgtgctccgaactcagggccccacctggcagacgcagaaaaggaaaaagggatgaagcagccagttagcacatggtttcccggttgcccagtccatgccgtcaacaccatccaacattctgaggtttgccaaaaggatctcgtttactcctgggtcacgtaaagagtacttaacttttccccccactccttgccgtcgtcttaagagtacttaacttttttaaaaagactaatgcaatcaactcatcttgaagagtttgctcactttccattgcccttggaaaaaaaaaatgcatgattatctgacaggatgagggtttgattgtcacataagtcattctctcgatggttgacacatccttgactctcaaaggatggcgttgataacctagagaggcaactgagaatagcctaggactggacctgcttgttctgagctgcctaaagagcctctgaaactagtgttaactgttccactcactaaccttgcctttatgaggtaggaggtgggactcaactctggagacggggctcagacactggaccaaattaaggactagctacaacaggaccagggtggaagcagctttccataaggcgtgcccaccagtgtgccatgtcagtttaccattgccatgtcaacacccgggcgttatcgctcctttccatggcaatgatccgatgacccaaaagttactaaccctttcctagaaatttctgcataaaccatcccttagtctgtatataattaaaagtgggtataaatacgactgcaaagctgccctgagctgctcctctctgcttatggggttgcccagatctgcaggagcagtcatggaggtataacactgctgcttcagttaagctgtttttgtctacctccagcatgcccttgaattctttcctgggcaaagccaagaaccctcgtgggctaagtcccactttggggctcacctgccctgcaccatttagatgtagagatggctacactgctttgcaggcttctttagcccaagtcattagatgcacaggtagccatcacctttgaaagattctgttgtaaacttgtgataaaaatgcctttcatggtctcatagacattttttataataactaaaatagtgattgttttcattacaagctcagtattgtactataaatcacttaactgctgaagtacaatgtaagtcctgaatggcaatgtcagtgttattaaccattattaactcaaggacagtggggagtaaggaagatgagttctgtttcatcattttccaaagtcacagagcttgttcttcaacagtgactcaaagcaaatgccatagcctgctttgttataagaattttgatacatagttaatatttacataatgacttacaattcaacatgaaagctcccatgtcagtactaagtaacttaattacaccatttataaatacagtactgtcggccctccctacccttaggcttcccacctgcagattcaaccaactgtggatcaaaaatattcagaaaaggccaggcgcagtggctcatgcctgtaatcccagcactttgggaggccgaggtgagcgaatcacgaggtcaggagttcaagaccaacctggcctacacggtgaaaccttgtctctactaaaaatacaaaaattagcctggcatggtgatgcgtgcctgtaatcccagctacttgggaggctgaggcaggagaatttcttgaacctgggaggtggaggttgcagtaagctgagattgcgccattgcattccagcctgggcgacagagcaagactctgtctggagaagaaaaaaaatttcagaaaaaaacaattaaaaataacaatacaacaacaaataataacacatataagaatcaatgcagcataacaactatttgcgtagcatttagattgtattaagtattaaaagtaatctagagatttttaatggatatcaggaggatgtgcatagattttatgcaaatatggtgccattttctctaagggatttgaacatccacagattttggtatccactggaggtcctggaaccaatcccccaccgacaccaagggacggctatatattttttcccttgacctaacacctactcacttttggacagcattataaaataatcagcatcatctccagaagtatttatcaggcatctatcatggtattgtattaattaggtcatctactgaaaggcagaatgttcttcacttcagattttacaacacccttttttcataatacgtggataggtttgtttttaaatgttggtgacttaaacctcctgaagagagggacctcatcagagtggaagtcttacttcgatcaaagcccgatcatacaacctattttcagcatgtttctagcaagttaaggcgaagcttagctagattgcttaggcttgggtaaggaccgcacactttgcttgtagcgttcttagtctcttggtctaagcaaggctgtgattcaccatctgaactcaatagcgccgtttcttgcactgggtggtttgctaaattcacatagataacccaaagaaagttcaagatcagaaagagagaagattgacttacttgttatgagggaattttcattcacagagccataaaaatataatcatgaattttgtggatactgcgtcctttgggccagccatctagggtacagatgggacgtgatgccattgtctagaagccctagggttgcaggtggctgctggcaaagcgacccaccatccatcccttgctgcatcgggatcaggggccgttccatgagctgctgccctgagaggcctcggtgtttctgttctttgccacccgcttctgtatgtgaatcactctgagtatttacatcctttgacattattcctgtttccccgtattttcatgtccattaagctgatactgtataggcttgatgacggtgtctttttctcagtgattttctccacacagtaaaatggtgcccaatgggagaataaagtctccttgctccatagaaggcctgcactttacatgtatatatgagaaaaagctggtttctgttagtctataatgtattaagatgtggttagtgaaaaactgccttccaaaattcagttaatatagaaaattaagtatttttaaaaatttttcagactgcttattgtagaatgaaattggcccttgtcttatctcagccactttacccccaatctggacattttattataaatacagttctgctttcagaccatcatatttttggaaaagaaaattgtgtaaggtaaaagtgattacattcaacacatttaaggcaaatcatctgaaagttaaaaagaagtaaagacaatctgaattcctaccatattactgtattttctgaaatataaggtgcactcaatttttttacatgctccctttgctgaagcggaataatatcttacagtggatatttatacttcactgtataaatatccctgacttatgatggttcaatttaatgatttttcaattttacagtggtgtgaaagtgatatgcattcagtggaaactgtacttcaaattttgaagtttgctctttccctggactagcaataccatattctgtagagtattcagtacggtaatctctctggatgctgggcagcaccagtgagctacagctaccaatcagccatgcaatcacaaggctaaacaactaatactcaacagtgtattgcattgccagaagatttttgcccaactgtaggataaggtaagtatttggacatgcttaaggtaggctacgccaagctatgatgtttggtaggttaggtgtattaaatgcattttcaacatctggtattttcaacttactatgggtttattgggatgtaaccccattgtaagtcgaggagcatctgtatttcatgagcaggtgttccttttctccccagctcccccaaagtctgtcatcatcttaaaattagtgacatcttaaaattaaaggaataaagagtttcaagaattaaacagagatgtaatttttctagatttcctcagagcctgtaatttcacatattaaagtttaaagattagattttttttagttttgattaagtggctgtgatacatatacttaatgtcacatacaagagtgatcatcctactctacatttcttgaataaggtgtaagcaaaattattatccattataacatttagaattccttaattactgacagttaatgactcagaatggtaagaaataaaatataaaattcaataatgttcccacttgaaggtaggcctctgaaattccctatatatcctggcaactattgtgtaatgcatatgtgcatatacaagcaatgtgtacaggctctttgcattaggccattcttgcattgctatgaagaaataactgatcctgggtaattttataaagaaaagaagtgtattggcttatggttgtgcaggccgtacaggaagcgtggcaccgggcatctgctcagcttctggggaaacttcaggaagcttacagtgatggtggaaggtgaagggggagcaggcatctcacatggtaagagtgggagctcaggagaccactatacttatgattacagtctcattataaaggatacaactcaagatcagccaaatggaagagacttatagagtaaggtctgggaaggtcccagatggagagtgtccatgccctcctccatggaatctgagcacatcaccctcccaggatatcactgagttgttcaccaaccaggaagctctactgagcctcggtgtccagagattttactggggccttatcatatagacatgattgattaaatcactggccacaagattgaactcagtctctacctgtcccctcctctccctggaggttggactggctaagaattccaacactgtaatcacacagttggtctttctggtgaccagcccccatcttgaagctacctaggggccaccatggatcacctcattagcataataattcctgtcattcaggaagttccaagggcttttgaagttctgccccaggaacagggaatgaaaactagatctatggtctccattataccacattatacagattttgtataaggttcttattagtggctctaactcttacctttctactggcttacttacaggctactgcaatcttgcagcatatcttgctatcatctgaacttcagcaaatttcaagttatgcttagtgtcatgtcccaaattagcttccccagttccccatgatcaataaaaaccactgccctcctggacattagagctccaagttttagattaacccttgactctctcttcttattaagattttctataaatcttgtctgactgctgactgcattatttagattactttctaacctttttgaacatacttctgcttaaaaagtgttaaaagtcccaaagcaaacaaagcagttagaatctgggtcatgttaagctctatatacttctttacttgtcctttctcccagagattccagtatgtcaagaatttctgggctagattatggttgaattgcaaatacaaatttagtcatcctcagccctcctgaatctaagatcaccagtagtagtgtttgagggaactgctccctgggtcctcaacaaactgccactagatatcttgcaaagcaggtttttgcatttaaacctggagggtggctgggtagcatgggagtggcaggaagacttggcaggcagtaggtggttgcaggttacaaacaagctgatctcttttttccttttcttttctttcttttttttctttgttcatctattccatacatccctcaaagcaacatttcctggcctacttctttagtgcatccattcactcatttgagcctttgtttattcatttatccagtctcgagtgcctcttccaggccaggtactgttctagcatcaggacagagcagtgtttaacaaaacatggcacccatcctctgcaaaatcccagcctagaggctgaggcaacagataagtaaacagatatacaagataactttagattgtgataaaggctataaaaacaatgttaggctaaggtgatagagaatgatgggaggcggtgtgtagcttagatcggaaagaaaaggcctctctgaggaggcagcattagatcttaagtcaagttctgaaatcagagaaattgggccaaaatttgtccagcttgagtttgctattcacatcaggaaagccttctgccctgagagccctgacatcctttctgggggccagtgtgataagaccacatgatcaagttactacatcctccccttatatggcccccagaagctcttttggggacactggtcccctgagtgtccccagaagagcttctgggggccatacgagtttcctgctgaagtgatagctcaggactgagcctttttgatgctgctcctttacattccacagctcagcctctcactgcctccctttccctctccctccccttctctctcgcttcctaactaaacctccctctgtttatgtagggtggtgagtgagtctctttttatggcacacaggtcacaggcagcctggctgccctccgtgaggccttctgctttcgggcatcttggtggggagcacaccagcaccgcagtgacagtgacctgggaagaatgctggggggccaggagcgctccgcaggcatttgctgcttttttataagcagcctctaggtgactgaatgccttactattaagtcatgcaaggggaaaataatcactttcgggctgacaccaaatatgagtatgttcagcaccaaaggcaccttgctcagaatattttataaacagattttttttaagtctcaactgtggcttaaagatacacttttgtcgtagtccttaatagtaactcatctgaaatacacgtacgtccatttctagtcatctgcattgatacatcagaataatgtgtttaatccaacttaatttaatagattataaaatacttgtatgcaaatgtttttgtctagaagttccaaaatttcattctcacttcctgttctgttccttccactcaccttgtgctcaccactccccatgccataccgggccatcacttcgtatggcctggcaagactgtctctcccatcttccccatctcacttgttacactgaaaaatggaagtggagagaaatagaaatatacagagcattcccaggggcgtatcctaaggataagctgggattcctttcaggtgtttctccttcaagctcctgccaaactgatagctataccccgatgaattcacacaggaagttagaaagtcaacaggaattgcctcccaagccagaacactaccctagctatactactagggtatcgcctgctctataaagacttcattaaccactcatcaggaatagcctgctcgtagataatgaaaagttgcctgtagaaaacgtattacactcaagagaatagtatcagtgcaagaagtagaaataaacaagccagcaattcccaagactgctctatcaacagggacttaaggctccgggtagagccccccaccagtgttgcaggttcattcactcctggggctcctggttccaatgttggacacttctggctattagagagttctttcttttattgggctgaaatttctctctatgcactggaaatatttgtgcgcctgatgggaggcatagcgagtagagaggctacagaatctttcatgtgtcatatccctagatggaacacactgatttcagtgaagatttttatatcaagttttttcaaattccctcaccaacctgcttgtcctccttctgaattctaatttgtctctgtctctcaaattgtgatgctccaaccctcttctttcagtgccctctcatttgctttcaacctccctcttcccttcaatcctgatcccttttggccccttttcctctgatgggaatactgggatggtatccactaggtgatactcccacctgagaagtttagctgtatggtactcctgttatgtattcctaaagacattgatggtgcgtgtgtggatctgaatatatatatttgatggggggtggtaattcctgtgtatttttctctgtacttgcaaactcaggaagggcaggcataggactgtactaggagtatctgccttcccagacagaactcatccaaatgtcccgagacaacagtaatagcattacatatttatgttgagggcttatttaataacagccactgtttttctggtggcggggggttggacagagtctcgctctgtcacccaggctggagtgcagtggcatgatcttggctcactgcaacctccacctcccagtttcaagagattctcctgccccagcctcctgagtagctgggattacaggtgcccaccaccaagcctggctaatttttgtattttcagtagaggcggggtctcaccatgttggccaggctagtgtcgaactcctgatctcaaatgatccacccacctcggcctcccaaagtgctgggattacaggtgtgagccaccacacctggccaacagccactgttttaaaagcattacataggttttctcatttaatttagccctcacaaacttacaaagtaggaagctacagctcagaatgatttcatagctggcccaaggccgtgcagccagtatggtggacccagtattagaatccaccttcccagccaccgtgacatcctgcagccacgtttttggtttttattatggtgttaatcttagtaagtttgggtgctacaacaaaatgccataaactgggtggcttataaacaacacaaatttatttctcacagttctggaggctggaagtccaaggtcaagggactagcagattgagtgtctggtgagagtagtgtttgcagatggtggctttttgctgtgccctcatacgatacaagggcaaacaagccccctcttctgtaagggccctagtctcattcatgagggcactaatccccctcatgacctaatcacctcttaatgccatcacactggggattaggcttcaacacaggaattttgggggcacacaaatgttcagaccatagcaggtgcctaatataaattatttgtggatttactaatagttaaaataaccaaaacctaacctgtcttccagttttatccattttgagtatctgaaaaattttaagcaaagactcaaaatgtttttaaagtcaatatatcaagtgaaaatctgtggatgtggctatatgaaggtgtgtacttatattcttcatgcttgcgctcttaacacggtttgcactgtaattaatataagcacatcaaaattgtgtacatgtctttcctacacaatgagctgcaacagaatggctgctttttgtgtttttaaataaactttattgaggtataatttatgtacaataagatgtgtacacttaagagtttgatgagtattgacaaatgtataaatccacgtaccagcaccctagtcgaggtacagaacatttccatccatccagaaagctgctagaagtagaatcatgcatacgtaagtggaatctttgtatctgacctctttcactcagcctgtttttgagattcatctatgttgttctgtatatcaacagttcttttattgttattgctgagtagcatcttattactgtatgaacataccacaacttgtgtattcattcactcactgatagatgtttgagttgtttcccaccttttggctattttgaattaagctgctgtgaatattcatagacaagtcttttgtggatgtgttttcatctcttttttgcaaaatcctgggggcagatttgctaaatgatatgttaagtgcatccttaactttgtaagaaactgccaaacgtttccaaaatggatgttttattttatatccccaccagtggtacaggagagtttcagttgctccacatccttgccaacacttggtattggtagtctttcttttttttaagtatcaagtatgcactgaaagatacatcaacattaatacagaagaaacagagtcaaatcatttaatcgaaataatataataatataattctggccgggtgcggtggctcacacctgtaatcccagcactttgggaggccgaggtgggtggatcacaaggtcaggagatcgagaccatcccggccaaaacggtgaaaccccgtctctactaaaaatacaaaaaaattagccaggtgtggtggcacacgcctgtagtcccagctactcggaaggctgaggcaggagaatagtgtgaacctgggaggcagagcttgcagtaggccgagatcgcgccactgcactccagcctgggcaacagagtgagactccaactcaaaaaataataataataataataatataattatacatctcgggaaattgagagctggaaacttggcaggggcttccacattatggaacaatttctatagctgcaatgaacttaaaaaaaatacacttaaacatttataaatgtatgctttgcctggaaggagtctggcaaaaacaacaaataatcttaaatgtatacatttcataaaagtgctaatgatttttcccaacgcttcccattcaccttcaccctacagagagttctgacttggctcatttaatttcttcccttcctcagtcactcaaaagtgttcttccatttcttggtcacttatttggacttttttgatgtccaggctgtaggaaaagcagtttatttgagaggtaaaagtggcatttgggctagagcttggttagagctaattctgagaatgttctagaaagagttatcagagtagttgttaagtatgaaaaaagcagacagcagaaaattattgtggcagactatatacattaccttctcatcataaaaacaaagcactcattgtttttactgaattgcctggtggtagatggggtgtgttcttaactaagcactgccttgacaagacagagggatgtggtgccatcatcttttcaataggaaatgtatatgtgcatatatttgtgtatatgtatttttcctatattgattgcttatatacatattcacatccttatacatatctatgttttataacttgaaccttgtttttttaactttattgaggtataatttataaaaaattatataattcaagttgtacaacatgatttttgatacatgtatacattgtgaaatgattatcacaagctaattaacatattcatcacctcagatagttacctttttgggggtgtgtgtgtgcgtgcgtgctcgtgcagtgagaatacttaagacctcctctcttagcaaattacgggcatataatgcattattattaactacagttactgtgctgtacattaggtctctagaacttgctttgtttttttgggatagagtcactggagtgcagtgacgtgatcttgtgatcttggctcactgcaaccttcgcctcctgggttcaagcgattctctgcctcagcctcccacgtagctgggattacaggcgtgcaccactatacccagctaatttttgtatttttagtagagatggggtttcaccatgttggtcaggctgatcttgaactcctggtttcaggtgatctgcctgccttggcctcccaaagtgctgggattgcaggtgtgagccactgcacctggccaacttactcattttgtaagtgaaactctgtaccctttgaccaacatctccccatttccccacccacaactcctgccaaccaccattctcctctctgtttctatgagttggtttttgttttagattctgtatataaatgagattattagtagtctttttatttttagctgttctcggttcggtataatggtatctctttgtggttttaagttgcatttctctgatgactaaagatagtgagcatcttttcatgttatttttggtcatttgtacatttcggggggtagtgccgatctctttagtttatgggctgtgtggttgtgtgttgtttgttccatcgttgaatagtaagagttatttatattttctaaatttaagtgctttgccagactcattaattacaaatattttctcctggttgatggcttgccttttaattttctcaacaattagttcatgttttaaaaagttgtactgagcaaaatttagccaggcatggtggcaagtacctgtagtcccagctattggggagtttgaaggggaggatcaattgagccgggaggcagaggttgcagtgagccatgatggcatcactgcactccagcctgggtgaccgcgcgagaccctgtctcaaaaaaaaaaaaaagtatttagttgccaattctttatttccaattcttcattgcaactttattgacacatagttgaccacaataaattacatatgtttaaggtgtacaatttgatgagttttgacatgtatacaccattgaagccatcatcacaatcaagataatgcacatttccttcagctccccaaaaaacagtttattttgaagagcaaaagtttttaattttgatgaagtccaatttatcaaatttttcttttatggtaagtgatttttatgttatttttgggaaatctgtgaaaatctttgcctcaaggagcaaaatttgtctcctataattttacttacattttctcatattttttctaaataattgtaactatagtgttaattttctcctttaaccacttattgagtttttaaacattttctaaatagctttttaaccaaaaatttttaattagcttttaattttttaagttatgatgaaataatgtgtacttttaattatatttttcatttttatatgtatttcttatatattcaatctgtattttttgatgaattgagccgtcaaggctaatacagggatgttgaagtgtctccctttctctctttatcccgttaccctgtgtcgtgagttccatcgccgtggttctttctaatttggttttgaggtctccacttttgagagtggccaaaacctggccgggcgcggtggctcacacctgtaattccagcactttgggaggccgaggtgggcggatcacgaggtcaagagatccagaccatcctggctaacacggtgaaaacccgtctctaccaaaaacacaaaaatttagccgggcgtggtggcgggcgcctgtagtcccagctactcgggaggctgaggcaggagaatggcgtgaacccgggaggcggaggctgcagtgagccgagatcgcgccgctgcactccagcctgggtgacagagcgagactgcggcacacacacacacacacacacacacacacacacacacgccaaaaaccaagaagccactctctgggagagccctaacagcgtggggtgggggagctaggttcacctgtgtccatcaagtgagacaaaatgagggaatgaaaccaaaatggctgaaacagaagaactgtataacttacagatcccggaaaggtcagagctgccaacaggaggctaaggaaaagtccaggggtgtcagagagctcaaccagggagagggagtggggagtaagggagagaggggagagcgagagagagagaggacctgtgggattatgcctttattaagatccgtggaccttatcccttagggtttcccatgggggttgtggattggctaatttaaaaaaacgtgtggttgggcacggcgactcatgcctctaatcccagcactttgtgagaccgaggctggtggatcacttggggtcaggagttcgagatcagcctggctaacaaagtgaaaccccgtctctactaaaaataccaaaaaaaaaaaaaaaaatagtagcgcgtggtggtgcacgcctgtaatcccagctacttgggaggctgaggcagatgaattgcttgaacctgggaggcggaagttgcagtgagccgagattgcagcactgcattccagcctgggtgacagagccagactccatctcaaaaaacaaacaaacaaattaattaattagttaaatttaaaaatgtgcaaaagggggaacttacatcactctggtgttgatcattaggttttactgtggtcagcagctgtggggtgaagagcaagcaggctgtttcacaaacaaccacacagggagggaacattttaactagaccaaaggtgatagggtacgactgggtttcaataacttaccgcaggcccaaaatggatgccaaagcagcaactatactagataaatgtatgctgccctgttttattttgcttttaacattcggcactgcctaatcttataatcttgtataaagatcttgtacttatttctttattgtacattaactgtctcactcactaggttgtaaaccccatgggaacaagggcattctctggaacattcccactgctggcaacattttttggcacatagtaggtactcactgttgaatgaattgaaagcttaattcgcagcctgtgagcaatgaagagacacatcctagttcttaaggaggattagaactttgtggtttttctcccataaaatgtctcaaatctgtattgtgaatattaaaatgaagttaataaactttctcttcaaagacaatttttacaattgttttatgaacctagttatagtctacattaactatacacagtgtacattcttaatccctttcattcctggacttgtattttaagatctctgttgaattcagtattcaactttacatgttgtctaaccctaaagataactttccttcccgtaacactagaaaacataatcacaggaaattccgaagaatttcagttcctaaagtgggagattgtaagatctgaaaggaaaatgagctataataagccacagaaggtgagaacctgtggaagttcgggttgtcagttgtctcttcagcatatgaagctcttcttcatgtcatcatttaatatacttggtgctaaaatgactctcgtggagtaaccaaatcaaatctgtattcactacaacaaaactttccaacttcccctgccattctcatgtttaagaaccatttatcttttttttttttttttttgagacaatgtctgtctctgtcagtcacttaggctggagtgcagtggtgcgatctcggctcactgcatcctccgcctcccaggctcaggtgattctcctgcctcagtctcctgagtagctgggattacaggcatctgccaccatgcccagctaatttttgtatttttagtggagacagagttgcgccatgttggccaggctggtctcaaactccacccacctcggcctccctaagtgctgggattacaggcataagccaccatgcccagctcatttttcttatattgaatattgacgatgaaacaaagagcaaccacttttcctctcgtggccctacttgcagggctggaatctgtgacactactgtgcatcccttattaacgtcctagtggcaagtacactgaggtgtggcctgatggcccattctgtgtcactatctctactctctccaggaactgagccatacccatatacataagagatccaacaccagatgtcaaaaagtcaatgtttatttaggaaaggaaatatgtcattgagtgattaactcctaaaagcaatggttaaacttttgaatcattggaattgagcaccacgtttcttctttactttgtagttgagcttatttactgggcacttgggttttcagtaagaaagccacatggtcgctgtcaacatcaagcgcttcctaagactagtctgtaaaattagcctgggaaattacggagttgataacttcctgctctgagaggagcttttgaacctttccggggacctaccggggtagattccactcagatgtgaactcctgaaggcaggagaagcctgtgcacatggaaggatgctaaaatccacaactacgtggcggtgaatggtgtaggctgcttataaggaatgtttcactcaaggaacatacggtccccaaaaccattgtcatttaaaaagcagaggccgagcacggtggcttatgcctgtaatcctagcactttgggaggctgaggcaggtggatcacctaaggtcaggagttggagaccagcctggccaatgtggcgaaaccccatctctactaaaaatacaaaaattagccgggcatggtggccgacgcctgtaatcccggctactcgggaggctgaggcaggagaatcgcttgaacctggggggcggaggttgcagtgagctgagatcgcaccattgcactccagcctgggtgacagagcgaaactccatctcaaaaaaaaaaaaaactttaaaaaataaaataaaaaggagagtaaaaagtggccccatccttctattgtgggcaagttgcaggttatctcaatgacctgacacatagtagttctcagccactgaggctgacaggcactggtgagcttgcttggctggttcagttggttacagactaaggattccctgtctgtttcctttcaggtcagttctcgtggtttagaggaaacactctaacctgtggtcacaagcattacctttggccaattcacccaaagccaaagcatttaaacttctattatacaattatattcttggttccatagaaggagacagtggtaaacagcccatagaagccactttctaaatactatcctttcccccccaggcttattaagatatgattgaaaaatagaaaattggccagatggggtggctcacgcctgtaatcctagcactttgggaggccgaggcgggcagatcacaaggtcaggagttcgagaccagcctggtcaacatggtgaaaccccatctttactaaaaatacaaaaattagctgggcatggtggtgcacacctgtaatcccagctactcaggaggcccaggctggagaatcgcttgaacccaggaggcagaggttacagtgagctgagcttgtgccagtgcactccagcctgggcaacagagtgagactccgtctcaaaaaaaaaaaaaaaaaaaaagaaaagaaaattaaagtgtaaaacatggtgttttgatgtaagtatatcttatgtaataattgccacaaacaagctaattaacatacccatcacctgagatagttattctctgtatgtgtggtgagaacactttaggtcagtctcttagtgaatttcaagtacacagtgcagtattattgagtgtagtcaccatgctgcacactagagctctaggacttactcattaactggaagttcatacccttccgtcaacctctccccatttactccgccctcccccagcccctggaaatgacctttctctgttttcttaagtttgactttttttagattccacataaaagtgatatcttgcaatatttgtctttctgtgtctggcttatttcacttggtatatcatcctccaagtttatccacgttattataaatgacaggattctttccttttttaaggctgaataatattccattacacagtctatcctcttggtttgtccaacttacaagtttttttctagagataaatgtttcttaatgtagatgagggtattttaatagttacgtagtaggaaaattagattgtctaaaacgtatttaagtctttgttaacatattcatttgatcaatatagagtatttgtttgggaccaagttcttagaatacaaaagccaataagaaataattccggccctcaaaaaatttgtaatgtgattaatatgcggtttagtttgttcagaagatacagacttttttgagaggaaaacagtaatctgatgccatatgaaattcaaatattctcacacattctacaagtaagctttttattttttccttcttattaaaaatatcaaacttatttatcttgcctttgcaagataaatggtaaatatctattctgaaactttatttctaataaacattataatttatatatattatatatctgtgtgtgtatatatgtacacacactgtaaaagtatgtgtaaaaacagtatgtataaaaaaagtacttggagctaatttatatatatctgtgtgtgtgtgtgtatacacacacagatatatataaattagatccaagtacacacacacacacacacacacacacacacacacactgatatatataaattagctccaagtccttttttttttttgtgggggggatggagtctcgctctgtcacccaggctggagtccgtggcatgatctcggctcactgcaacctccaccacctgggttcaagcaattatcgtgcctcagcctcccgagtagctgggactacagacatgcaccactatgcctagctaatttttgtatttttagtagagacgggtttcaccatgttggccaggctggtctcgaactcctgggctcaggtgatctgcctgcctcggcctcccaaggggctgggattacaggtgtgagccaccacgctcagcagctccaagtacttttaaaaaggaatctcagttgggcatcctgtataaaaatacagtcctgaggagtagtcattttcattagtgttttagttttacatattcattgtagaaaatttagaatacacaaaccaaaaagaagaaaataaaattattcataatcctatcattcagacaccaccactgttgtttcagtatatgccttccagccttttataatctacaataataaacatttatgtgcatgagcaacagtaacatctcagcatgatataagcctctcacatgcaatgtctcatgtaattaatgggctcaggctctgatgtgtttcctggcagtttttaaattaataaattgtgcgacacttttttttcattaaatactctactaagataccactttaagtaactgcataatattttaaataaatgtatttaatcaaattttttattttttgaacttttttttgctattataataaatactgttgatgacatgtactgtttgcaataacaaacaaaacaaaacccaacaaggaagaaaatattttgttacctccaagaattttttttttttttttttgagacggagtctttctgtgtgccccaggctggagtgcaatggcacgatcttgtctcactgcaacctccgcctccctgggctcaagcgattcttctgcctcagcctcctaagtagctgggattacaggtgtgtgccaccacacccggctgattttttgtatttttagtagagacagggtttcaccatgttgtccaggctggtctcaaactcctgacctcaggtgatctgcccgcctcagcctcccaacgtgctgggattacaggcatgagactccgtgcccggcctccaagattgtttttgttggatcgattcttagaaagagttctgaacaccaggacttgggcaatttttagcctattactagatattacaagagatattcttcttgtattcagtgtttatatgtccacaagaaaatggatttaatgattatctggtatttttcagtagtgtaaacaatcagttaatttagtacacagagtgaatgacatcactcatgagctgcctctgcagcagccacaaattctgagttgctgggaactcatctgactggcaaaatggtggaacgctttattgggctcatgatacctacttaaaacactcagggaggccatgcagttgcctttttttcagctcaaaggaataattctattaagtttttataggcttaaatgcctaatgaacgtttttatagtttaaaacccacaccgcaacatttttctacataggccccttccttcaccataacatgcaagctctgagacacgtggctaaggaattatcaagaaagattaggaggagaagtaagtgtagctggcagtgtggggatatctgaatgtggagatcacatcttgggaccttatgcctttgggagctgtgggcatcttgagacatacagtatccactaccatccctggaaaagtccccagaaggttctggatactctcaacattgacaccaaagagagcatgtagatcctctatgtgtccttgctgtccagcaacaatgggtaaaataccaagatcatatgcagtgttcatatcaagcagtgaggacattaaagaggtcaattccagggcatggtgacttatgcctgtaatcccagtgctttgggaggttgagacacaggattgcatgagcccaggagtttgaggttacggtgagctatgattgcaccactccactccaaactgcacgacgcagcaagaccccatctcttaaaaaaaaaagtaaaaataaaaaactaaagaggtcaactctaatattcccttaactcaaaaggaaattcatctttaagaccaaggaaaatgatagtcttgggtaaatatggaagaactgtaaaaattccttctagagagacaaaaggaagaacaggaagaatactggtaaaggcagatttgacctcaagcctctgtatgactcatgatttccagttctctcataatttggattgattgattggttggttggttgatttagacaggggcttgctttatcacccaggctggagtgcagtggcaccatcatgctctcaaatgcctgggctcaaataatcctcccacctcagcctcctgagcagctgggaccacaaatgggcaccaccacgcccagtttatttttttattatttgtagagatgaggtcttgccatgttgcccaggctggtctcaaactcctgggctcaaaggatcctcctgcctcagcctcccaaagtgctgggattacaggtgcaagccatagcacccggcctcatgatttggattttattctgaaatatgctaccatatttatgactttgttttgtccctttgagaaaatgatatagtgtaattggaaacttaaaacaattgttttcacaaaaataccaagaatgcaggttaaaaaaaaaacaaactaattataaccaagcatatttgagtacctttccctacctttttaataaacaattagactcatttatgggttcttcaaaaaaggaattaactggtagatgactaacaatagtagttccttcttctttgcagaatcaagctgtaataaaaaaggtaaatatcatctgtacattggtgaacttatctaaattgaaataatcatatttcctctgttagttaagaaggtgggaaagtagttgagtatttactttggtctgccttggatgctagctgagagtcttattttgttccatatcctattactcatgagtcatttataatgggcttcctgaattcatattggtacctacacatttaaaaaaatcaattagcgtcagccaggaatattttcttgggtaacaatatttttaaggctaaaaaaactagtgccatcaatgtatggcattcaatacatgtcctttgactgtggtttaaaagcctgtggcttaaaaatgattttttttttggccttgaggcagaaataaaatcatgaatttaatttgaagtaggacacttttccagcttctgtagatttagctgggcccaagggaatataattcttggtaaaatatttcaactctcagtattgtacattgagttataaatattgatatggcttttcaaataggtttttcattaaaaatgtgacttttcccaatttgtctacttctttactatgatttgtacttccctaattgtatcatatgttagaatatacctacaattttataaagaaagttattgatgataaaataagcataaacttattttctcactaactttcaaaaaaaaatgctattccattaaatgaactatgacctgggtggtgtgaactatcaacatgtaatatagattaagtgattatatttaatatttaataatatttagtagtcctaaacttattcttactgttgtttatagcatatatataccctctatataatactgaaagcaatattttatttatgtatattcagcaagaacatttgtcagtcatgtatcaagcacttactatatgctacaagtccttacaaagaatttttttctgttaaaggatgatagtaacttggaaaaaagtcttccttgtgctcttttcagtggcaattaagcattcaactttaaaacggcagttaaagttgctttagttatttataatgcttccatgtttaaagacatctttactaggcagagcacggtgactcacgcctgtaatcccagcactttgggaggctgaagtgggaggatcgcttgagcccaagaattccagaccagccatgggcaacctggcaaaaccccatctctacaaaaaattttaaaatcagcccagcgtagtggcacatgcctggagtcccagctacttgggaggctgaggtgggaggattgactgagccggagagttggagattgcagtgacccactattgcgccactgcactccattctgggcgacccactctcaaaaaaaaaaaagacatctttactaacagttttcaagatacatgggaaaggtagatacaggttttccaaattcttattattttttactaatatttttggtgtttgcctttctttcagttcctctagattcctattgggtggctggatggtaggaaattttatgctgctgaatatacccagtgctgctgcaaagtgcccctgctgaacagttctccagtctctgatggatttcctttcagggtctctccgtaaaatatacccatacttgactatattataactaagagttccaagaaacatttgggtaattgaaggaagatagaattttaaaatgggggtgggtgagcagcttcctaaaacctggctctcccttgcgcatagccctcctttgtggcacgttcaggtgaaagctgcctgctattctcccatgtaagggcagacggggtgggccacctgcctgcccctcattgctgtttcttaacaaggaaaaggacaagtagtaaactagaagcagcttttccaccctcatgcaagagcctttttccccttgaaatggaaacaatgccacctttgtctttaattcacaaatctttatggagagtggcagaattgtgttagccttggggaaacaaaaatgaagggcccgatgcggtggctcatgcttgtaatcccagagctttgggaggctgagcggggaggaccccttgagcccaggagttcaagactagcctgagcaacatagtgagacccctgtctctacaaaaatttttaaaaatgaagaaaacataatctatgctatttctgagcttctgctgtcgggagggagatagacaatcaacaggtgacaatgaaatagtctcccagtggtgtgaagagatagagagcagaaaagtgtctgcccgacagtgaggccagaagatcagggaccattcctggaggaagtcaacaactgagtcccacagaaggagctggccatacaagaaaggggtgttgtagacagacagcagcctgcaaaaagaactggaaatgagagaaaaagaaccatcccggctcagagaacctggaggacttcagtatcttgggactgacaatgaatggctgggagtaggaagagccaaaagaggcagaggttggagattgggaatttgggttttattctggagcagttgggccttgatcagtttttagcaatgctgtgatggtatgaaattggaattagaatttaaaggattggcagtaggtaagactgaatggtaggagatcggttaggggaaggatgtagctggaaagtcaggcaagggaagctgaaggcccccaaccaaggccacggatgccgaggatggagaggagagaaggagctctgagaattagtgaggagttcgatggatgggctcagagctgactggacaaaacattgcacccttcagttgtggaactagggactctccaagtcagagcgcccactctcagctccatcactcaagcctcccacacaactttcttctgtcctttcgcttctcacttgcctttttccttttccctctttcccatcttcctgagtaaagctaagttatttattcagagtggctttcaatctagaaacttcagaatactgcttagccccttcctttccctcaaccccacctggtcactgtcgtttattgacgtcacttgggagtttcccaaatctggctcctttctgtcaaaccaaccctgctgctctgaccaggcctcagtttacctcttcagacctcccttctttcatctgccatttaaatccttgttagccctgcttagtgctaagaatgatcagagacaggagaaagtgaaacccattcctatttaaagatgggatttaagcaaagaactaataatgtttgggaatattttaaaacaataattttctccatcatttctagttgaataagagttggtctagtaatagaattataacaatgttttctagaacacaccaaattatatacagtagtgcttcttctaaaattcccaatgaggccaggcacggtggctcacgcctgtaatcccagcactttgggaggccgaggcaggtggatcacctgaggtcaggagtttgagaccagcctggccaacatggcaaaaccccatctctactaaaaatacaaaaattagctgggcatggtgccacgtgcctatgatcccagctacaaggggactggggcaggaggatcgcttgaacctgggaggcagaggttgcagtgagccgagatcgcaacactgcactccagcctggtgacagagtgagactccatctcaaaacaaaataaataaataaaataaaataaaataaattgccagtgaaaaagctacctgtccttttctatcctcatctcctccaagaaaaagctaaaatattttaataaaagattttttaaaagtcacccctattgtataagaaagtgattatccattctaaaaaaagcaaaatgattgcaagggattgattacttttgatgacggcaaatagcttattcaaatactctacaccattgcacttattctaaaatacagataattaaaatgagaaaccatttcctaagaacactatggctaatactactctttctttgcttttgtgtaggtaggacaagttccttaagagctcttgccaaataatgtgttctatttagggcagctactgataccagattcacttaataagtactaatctcttttaaacagactgtatgtgataccggattaataaaataagctctcatctctcatgataaccctttgttcccgggaactttctctgcttgcctcaaagatgttatatttgaagatgtttatgcttcagaatatgtttagaaaacttctttcttgaatgggaaaggcttttctgtattgccaagcagatgtgtttctggaatgtgaaaacacagactataagccatggaagcttatgtagcttatctatagcagaagaataagagtgcctcctccttcctcttagaattcagtttaaagacaaacaaacagacaatatgtgaaggtatgtgcactctttgttgaaagtcataatacaaatatgatcctgagaaaggtgattttggagaaccaaaattggtaaattgcacacatttgtgagaatgcaaaggtgactttagcactaacggactgtccagttaaggggtggctgagggataggatgggttgttattgaaatctggcaaatctctgttggtgaagtgttttggaactcccaggaatttgtgaagctcccaggctaaatcgggaaaggggtgggggaagcagggaggtccccagcacacctgtataacttggcctacattgatctgagaagacctcctttgtattagcctgtttttatgtgctgataaagacatacccgagactggacaatttacaaaagaaagaggttgggttccaagatggccgaataggaacagctccagtctacagctcccagcatgagcgacacagaagacgaatgatttctgcatttccaactgaggtaccgggttcatctcactggggactgtcggacagtgggtgcagtgcaccgagtgtgagccgaagcagggtgaggcatctcctcacctgggaagcgcaaggggtcagggaattccctttgctagccaaggaagggggtgacagatggcacctggaaaatcgggtcactcccaccctaatactgcgctttcccagtggtcttagcaaacggcacaccaggagattatatcccatgcatggctcagggggtcctacacccacagagcctcgctcattgctagcacagcagtctgagatcaaactgcaaggcagcagcgaggctggcggaggggcacctgccattgctgaggcttgagtaggtaaacaaagcggccaggaagctcgaactgggtggagcccaccgcagctcaaggaggcctgcctgcctctgtagactccacctctgggggcagggcatagccaaacaaaaggcagcagaaacctctgcagacttaagtgtccctgtctgacagcttcgaagacagtagtggttctcccagcatgcagcttgaaatctgagaacggacagactgcctcctcaagtgggtccctgacccctgagtagcctaactgggaggcaaccccgagtaggggcagactgacacctcacatggccgggtattcctctgagacaaaacctccagaggaacgatcaggcagcaacattgttcaccaatattcactgttctgcagcctctgctgctgacacccaggcaaacaggatctagagtggacgtctggcaaactccaacagacctgcagctgagggttctgactattagaaggaaaactaacaaacagaaaggacatccacaccagaatcccatctgtacgtcaccatcatcaaagaccaaacgtagataaatccacaaagatggggaaaaaacagaacagaaaaactgaaaattctaaaaatcagagtgcctctcctcctccaaaggatcgcagctcctcaccagcaatggaacaaagctggaaggagaatcactttgacaagttgagggaagaaggcttcagatgatcaaacttctccgagctaaaggaggaagttcgaacccatggcaaagaagttaaaaaccttgaaaaaagattagacgaatggctaactagaataaccaatgcagagaagtccctaaaggacctgatggagctgaaaaccatggcacgagaactacatgacaaatgcacaagcttcagtagccgattcgatcaactggaagaaagtttatcagcgatggaagatcaaatgaatgaaatgatgcgagaagagaagtttagagaaaaaagaagaaaaagaaatgaacaaagcctccaagaaatatgggactatgtgaaaagaccaaatctacatctgattggtgtacctgaaagtgacagggagaatggacccaagttggaaaacactctgcaggatattatccaggagaacttccccaatctagcaacgcagggcaacattcaaattcaggaaatacagagaatgccacaaagatactcctcgagaagagcaactccaagacacataattgtcagattcaccaaagttgaaatgaaggaaaaaatgttaagggcagccagagagaaaggtcaggttacccacaaaaggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagacattttgtcaccaccaggcctgccctacaagagctcctgaaggaagcactaaacatggaaaggaacaactggtaccagccactgcaaaaacatgccaaattgtaaagaccatcaaggctaggaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcacgtgcagagacacacgtaggctcaaaataaagggatggaggaagatctaccaagaaaatggaaaacgaaaaaagacaggggttgcaatcctagtctctgataaaacagactttcaaccaacaaagatcaaaagagacaaagaaggccattacataatggtaaagggatcaattcaacaagaagagctaactatcctaaatatatatgcacccaatacaggagcaccgagattcataaaacaagtccttagagacctacaaagagaattagactcccacacaataataatgggagactttaacaccccactgtcaacattagacagatcgatgagacagaaaattcacaaggatatccaggaattgaactcagctctgcaccaagcagacctaatagacatctacggaactctccaccccaaatcaacagaatacacattcttctcagcaccacactgcacttattccaaaattgaccacatagttggaagtaaagcactcctcagcaaatgtaaaagaacagaaattataacaaactgtctctcagaccacagtgcaattaaactagaactcaggattaagaaactcactcaaaaccattcaactacatggagactgagcaacctgcccctgaatgactactgggtacataacaaaatgaaggcagaaataaagatgttctttgaaaccaacgagagcaaagacacaacataccagaatctctgggacacatttaaagcagtgtgtagagggaaatatatagcactaaatgcccacaagagaaagcaagaaagatctaaaatcgacaccgtaacatcacaattaaaagaactagggaagcaagagcaatcacattcaaaagctagcagaaggcaagaaataactaagatcagagaagaactgaaggaaatagagacacaaaaaacccttgaaaaaatcaatgaatccaggagctggttttttgaaaagattaacaaaattgatagactgctagcaagactaataaagaagaaaagagagaagaatcaaatagacgcaataaaaaaatgataaaggggatatcaccaccgatcccacagaaatacaaactaccatcagagaatactataaacacttctatgcaaatgaacttgaaaatctagaagaaatggataaattctttgaaacatacaccctcccaagactaaaccaggaagaagttgaatctctgaatagaccaataacaggctctgcaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcatttcatgaggccagcatcatcctgataccaaagcctggcagagacacaacaaaaaaagagaattttataccaatatccctgatgaacatcgatgcaaaaatcctcaataaaatactggcaaaccgaatccagcagcacatcaaaaagcttatccaccatgatcaagtggcctttatccctgggatgcaaggctggttcaacatacacaaatcaataaacgtaatccagcatatagacagaaccaatgacaaaaaccacatgattatctcaatagatgcagaaaaggcctttgacaaaattcaacagcccttcatgctaaaaactctcaataaactaggtattgatgggacacatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaatgaggaagtcaatttgtccctgtttgcagatgacaagattgtatatctagaaaaccccattgtctcagcccaaaatctccttaagctgataagcaacttcagcaaagtctcaggatacaaaaatcaatgtgcaaaattcacaagcattcttatacaccaataacagacaaacagagagccaaattatgagtgaactcccattcacaattgcttcaaagagaataaaatacctaggaatccaacttacaagggatgtgaaggacctcttcaaggagaactacaaaccactgctcaaggaaataaaagaggatataaacaaatggaagaacattccatgctcatgggtaggaagaatcaatatcatgaaaatggccatactgcccaaggtaatttatagattcaatgccatccccatcaagctaccaatgactttcttcacagaattggaaaaaaactactttaaagaactaaaaaagagtctgcattaccaagtcaatcctaagccaaaagaacaaagctggaggcatcacgctacctgacttaaaactatactacaaggctgcagtaaccaaaacagcatggtactggtaccaaaacagatatatagaccaatggaacagaacggagccctcagaaataatgccacatatctacaaccatctgatctttgacaaacctgacaaaaacaagaaatggggaaaggattccctatttaataaatggtgctgggaaaactggctagccatatatagaaagctgaaactggatcccttccttacaccttatacaaaaattaattcaagatggattaaagacttaaatgttagatctaaaaccataaaaaccctagaagaaaacctaggcaataccattcaggacataggtgtgagcaaggacttcatgtctgaaataccaaaagcaatggcaacaaaatccaaaattgacaaatgggatctaattaaactaaagagcttctgcacggcaaaagaaactaccatcagagtgaacaggcaacctacagaatgggagaaaatttttgcaatctactcatctgacaaagggctaatatccagaatctacaaagaactcaaacaaattcacaagaaaaaaaacaaccccatcaaaaagtgggtgaaggatatgaacagacacttctcaaaagaagacatttatgaagccaaaagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgagtatatacccaaaggattataaatcatgctgctataaagacacatgcacatgtatgtttattgtggcactattcacaatagcaaagacttggaaccaacccaaatgtccaacaatgatagactggattaagaaaatgtggcacatatacaccatggaatactatgcagccataaaaaatggtgagttcatgtcctttatagggacatggatgaagctggaaaccatcattctcagcaaactatcgcaaggacgaaaaaccaaacaccacatgttctcacttataggtgggaattgaacaatgagaacacttggacacaggaaggagaacatcacacaccggggcctgttgtggggtgggggaagggggagggatagcattaggagatatacctaatgtaaatgatgagttaatggatgcagcacaccaacatggcacatgtattcatatgtaacaaacctgcacgttgtgcacatgtaccctaaaacttaaagtataataataaaaaaaaaagaggtttaattggactcacagttccacgtggctggggaagcctcacaatcatggtggaaggtgaggaggagcaaagtcacatcttatgtggatggcagcaggcaaagagcaagcttgtgcagagaaactcctgtttttaaaaccatcagatcttatgagacccgttcactatcaagagagcagcatgggaaaaacccacctccatgattcgatcatctcccactgggtctctcccacaacatgtgggaattatgggagctacaagatgagatttgggtggggacacagagccaacccatatcacccttttagatgaaaagttgtttatacaccaatgacccctggctgcagacatggtattgggaatacacatgatagcagaatttggggttgtgatgacagaaaacataaagaatgctgaaggtcagaatatttgggttctatttccttcttttccacttgttagcactatcacaggaagcaagaatcttgatgtgcttaactctaatttttctcatctctcaacatggagaataacacaatttgctttatagacctccaaggaatgcagtgaggacaggtcatgggggaagatgaggtgagggtgctttgcgaggggactttataaacacaaggtgttgctccgtgccttgatgagtgcctgtggagcaaccaggaggccaagggattcctgtggaaagaaaattgaggtgagaaggggggccatctaagaggactttgctttatctccattggtagaattttaagtaatgagcatgttttaatagattacttgtaattttaaaatgaaagtgtacagaaataaaataggatgttttttaaggaagattaaatcagttatagaagtttaatgtaaaagaagtaactcattttttcttccgctgtagttccacaattcttcattattctgaaatccaaaaagttttgaaagcaaagactttttttcatacattttcagcaagcttatttgatcataaaacataatcttcgctaatgtgaggctagtttttatttctgtacttacactttttgtaaatgtacacagtgttaacatgctatgtaatatacaggaactaacttttgaaaatcttaaaattctgatataccagattttatataaggaatggtgcgtacctgaatatggatattaagttcatgaataaaacacatgctctagtagttttattcagggtaaatttatgagccagtagatttattcaggctaaatctatgagcctcagatctggtaatattttcgagagcataattcagtacaacaaacatttactgagcaggttctgctatggtttgcatgtttgtctcttctattgagattacgttgaaacttaatctctaaggtggcagtactgagaggtggggcctttaagaggttattgggtcatgagggctctgccctcataaatgggttaatccattcatggattaatggatcagtgggttaatagactaattgggttgtcataggagcggtactgatggctttatcagaagaagagagatgtaagctagcacactcagccccctcactacatgatgacttgtgttgcctcgggattctgcagagagtccccaccagcaagaaggccctcaccagatgcagcaccttgaccttagacttctcagcttttataactgtaagaaataaattccctttctctataaattacccagtttcaggtattctgttataagcaacagaaaatggactaagtttctttgtatgggaatataaagactagcaagtggtgattgctgctcccaaggaatttgcattgtagtggggaaaacacttctattttaatttaacacaaggtatattgagttcactgctgtaacaggatgataatcagatcacaaagatgggtgagagcccagggccgggcccggaaggtgacggaatccattctgcatgcagcaaggagggagagaagattgtttaaaggctcaatattttcagtcctttttctttctaaatagtacattgtgttgttgacactctttctgtgagcagtaagggatcctgtggattcagcattccccaaatattccccagggtgatgagacacactgaaggtgtaaagattgggggaacagcgcccgcccagtcattccaaactatggcgagtcgatagtcttccttaccagaggtggcgctgtggcagagaagacttagtgcgggggttcagaaatgccagttgcccctaagccccattttggggggtggttgatattgaaatacattggtcttaaagccaccaatagagttgtggatagtgaagaaagacactgatgattaaaatgtaattaaaaccagtttttccactaaccctattttggccagaccaagtgctgagatttaataaataagagaccagataatttttttttttatctcttggtgccttatttatatccagggtggcttatgactttagtgcttctattattgcccgccgccccttccttccttccttccgttcattctttctttctttctttctttctttctctctctctctctttctttctttctttctttctttctttctttcttctttctctttcttctttctttcattctttctcttcgtttcttttttcttctctctcattttctttctctctctctttcttcttttttctttttgttttctgtggaatctgcctctttttcttttatttccacttttatgattactagaaagccatggttccataatatggatataatagcatatctgggatgaccgtgactccagagctgcaggtagaaacagctccaggtcatgtaaagaaggtgtgtgtcctttaatggaagataatttgagcattaaaaaaaaaaaatgtccagccttccatcaaacacaggagagcagttgcagaattagcagtcaggaaacactgtctttatgatccatgacaacttcagtagctgtgtggcatgcgtgagctctggtggcctaactgaaaagccctggtgattagcagtacagcagagagaagtgcaaaggagtaacagcacaatagcataggcactggtttaaatctcagcctccagagctccaagttgtgaaagctctaacaggaaagggctgcaaactcacatcgttccacgcagagggagctgtggctcatggctctggggaaagctaatggctccttgtcgtgaccataatttcattgtagtggcagttgccaaacccaaagagaaaacggagaggagaacaacttttatgaaactatttcctctcaaacacacaaaacttgtcaacttagttagagctgtattcctcccaggggatgccatcttctgggctgtcaaacccataacatttgtgggtggcaagatgatgtcatctgtgttcggcagcttgtagtaatttccactgtgagccctgcgcagaggttgagatgattgccataaatgggatctaagcttacagatgaaagcctcacttttcgtttccattgagttcacaatactctttagcaggatgacaattgtgctgtcgtcaacattacatcatgctatctccctcgaaatggcatcattcaagcgtgtgagcacagctgtgaaaacaaaacagattttgctgtgagcttagtaaatcctcaaagcacattctaattggtttgcttgtttaaaagtaatatcaaaaatataatgtcaaaattgttgctgctgcaagtgagtcagagagaagttcaggagctccggaggccctgagagatcaggcgtgggtgctgtgactgggccctgtcagtagagcccctgtcaggagtcttgttcctgcgtggaggcccagtgtgagcttgggtagaagtgctcctgacagcccatggagcaaacgccggcctgccatgcaaattccccttagtccacaaggctggggggcacttatatcaccagctgataactatgggggaccaagtgattatttcccaatctgaagacaacatttactataaccactatcaagatctgcaaggctgagcacctttgacaatgaataattccacatctggagaagcatcccatcaaataaatgtaacaacagtatataataagcagatactgtcagctcacagtgcaaagcagaagaagcttcctgatgttggaataagtgtcagctgacaagatgtttcctagatgaacaggaaaggctgacatgactgactgtggattaaaatgtgaaccaaaggaaggtttacttcctttattctacaaatggcaaaaactgcctaactcacagaatgtgcctagttggtggctaccagaaatggctttactatactttgtgtaaaaagtgtgtcacttggacctctgagacacatactggagagtcaccggcagagagttctgagcagttcaggacttcaggttgttctccttctggacagcaggacagtgctggagctctcttagctcctcggtcttgtcttgtgttgtgttaaaaaagtgcagagaggggaataaaaagaggaagttcaccaggacagcagaaaaaaggtgcctccgtgccactgcactccagcctgggggacagagtgagactccgtctcaaacaacaacaacaaaaaaaggcgcctccttcaaagagccgtgtatccctaggcagaagccatctagttggagccagcaatgattcattcctgggattcacgtctccttccaaaatggaaggatattcggaggctcggtattgccaagtgagggaagatttggaggtggtttactttgctggggctgccataacaaagtacgcgagactgggtagctcaaacaccagggttggtttctcctgaggcctctctccttggcttgtagatgacatcttctccccatgtccccatgtggtcttccccctgtgattctgtgtcctaatcccctacttgtaaggacaccagtcatactggctgaggacccacccaccctaattgtctccctttaacttaattatctctgtagaaaacctgaggtcctgggggttaggacttctacttttgaatttgggaggggcacaacatagcccataacagagagcatcttcagagtccgtgtctcctgcagctaaactcaggcacgcttttggcctcaccggacaggattgccatggtgtgactaggaaggaccactcgagaatctcgggccaggtgcgtggctcaggcctgtaatccagcaactttgggaggctgaggccagcggatcatttgagttccagaccagcctggccaacatgttgaaaccccgtctctactaaaaataaaaaaattagcctggtgtggtggtgcgcacctgtaattccagctactctggaagctgaggcagaagaatttcttgaacctgggaggcggaggttgcagtgagccgggattgcaccactgcactccagcctgggcaacagagtgagactctgtctcaattaaaaaaaaaaaaaaagaatatcaaggatgacaccatttgggtttgtctttagagctcgactgtaaaattccatcactagccttatttgcatttaaaaactgcttatcgtcctacacaagggacaaagtttagaactgctatggaaaattttttttcctaggggaagagttaatttctcccttcacttctgccaacagaagtttccagggtgtagggcacttcttaaagtccttatgaggtcctcattattgtgtctattttgcagacaaaaaactttgccagcaagtctttggcagagacagccctgtaactcagaaattccagactccagcctcagtgacacagatgtgagcagtggtagctgctaccactgccgacgagtagctctttctggtggggtccctggagctgctcggctgaacatagcaacacaacacacctcagaaccccacgactcttcctttgatacaaaagggaggttgctgctgtgggtgtcagggtttggctggagcaacaaaaatcacatttatgtttatgaaaaattgcagagagtttttttaattgagcagaaaaattatacttacatcactgaggtttgtccatcattaaatgcatgtggtatattttatattatgtctgacctaggtgtgtgaggctgtagattcttctgtgtttaaacactgagcaaggaggcacaactgagtaaatactaggtatccaagacctgattttttatgaacttggcttcacagttctcccattattagtaagtctgaagacttaggatattacattgattttgttacctgaatgcaatcagttgttaaagtttcttaaccttttatgtttacacatatggattaaaaagagaagataaagaagataacaaagacatagccacaggagatgaaatatggaataaaggctgggtgcggtggctcatacctgtaatcctaggacttcaggagaccagtggcggatcatctgaggtcaggagtttgagaccagcctggccagctgatggaaatctgtctctactaaaaatacaaaaattagttgggcgtggtggtgggcacctggaataccagctatttgggaggctaaggcaggagaatcacttgaacccaggaggcagaggttgcagtgagccgagactgcaccattgtactctagcctgggcaacaagagagaaactctgtctcaaaaaaaaaaaaaaagaaagaaagaaagaaagaaaaagaaaaaaagaaatatggactaaaattctctaaaaaaagatttttatttctatggagttataacttcactaaacagcaaagagagaagaagagaaaatatacttgttaaatttttaaaaatatttttgtaagtttttcataagagattctgtttataagtaactttgaaattaattttattgtctttggtaccagaaattttgactcaaacaaagaaagtttggatatgtgcattaagtgaaatagatgtgttgagtgatgcagtatccttcggaagtaaaaaggaataaactgatgcatctttagacatttgaatgtcaagcactgagaagttgccttttttcagagacaggtgttaatttactctgaattagtgtacatataataagtggtaggatatttctaaatcagctatttattaaataaaatacaatagggactgtggagtctttcactggttagtgaaggtattaaagtttgctcaaacttcttaatttaaagcaaataaatttacaaatagattaattgtgaaggcagtgtccagtttacagtccatatactctacaatgcaaaaataataaaaattctaaattttcaggtttagaatgtgcaatttggaaggttcatatagtttaagagaaaaggaagggaaaaaaaaccgttgtaatcaccacacctaagataattatgcttttttactttttcattttgagacagagtctcattgtgtcacccaggctggagtgcagtggcacaatcttggctcactgcaacctccacccccctggctcaagcaattcccctgccccagcctcccgagtagctgggattacaggtgcatgccaccacgcctgtctaatttttttgtatttttagtagagatggggtttcactgtgttggccagactggtcttgaactcctgacctcaggcaatccacctgccttggcctcccaaagtgctgggattacaggcatgagccaccatgcccggcctgctctttcatttgaaaaagatgttctggtctctcaggtaaagatgtttgggttggggacacaatttatttctaaacactaattccacaaccaattctacataaataacctaagaaaagtaaatttagcaaaagcctctacttatacagaaatctaaggaagaaaatcattaaaacggcagaaagaagtcccaccttgagggatgacacagcctcccgggaagtgatgggcaaagttctgttccctgtgaatctctaggcttggagggcagagttctggaggaaagagtgggctgcgaaactcacctggggctatggtctgaatgtttgtgtccctaccaaattcatatgttgaaacctaatcaccagtgtgctggtattaggaggtgagtctttgggaggtggtgagatcatgagggtggagtgcttgtgaatgggattagtgcccttataatagaggccagagagctgccttccccttttcactatgtgaggacacagtaagaaggcaccatctgtgaaacagcaagaagacctccctagaaactgaatctaccagcaccttgaccttggacttcccagcctccaaaactgtgagcaataactttctgttgtttctaagccacccagtctggtggtattgttacagcagcccgaatgaactaagatacctggaaagctccaggtgaagggagtctaggtatgtggactgccaggatccctgttttgggggtcaatgcaggaactcagaggtccagatgactgcaattagtgaagaactgtggttctgtggctctggggagaggaacttacgcttttcccagtgtaaagatgatcctaactgtggtgatgagcagcctggtaaaactgtgcgggaggctgcagagagaggaccccccacactgaacaagaagctgctggtcctggtgggagcagcatccctggatgggggctcacagaaaggccagtctttgttgacacagtgaaagctatatagaaaaacgaggctgaacaggtagatacatatgtgccagattggaggcctggccacaacaagcctgctactaggcagagtggcttcactatgaacagaggggcaatgacacaaagttccctacgcggcacagcctgtggctcaaatgctgtccgctgtcctcaaacggatcgacggattaacgataatcagtaagcaagaacaaaactaacatggtgtctaggaaaagattctttatcatgacatcccaccagtaagattcagagattccagactcctggaatatttttgaaatatttttgaagtctatttttgaaaaatattgttggcaaaaaataaatttcagacagcatctgctttttactctccacggcattctagaaatatgatctccctaaagtaagatgaaccgtgagaggacatgtcaacagaagattcagttgagacgtaagcagaaccataaagggaagtaagggggcactgaagaagtgttttagagctgtacagataacactaaagtttcaaaatgcatcagaaccagtagagcagaatcaaccctgccaagaactatttcagtcatacagaagagagcccagagaaaaaaaatatatgccataatgcaaaaaactaatgccaaaaaaaggagaaaagaatatggggtatttcatggccatatgatggagataaaacatgtggataattggtatttatgaagaaaacaccagaacaaatggaataaaaattaatatttaaagacatataaaagtcctagaaacctaaatatttccattaaaatagctcactgggtactgggcaaaatgaagagagtcaaacactgaacataccctgatcaaagttgaaatttatttataaataaagaacatcctgaaacaaggtcatacaccaaaaaaaaaaaaaaaaaagagagagagagattggaaagggaaatatagattggtctcaaataatatagatgctaaaatcagtgaagcaaccaacatttgtagaattctgagggagaaactttgtgacccaaagttccttacatagccaagctggttttcacctgtcaagaacagagaaagcttttcaaagattcaagggctcatgaataaatagtccatgtattattcatggagggaagagctctcagagaagtaacctcttgctgctcaaactgtggaccacggcgcaacagcatctcatcacctgggagcttgttagaaaaccagaaactcaggcttcaccccagacctatgaatcagaacctgcaatctatcaagatctccatgtgatttatatgcatattaaggtttgagaaggactgctgtagtaaaccaagtaattaatcacactgtaaaaccctcaaaacagtgaagtcatagttgaggactgtagtgaacatttaacttaagtaaccatagaatcaaatattaataaatgtatattgaaggtctacatgtatgttaatataattgcagggcaattcttctggtggctttggattaacccaaccttcttcgctttttgcttatggttctcaagaataattgtagaatgtgctgagaatgcagtattctgagatggagggaactgcctgaagcagcctgggccttgctcctgtccctcctagagactgtaacaccttgagttatggaggaactgcccaggacagcccaggctttgtgcctctctccctagaagcaggatgtctttcaaagctttagcctagtatgacacattgcccctgagatatataatccagggagggctgcctttcagggcccctcagctgcggtgcaagtgaagcatgtagcttcaagactccatctctccaagcagctttcctgagccctgggagaccagctcacaagggagcctaggcttatgttgcctcttgctgcctatctgcaagtaataaactcacttcgtataacttgctgcatgtgagcatgttctgtctcactggactcaggcaagttgggaaccagtgcacagtgaacctacttcacaataacataaaatagtaacttgaaaataaatattgtccaaaatctaacataaacagagaggaagaaagggtaggtgacaggaaataaaatgagcctattgtgtcgtctagttcaaagatattcaatagagttcttaatcttgggatgttgtattcttggaattggtagacatatatattcaatgatgttcttgaagcttttaaaggtgaatgatgccaaattacaaattagctatataaaaaactatttcaaaggaagaaaatttatataatataaaaaataaagaaataaaaaatgaagaatgaatcagaacacattatttgtgaaaacaaatgtaaatgggataaactctccctattcaaagaagtaggcagatttttgtcactgaaaatagttttattactcatctttaatataaagaaaatagaaaatacaaagcagaaacatcattacacacaaagaatcattatacacaaagaatcattgtaaatgttctgatgatcatctttccaaaacacagaccaattagtttttacaaatgacaccatgctatgcatacatttttaaaacctacctattgaataagatgtgcctaggtatatattttgttgttgttgttatttatttatttttttactttaccctaagcctttttttttgtatatatactttaagttctagggtacatgtgtacaacgtacaggtttgatacataggtatacatgtgccatgttggtgtgctacacccattaactcgtcatttacattaggtatttctcctaatgctatccctcccccagcaccccaccgccctgacagaccctggtgtgtgatgttccccttcctgtgtccatgtgttctcattgttcagttcccacctacgagtgagcacatgcagtgtttggttttctgtccttgtgatagtttgctgagaatgatggtttccagcttcatccatgtccctgcacaggacatgaactcatctttttttatggctgcatagtattccatggtgggtatgtgccacattttcttaatccagtctatcattgatggacatttgggttggttccaagtctgtgctattgtgaatagtcccacaataaacatacatgtgcatgtgtctttatagtagcatgatttataatcctttggatatataccaagtaattagattgctgggtcaaatggtaattctagttctagatccttgaggaatcgccacactgccttccacaatggttgaactaatttacactcccactaacagtgtaaaaccattcctatttctccacatcctctccagcatctgctgtttcctgactttttaatgattgccattctaactggtgtgagatggtatctcattgtggttttgatttgcacttctctgatgaccagtgatgatgagcatttttcatgcgtctgttggctgcatagatgtcttcttttgagaagtgtctgttcatatcctttgcccactttttgatggcgttgtttgtttttctcttgtaaatttgtttgagttctttgtagattctggatattagccctttgtcagatgggtagattgcaaaatttttctcccattctgtaggttgcctgttcactctgatggtagtttcttttgctgcgcagaagctctttagtttaattagatcccatttgtcaattttggcttttgttgccattgcttttggtgttttagtcatgaagtccttgcccatgcttatgtcctgaatggtattgcctaggttttcttctagggtttttatggttttaagtctaacacttaagtctttaatccatcttgaattaatttttgtataaggtgtaaggaagggatccagtttcagcttcctacatatggctagccagttttcccagcaccatttattaaatagggaatcctttccatattgcttgtttttgtcaggtttgtcaaagatcagatggttgtagatgtgtggcaatatttctgaggcctctgttctgttccattggtctatatatctgttttggtaccagtaccatgctgttttggttactgcagccttgtagtatagtttgaagtcaggtagcgtgatgcctccagcttcattctttgtgcatagaattgtcttggcaatgcgggctcttttttggttccatatgaagtttaaagtagttttttccaattctgtgaagaaagtcattggtagcttgatggggatggcatttaatctataaattactttgggcagtatggccattttcatgatattgtttcttcctatccgtgagcatggaatattcttccatttgtttgtgtcctcttttatttcattgagcagtggtttttatttctccttgaagaggttcttcacatcccttgtaagttggattcctaggtattttattctctttgtagcaattgtgaatgggagttcactcatgatttggctctctgtctgttaatggtggatatgaatgcttgtgacttttgcacattgattttgtatcctgagactttgctgaagttgcttatcagcttaaggagattttggggttttctaaatatacaatcatgtcatctgcaaacagggacaatttgacttcctcatttcctaattgaataccctttatttctttctcttgcctgattgccctggccagaatttccaacactatgttgagtaggagcagtgagagagggcatccctgtcttgtgccagttttcaaagggaatgcttccagtttttgccctttcagtatgatattggctgtgggtttgtcataaatagctcttattattttgagatgtgtcccatcaatacctagtttattgagagtttttagcatgaagggctgttgaattttgttgaaggccttctctgcatctattgagacaatcatgtggtttttggcattggttctgtttatgtgatagattatgtttattgatttgcatatgttgaaccagccttgcatcccagggatgaagcaacttgatcatggtggataagctttttgatgtgctgctggattctgtttgccagtattttattgaggattttcgcattgatgttcatcagggatattggtgtaaaattctctttttttgttgtgtctctgccagtctttggtatcaggatgatgttggcctcataaagtgagttaaggaggattctctctttttctattgattgtaatagtttcagaaggaatggtatcagctcctctttgtacctctggtagaattcagctgtgaatccatctggtcctggactttttttggttggtaggctattaattattgcctcaatttcagagcctgttattgttctattcagagattcagcttcttcctggtttagtcttgggagggtgtatgtgtccaggaatttatccatttcttccagattttctagtttatttgcatagaggtgtttatagtattctctgatggtagtttgtatttctgtgggatcggtggtgatatcccttttatcattttttattgcgtctgtttgattcttctctcttttcttctttattagtcttgctagcgttttatcaattttgttgatctttttaaaaaaccggctcctgaattcattaattttttgaagggttttctgtgtttctatctctttcagttctgcactgatcttagttatatcttgccttctgctagcttttgaatttgtttgctcttgcctctctagtccttttaattgttatgttaggatgtcaattttagatctttcctgctttctcttgtaggcatttagtgctatacatttccctctacacactgctttaaatatgtcccagagattctggtatgttgtgtctttgttctcattggtttcaaagaacatctttatttctgtcttcattttgttatttacccagtagtcattcaggagcaagttgttcagtttccatgtagttgtgcagttttgagtgagtttcttaatcctgagttctaatttgattgcactgtggtctgagagacagtttgttgtgatttctgttcttttacgtttgctgaggagtgctttacttccaactatgtggtcagttttagaataagtgtgatgtggtgctgagaagaatgtacattctgttaatttggggtggagagtctgtagatgtctattaggtctgcttgttgcagagctgagttcaggtcctggatatccttgttaaccttctgtcttattgatctgtttaatattgacagtggggtgttaaagtctcccattattattgtgtgggagtctaagtctctttgtaggtctatcagaacttgctttatgaatctgggtgctcctgtattgggtgcatatatatttaggatagttaactttttgttgaattgatccctttaccattatgtaatggccttctttgtctcttttgatctttgttggttgaaagtctgttttatcagagactaggattgcaacccctcctttttttttttttttttttttttgctttccatttgcttggtagatcttcctccattcctttattttgagcctacgtgcgtctttgcacgtgagatgggtgtcctgaatacagcacactgatgggtcttgactctttattcaatttgccagtctgtgtcttttaattggagcatttagcccatttacatttaaggttaatattgttatgtgtgaagtctatcctgtcattatgatgttcactggttattttgcctgttaattgacgcagtttcttcatagcatcaatggtctttacaatttggcatgtttttgcagtggctggtaccaattgtttctttccatgtttagtgcttcctttaggagcccttgtaaggcaggcctggtggtgacaaaatcctcagcatttgcttgtctgtaaaggattttatttatccttcatttatgaagcttagtttggctagatatgaaattctgggttgaaaattcttttctttaagaatgttgaatattggcccccactctcttctggcttgtagagtttctgccaagagatcagctgttagtctgatgggcttccctttgtgggtaacctgacctttctctctggctgcccttaacactttttccttcatttcaaccttggtgaatctgacaattatgtgtcttggggttgcttttctcgaggagtatctttgtggtgttctccgtatttcctgaatttgaatgttggcctgccttgctaggttggggaagttctcctggataatatcctgcagagtgttttccaacttggttccattctccccattactttcaggtacaccaatcaaatgtagatttggtcttctcacatagtcccatatttcttggaggcttggtttgtttctttttactcttttttctctaacctgtcttctcactttatttcattggtttgatcctcaatcgctgacaccctttcttccacttgatcaaatcggctattgaagcttgtgcatgtgtcatgaagttctcgtgccatggatttcagcttcaggtcatttaaggtcttctctacactgttgattctagttagccattcatgtaatcttttttcaagatttttagcttccttgcaatgggttcgaacatcctcctttagcttggaggagtttgttattaccgaccttctgaagcctacttctgtcaactcatcaaagtcattctccgtccagctttgttccgttgctggtgaggagctgcgatcctttggaggagaagaggcactctgattttagaattttcagcttttctgttctggtttctccccatgtttgtggttttatctacctttggtctttgatgttggtgacctacagatggagttctggtgtagaagacctttttgttgatgttgatgctattcttttctgtttgttagttttccttctaatagtcaggtccctcagctgcaggtctgttggagtttgctggaggtccatcctgggtatcacaagtggaggctgcagaacagcaaatattgctgcctgatccttcctctggaagcttcatcccagaggggcagccgcctatatgaggtatctgtcaggccctactgggaggtgtgtctcccagttaggctacacgggggtcagggacccacttgaggaggcagtctgtccattctcagaactcaaacgccatgctgggagaacactgctctcttcagagctgtgagacagggacgtttaagtctgcagaagttgtctgctgccttttgttcagctatgccctgcccacagaggtagagtctagaggcagtaggccttgttgagctgtggtggtctccgcccagttcaagcttcccagccacttttcatttgactttttcttacctactcaagcctcagcaatggcagatgcccctcccccagccaggctgcagcctcgcagttccaactcagactctgtgctagcagtaagcaaggctctgtgggtgtgggacgcaccaagccaggcgcaggatataatctcctggtgtgccgtttgctaagaccattggaaaagcacggtatttgggcgggagtgtcctgtttttccaggtagtctgtcacagcttcccttggctaggaaagggaaatcccccaaccccttgcacttccaggtgaggtgatgccccaccctgcttcagctcgccctccgttggctgcacccactgtccaaccagtctcaatgagatgaaccaggtacctcagctgcaattgcagaaataacccatcttctgcgtcgatcacgctgggagctgcagactggagctgttcctattcagccgtcttgctgctgttgttatttgtttgtcatttttctgcttgggattctctgaactccttggatctgtggtttgatgtattttgttaattttgaaaatttccttgtaaatatttctttgaacaattatatctctcttctgggattgtaaccactcattgttagatcgtttgatattgttccacagctcttcaatgttctgtgtgtgtgtgtgtgtgtgtgtgtgtttttaactgttttctctgtgttttggttgggtaatttctaatatcctatcttcaagtttattgattcttttcttggttctctcaagtgtactgaagagtcagctaagtcacaatggttttctttcccctagtattttcttttttaaaaaagtgtttttaatatattttttaaatcccctagtattttcatttgactttttcttacagtttccatctatttgctgaaaatgttcatctcttaatgcatgctgacactttccccctagagcatctaacatatgaattatagttattttaaattcctcatctgatagctttaatatctgggttcttcctgagtctggttgtgttgattgcattgtctcttgactttggttgtttttatcttgttttccatgtatgtcttctaatttttgattgaatgttgggcatcaggtatagaaaaaccaacactatggtaaatagtatttatttctgcaaatgggcatgcctcctgtgctagcctattagtgttggcaatgctatattatgagatattacatcctcctgagtaaacctacttagtaattgaggtgggtttgaattttgttgttgctatggtgaccttcagtacatcactgactttaatttttctagcattactttgtgcttagggtggaggctggggttccaggatatttttctcagagctcctgcttcaccctcaattttcagtcttaccagtttgtctgtgacaaagactgggaggcctatctccatgctcttgccttctccccagaagtagactgctgttgctcgttacttggtgcttgcttggtggtggagacagggaagggagattctctcttgtccagatccagcttcagtcttaggcaagtctgtctgcctaggtcttaggaatgggactttctcagtgatcctgctcttcttcccagtgactgccaaactgcctcatatctgtgctgggtcttgaataggacagttcctcgcccctcccccacatgttggagacccctattcatattgtcatatatatgatccttgacccagaactctttccttccccttctccaggggtagaggatgttacttcttttctttttacctttttccaagctcccccaactttgccagtgccctggaaacctaaactatatttataggagaagagagttcagtcaggattttgtgaatttcctacaacaacaaccactcccattcttcaggtccacaccaccaaaggaggttcccttggtctcattgctctgcttccagactttctcatgagcatccagtggaggcccagtagaaggtcctgaatgtgagtgcaaactccctttgtgtgtggagttctcaggggtgctatactcttgtgccagcccacacttggcttttgctcttaatcgtaaagtttagccaaattcttcttacccacttgtacagtcccagcatctcttcctcctggtctctgctacagagaaatcagtgagggtgctccatctttccttggagaagcctgacttttcttggatttaaggatatttggttgccccatgccctcagctctttgatgagttcatgaaaagttatcgtgttgtagtatatccggtctttttgttttgttttgtttgtagtttatttttctgttattagggtaggggaataatttttcctgctttctacactctacatggaaccagacatggtttcaaatagtttatctcttctttacaaaaaaaaaaaaatccctaaagtctctaaccgatgaagaaatttaagcacagaacattttaatcacctgaagttatacagccagaaggagtagtgctgacattcaagcctctcagtagtctgatggcagaggctgcaccatgaaccactaaaatacaccactgtgcatgttgcacatggtctacctatgtcatttttaatttactcagtgctttcctgaggggtagcagtttgcttcccatggtttgctattataaacaatgctgcaatgaaattgtgaagttatctcccaaggataaggtcctggacctattgctgggtcaaaaggtatacttatataaatttaaaatacctactgccaaatagcaactaggaagagtcctttaaaaattacatttaaactcttcaatgacaaaattacagaagtggtatgaagacaagcttattgcaaaaattcaaatgtaaatgttagttatatgcacataacctagaaatgcttaacaattaagaaaaaactaggtatgtcacgaatatataaaatatatgtagattctattttatcatttactaccataaaatatacacaaagctattataaaaagttaaaatatatcaaaactcatgcatgtaaacacttacagaccatacatggcaccattctcagtcaagagacatataaacaaacagaaagatgcagtattaaatcataactgcattaaattaactgtagcatgtactgtactactataataattttgcagccacctcctgtagctattgcagtgagctcaagtgttgtgagtatcagcttcaaatgctgtgtgatgctcatcatctcccttcaagcagttcctctcttcaggaaattgcatatcacagcaaaaagtgatcttatggttctcatgtatttttcattgtgtttgttgcaataccaaaacctggaataataccaggggacccatacaaagcaccactagggatgctggaagggttcccaggaagcagagaaaagtcatgacattacaagaaaaaagttgaattgtttgatatgcactgaggtctgcagctgtggttgctgccatttcagacagatgaggcatcttgtaaacagatgacataaacttacggtattgataaatacagcacagtggtgcaaatgtgttttccttctgtatgattttcttaatattttcttttctctggcttactttattggaagaatacagtatataacacatgtaacctacaaaatgtgtgttatttgactgtttatgttaactgtaaggcttctgatcaatattaggctattagtagttacattttggggagtcaaaagttatacatggactttcgagtgtgtgggggtcaatgcccctaactcccacatcgttcaagggtcaatgtgtatatatatatatgtgtgtgtgtgtgtgtgtgtgtgtgtgtgtatgtatatgtatatatacatatatatagatagatacatatatatatatatatatatatatatatatatatatatatatatatatatgtctctgtgtgtctttactcctggcccactccaatcctacctctcctcctgtaccaaccactattgctgtctgccatgtataatggataggattttgaaagcagagaggagagcatttcaagcagaaagcacagcatgagcaaaggaagagagttggaaatgatacaacatgtggcagggacaataggaaagcaagcctgtctggagcagagttatgcaatgtcagagacaagtttgcaaaagtagagggagctacagaagccgggcagaggacttgtgatatgatataattggaaatacagagctattctttattttgggacagagcagtgagatgataaagctgttgtctcaagatgatcctggccaaaacaattgcacattgtttggatgggagcacatggaatcaggagtcatggccaagactctgtggagataatccgtgaaggaggaggtgaaggcctgagccacatggccatattagacatagagaggaaggcgtggaataggacttctcaataaatgaactgacacgtgacccactggaagttatcaacatgtcaaagagataacgaacttgtgtactgtgtgtatacaaggctgagtattacaacttcttaagataaatgttttataatttcccctgcttaaattccatagtcaagtgttatcatttctcccctacatacactctcgctctgttgccgccctctgcctttgtttcctcacttagctaaatcataggcctgactaaatccaactgtctactgtgtgactgaaccacacagcagaacgtacctggagaaaatccgggtatgtcaaattgacatcaagtggagcctcaaggccaccaggcattaataccaaactgccttgttttccctctcccgttctcactgtgacctctatttcagaccttcactgccctccccaaacctccagcacttcccctatcttcagtgtcagcccatgatactgctttctattacagtggaaaacagaagccactggaggggacaggtgccagctcccaccattagccacctggacccacctctctggatctgtgcccacccactgtgcctgccctcctcttatcacagacaaccactggggctccttggaaagccaacgtctgcccctactcataggcaacatcctcctgcactccctcaggccactactccagaaattctccctctgtctcctgtggcaaccaatgttttctttatttctggatcatcaaacaatcaaccatgttgacttgtctttcatgttaaaaacaacaacaacaaaaccctctgggcccctctctctcctttagttactattgtattcttttcctttgctttatgtgacaagttctcctgaagagttgttcacattcattgtttgtaattcctttcttctccctcttgaagccactccagttgggtttttactaccacctgttcaccaaaactactattaccaaagtctccaaatctaaaggtgagtgcttagggatcattacacctgaactgtcagcaggatgccctgtcaatgtaccttccaaactgagacacgtgggagggggaatggctgtgagtaatgactagatcatgtcagtaggtgtaaactgggattgtctgggggcaaaccatgatatatcagcagattcaaaacagcttttccttccgtcttttgaaacatttctactctgggcctgtggacagcagtaatcaggttttcttcctgccttcctgactactccatgccagtctcttttgcccattcctcctaatctcctggtcttcaaaacagtgagatgccccaggactcagcccttaaacctcttccctcctctgcactcactcccacagggatctcctcctgtcccagggctttaaataccatcaaatgctaacgactctcaaatttatatctggcctgcatctctgccctggacttgaatagccatctgcccactctgtgtatctgcagacttccccattgtagtatgttcaacattgagcaactctttcccaaaacctgtttcccatctcagattataacaactcagtgctcctagccactctggctgaacgcctcagtgtcatccttagctcctctctttctctcaccaccctcagcccacatctgctgagtcagcaaatcctgttggcacatacatcaaaagagacccggaacctgcttctcatcaccctcccacctccgccttagcgtgagtcaccagtatcttgtgctgggatggttgtaattgctcccggagtggtcgcctcccttctatccttgcccccttcgcattcctcgctacagctctcagagccatgctgtagaaataattggaagccagatcctgtcgtgtttcttctgaaaaccctccgatgacttcccttctcattcgtaaaagccagtgttctcattctgtactgccttcttattcattcgctctaagtcctttgcagttgctgatccctcggctggaaccagatattcacatgtgttactccctcacgtctttacttgaaagccatgtccccaataagcctatccaaaccctgacatcccatctgaaccttgacacttcatacccccttccttgccttgttttcttctgggcttctaccactggctaacatagtgtttatcttctatatcttacgtattggctgtttccccacctacaatggaagttcattaggactagggtttttgtctatttcagttgttgctgatcctcagcacctaaaaacgtgcctgacacagactagatccaataaatatttgttgagtgaattctcttgcaattaaatgcacacaatggaagaggagatgttgcagctataataagcaaaggaaaccagacattgatccttccatgtgaaatacgacccaagcttctatatataatacttcacagagtgttctgcagaggattaacaacacaagagacaccacaaataaaaaggagtccacaatcaaataagttgggaaatactgcataggatacttttaggaattcagatggtgcaatcgcaaataaaaatctctgataaatcatttaggaaataggtttctatctttttctttcttcttccattagcacttcatccagccaattcttaagtagtcttcaaggcacagtgtgttggccaggtgtggtggctcatgcctgtaatctcagcactttgggaggctgaggtgtgcagatcacctgaggccaagagtttgaggccagcctggccaacatggtgaaatcctgtctctactaaaaatacaaaaattagcttggtgtggtggtgggcgcctgtaatcccagctatttcaatggctgaggcatgagaatcgcttgcatccaggagacagaagttgcagtgagtcaaggttgcaccactgcactccagcctgagaaatagagtgaaattctgtctccaaaaaaaaaaaaaaaaaaggactcaatgtatcaacagttgacattctttcaggctgcccagcttcactggacacctttcctgcatttgtggagcctctgacctaaccgccacaagttaggatagagcatagaccattgagccctactgcagtgaggcttccattggaagctagttttgcgaagaagcaggggtcatgcaaagtccatcctgcagggcagcggttgcagaggttcccatggtcacatatagtgtcctgtaccagaggtgggataggaggaatctgcatgtcgaggtggtagcagtggtggcagtattgtgatctaatttgagcagtattgtgatctaatttgagcagtattgtggtctaatttgggcattgttcctggcttctctatctcctaaccctaaccctaaccaagtgttcctcaaacatgtctcagtcagagctcttctcttaagaaaacacctattaacttccagcaaacatcagcgttcctttggtggtctgctccacatctgtgctctcagagccctgctacagtccgccacaggcgcaccagggactgagatcctggctgtgtctcctctaatcccaggaattctcaaccctaggaagtaggacaaagccatcagtattgctttcaagacctagatgattgcaatgtgcagccagaattgagaacccccaggtaggataaacattttcctggattctgaacttggaatagtgttctgaaattcaggcagctatgaagagctggcccctaagtgctgtgagaggcatgtccccatgcccgtgtggaatgccacagatccaaggccaaggccatcactgcaggccagcgcagctgagagaggagtggaacaactcagtgagcaacctgcatcagggagaagtcttctctcctgttatgaagtccaggtgctggtgagcatcagcttctggatcagcctatcggccccgcacctggggactctgggaaaaataagaactcctgtaatagcatctagcagacaaagagctgggagaatgacaggggcatgaacgagaagagccagcacttgcacagactgaatgagctcctgggagctggagtgagtgttctgtgcactttgagaaacagcacagatcattcagcttagtggtcatgatccagtcaacaaagaaactctctttattctcctcccccctacccccgagacctcacagatcccacatggattttgaaagcttttatctgccaaatacccgaatctgttatgttataatgtaatgtgggtttttggtgcttattaattgtttagtaggctgtgttgcccaaggagcttgtgagagtagtgagtaaatatgacctttccattaaccatttcaatacactgaaaacagctctactccctgtgtgactccagcctgggaattcactttggtctttttctttagattttctctgatgagagcaatcctctagctttttctccacctctcaacaatcacatttgaatggtcacatgagctcatcaagaaaaacacagtttttcttcttctttagaggcacctaccaaggtgttctgaccaaattagaacaacaggatgtaaatgctttcagtacctcctaaaagcagtactgttcgcccaataataactcaggatgcacctgttaaagtggttcaaatggtggcatttcagtttctgaatgtcctggggttgtcttgacaatgttacaacacatttgggtcttgtgttatcctctggaggtggaaaacaaaagctgtatttttcccattcagtagccattcctcccatgtcagttcttatgtgctccctgggatgaggacagcttccaacgagaggctttgccatgcacctacagggctgctgtcggaagggagtgcagctccttgaaggctgtggatttgcaataagaaggcagcgtagaccgggcgtggtggctcacgcctgtaatcccagcactttgggaggccgaggtgagtggatcacgaggttaggagattgagaccagcctggccaacatagtgaaaccccgtctctactaaaaatacaaaaattagccgggtgtggtggcaggtgcctgtagtcccaactactcaggaggctaaggcaggagaattgcttgaacccaggaggcagaggttgcagtgagccaagagcatgccattgcactccagcctgggtgacagagtaagaatctgtctcaaaaaaagaaggcagtgtagcaatactattttgctagaagtagtactaacttctaacaatacagaccaacatacctattgccttttctgcttgggaaaggccatgattttgaggggggtctctctcaagcaagccatcctctgagggtagacaaatgtgacttttcatccattccttcatgcattcattcaacaaacaggtatcgtattagtctgtttttgcgctgctgataaagacatacctgagattgggcaatttccaaaagaaagaggtttactggacttataattccaagtggccggggaggcatcccaatcatggcaggtgaaaggcacgtctcacatggcagcagacaagagaagagagcttatgaaggaagtctcccctttttaaaaccatcagatctcatgagactcattcactatcatgagaacagtgcaggaaagaccttgtccccatgattcaatcacctcccaccgggttcctcccacaacacatgggaattgtgggagttacaattcaagatgaaatttgggtggggacacagccaaaccatatcaggtattaaatgcctgctgtgtaccagacatcacgtaaacacctctcaggccatggggcttacagtttagagggaaagtccgaggctaaacaaaattcacacaaccaaataattacccttctgtgaagggatatggggagaaaggacaagatattagtgcaggaagcctaaccccagctggaggtcagggaattttttactgagaacattgtattatttcatcgctgtacacaaattcagttgtatcttcacttttaggctttctgagctggaagccacgctgcttggcgatgggaatctaagcaggaccatgtgtggctgctaccatatgaagcaacatgtcagtcccttgggagggctgggagttcagaggaagtgacgctgagcagcctgtgtggaggggtggccgggtcatgcaggaaaggccgcatgtgagagaaggtgccaggcacagtgagtcagtttgttttggtggagcctgggaaagagatgtggttagaaagaggggttccttcatccaacacttgttgagcctcaactgtatccaggcatttgggtgctagggagagagaagtgaatgtggcaaatagcccctggccttcggggagcttattgatggagaagacggccaccttaaccagctaagtctgcaacaaaatggcatcaaatgacaaaaagtgttatgcagaaattaaacagcatggcactggtgagagctcagtgggcagagggaggctgctgcagagaggggctttgacttgtcaatgtggaaaggcaatcgccaggcactgaggaggtggcgtgggggcaagagacctgagggtgcagggagtccagtcacagaagacaggaagggaacaagcacagggcaccacacacaagggcctgagaaggggaatgctgggagggtatctagaatcatccctaatggctagaatctaggcgagcagagggcagagtggtatgggttgagattgcatctttcctgaaggcccttgcaagccaaggcaaagagctggaatttgactgtatgtgaagggaagcccctgaaggaagttaagcaaaggagtgacacgattcaattctagctgctggatgaaggatggatgggaaggacttaagagtggaaacaacattcaggaggctactgtagcagacaggaagagaaggatatggcagcagtggagagatatcagtcagtgggagctgtggctcagagatggcaatgattggacttgctgatggggagatcgagtaggaggcggggatcaaggcactgcaataaagaaaaagggtaacaaagtttacaactcagaggtcgggggtggtggctcacacctgtaatcccagcactctgggagcctgaggcaggcagatcacttgaggccaggagtctgagacaaagtttgcaactcaggtttctggtttgtgcaacagcgaggaagaactatttactgaggaggggaaatcggaggacaagcagattgctgcagggaagcacaaggtcagcttcagcacacctgcaggacaaacaagaggaggcatcctgtagatagtgagagctcagagagaggcctcggctgcaaatgtacactttggcagcagcatatagatggtgttaaagccatggctatggatgagatcacctagggagtgatgcagagaaacaaaagtgggttggaggctgagcgctgaaaactgacatcaaaggttgggttgaagagactgaggagtgacgtggggatggtaggaggtagatcagagaagcagaaaggacggtggatgcagatggggccaatggcagttgtaccaacgctgctgagaagcccaggaagatgaggaacataaagtgttcatttgacttgtcaatgtggacatcttcagtgactttgagaagacttggtgtgtggcaggtttgagagtcagagtggcatgagctgaaggatgaatggaaagtgaaatacagataattttttttttttttttgcttatacactgatgaaaatggtccagtaggaaggagtgatgagtaacttgtgcaggagagaaagagaggagctgaagaacaaagcctttgagcagggagcagggagggcatatgagattcctagggctgctgtaacaccacactcttggtggcataaaaccacgtacgtttattctcttacagttttggaggtcagaagtccaaaaccagttgcactggactataaattgtccacaggactgcaggtccctccagaggctctgagggggagtctatttccttgctttttccagcatctagagctgcttttcctggctcttggccccttcatcttccaaaccagcagtttaacatcttcaaatctctttctgcttttgttacgtcgcctccggctgtgtagtcaaatttcctactgcccctctgttatgaggacacttgtgatcacatttaggacccaccgagataatccagggtaatctctccagctcacgacccttaatttaatcacacctgcaaagccttctgccatataaagaaacaatcagatgtttcaggaattaggacctggttatccgtgaggggcattattctggaggactgggctttgctaggcagggatatactgacttgctcctttgtgggcagagggaaaggcgcctgtgcaggggtgtgtagatttggcgggggagggataagggagctcatgcttttggcttcatttttctcagaaacatgagataaagctggcagctgagaggatggcgactgacagggtggggtggggagaggagaggaggagcagtgtcagtggaagtatggaagcatctcagagagtggggcagcacactgcctaggcagaggtagtcagttttagggcaggggtgaggaggaatttaaggcttatttttaccagtgtgaaggagacatgcggcttgactgtgcgatttttctccagcagagtctggctacctggttgaaggcacagggaacccagagagacaaagctcaccagcatctgtggggagaatgtggcagggcaggaagtgaagggtgagactccatgggctgtaacttggccaagaggcaagagaagacatagcagtctgttgggctgcgaggggattgtagaagatggtggggtgggtagctcagaggtcatgatgagaaagaagcattgcagaaatgggtttcttgagcaaacagtcgaggaggtgctgggcagagtggatgccttcagattttggagatggtgcagatgctggtgatgacaagtgctagggtctcccttttgggtgtgagttactgagggaaaggtagatggagcatccacctggatgctgaagatgccaggaatgaaagacaggaaaggggtggccaggaacactgtgagccaggaaccaaagtcttcactgaaccaggaagagtgatgtggaagaatgacaggaactggcagggaagagggtgccatgcccagtggcatcaatttaaggagtactgaaggttttgtaggatttggaaggagcaatggggaaccaggaaggcatcagctttacttcctggctctgagggactccaggtgtgaaagaatgagcagccaacacttgagagagctcctagaactgtgtttcagttaaaaacgaaagacactgatgctgtaagagtgtatggcgatgcttgtgggaatttcccaacagcaccgtggaagggtttgggaggtttgaggtgttggagaacacagggattagagtttggcaataacagttattggagagaatccctggatttctagtgttgagtgagtttcacagggacacaaagcatgatgcaaccacatcacggaaggccttgaatggctgccccaggcatgactatttcaccccatcggccaaggccatggggacagtggtggcgttttggtccaagtttaagcagcaaactgtcttggtcaaaggcaggctttaggaaaattaattttccagccatgtgaatgaaagagactcttagaaagctactgcaataggccaggcttagtctccgttcagggtatgaacactgagaatgctggaaggaaatcatggttacaggaaatgcggttgaattttgagacacacgggaaaagagcgagcaatacaagatgcctcccatgtttcaagcttaagtggctggaagaacagactttggagggagattgatggttttggtgtttggcaacccatggttaaaggttcataagtggctgggcctaaggcgggagcagaataatgacaggtgagacagtgggcgcgtcccctgttgccaagccaggagttaactacctggggcttcctggattgaggataatcaaagagcaggcaggatcccggagagcaacccggtgattctaatttagcttcagatccccggggtagggctggagctttcgattaccatctgctgtaaggtgtgtgtgcaggtgcgagttatgagtcgctgggcagggatgccttcgggccattccacaggctgagttcagccatagcaggcgtgctgtcattcattttagtaaccggcataaatgagggcacagtaggaccccagtcagtcctgctaggtgccttcttgtctagaagaggccgctttgactttctttcctcttcatccctgagttgaggccgggcaggggtaaccagcaaggggttcacttgggaagcgggtttcatcacccctctgagcccaggtcgagaatcacagttgagctctggccaagaatctaactaattcaggtgcaaaccccaccgtcttttgcccgatttcctatattctgctgacagcagctctctccttcctttggcctgaaatcgcggggtgcttgtgtgagctgagattagccgaggctgacctgcccctccgtggcttcccgctggcctcatcgttacttcgtgtgttcaccgccgctctgagcagagcgggcccctggggaaaggggtgcgggcctgggttgcggaggcgcaggagcctcgcgggattggggcgagccgtcccatggcgggaaggcaggaggccggactcggaaggctctcccagactcggtccctcgctccagcccttccctgccggtgcgcggagccggggctcgggcgggtagcggtcgcgcgccggcgcgggcgggcggggagaggaaggggcgcggcctctccggggcggggcgcggggcgggcgctgcgaggggaccggaggccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtaacgccgcgcaggccggcgccctgccccgcacttggcgcttcgcggggcgtggggcgcttgggcgccgcgggcggggggtcccggggccacgtggacgccgacggctctggtctgcggcgtgcgtgctacgggcgcggggctcggggctcaggggtgcggggtgtaatactgggggcgcggggccgggagcgcggggaccctgcgggttcggggctccggctggcggggagcggggggcgcgggcgccgcggctcggggccgggagccggggactgcaggggaccgagggcttggggctccgggtcgggaggcgtgagctcagcgggccgggcactggcggctgacgtggcgctcggcggccggggcggtgcgggaggagggggcggacccctaggggacagccgggaaaagcccgccctgcgccgcgctcctgaattcaaccgcctcttgcacctcggcaccgagggaggggaaggtggggtcgtcgccctttcgggcagccgggagtccaaatgtcaccccgcggtccctgcccagcgccccaaacttcctgtgccggccggacgcgcggcctgcccgtgggccacgtgcactcaccagagcggccttgctgctgccgcggccaccggggtcggctgggacagactgcgggcacgtccccttccagaggctttaactgaaaaatagaacccaggaaggtgtggtttcccactttgtgcgtcttttgtgggataggaaggagtggtccgggcagaggagggttgctgagctaccccgggaagaccaaggtagtgcgaattctggaacccctccgcccccctgcagctcagggtggatgtaatctctgaacggagcccactggtcctcaactccaggctgtcctgtcacctccctgctgctctctcgggtccaggtcacttgttatgtgtgagatcggaaaagcccctccgttgagcagatggtccctcttgctttggttctctgggcgaggctttggtgtgggcctcgctgctgacctgagagaccctaccctggcactcatcccacggaagagcttcctgtcattcacacaagcatgtgcacagctttcctgccagtgccgggatgccccgaggaagggaagtgaccacaggccagagcagaaagccataattttaggacacaagacctttgagaggttggaatagcctgcaggttcttgttgcagaacttggtattcttccccagagctcagtagaggctcacttgggaaagggatgtagggaggcatagagaaaaggtaccctaagaaaaatggccagttcagaaattgtacctttcaaactgggagaaacgtttttctcttaaccttgtattcaggctattactgcgtttcagttcatttggagttaaatcaacttttagggccactgtgggtttattaacaatgtgtatatgaagtacattatgtttcacattcctaagaaccaactgactcgaatttttacaactccaatggtttagaaattactttgtaacataaaacaatcaggcagtattaacagtttctctttgttcgggagtattctcagcaactatttcaattaagtgtactacttaattggagcctatttcagtggaatacatctgtcgatgggttttcttttttctttcttcattatttatttattttagagatgggatcttgctctgttacccagcctgaaaccagtggtacgcagccgcagctcactgtagcctctaactcctgggctcaagtgattctcctgcctcagcctctgaagtagctgtgactacaggcgcaggtcatcacacccagcttattttgttgttgttgtttttgttgtagttggtagaaacagggtctcgctatgttgccggggctggtctcaaactcctggcctcaatcagtacttctgccctggcctcccaaagtactgagattacaggcatgagccatcgcatcccattctttactttttttttttttttaaagaaaaactgacatgcagatgtaataagtccccacagtgccaaaggaattttaagtttagaatctttgcaataaataccagctagtcctgggctgagtgagagaaaactggcacatctgggcacttggtattaagtaaattccttttccattatatgtggcttgtagacatttagctggatgcttccagaataattagctttatgttgttactttttttttttttttttttttttgagatggagtcttgctctgttgccaggctggagtgcagtagcgcaatcttgatttactgcaacctccacctcctgggtttaagcgattctcctgcctcagcctcctgagaagctgggactacaggtgcgtgccaccacgcccagctaatttttgtatttttagtagagatggggtttcaccatgttggccaggattgtctcgatctcttgacctcgtgttctgcccgcctcttcctcccaaagtgctgggattacaggcgtaagccaccgcacctggcatatttgttgacttcttgatagtctactacaaatacttaaacagagatatgtgggtttctatgatggtgtttaagttggacttttaagagggccctttcagaaaactgcagatactgcagtagggctcacgaataggctgccaggaaaggaggctgagtgggcggcgagtcaaatgggaggtcagcaggggcaagatcaagtaggaccaacaatacctggcacaacactttggtaagttgtaaggctgagagcaaggtggtgactctggaggggtctatgcaggagagggaaggaggtcctggagtggtgagctgagcgtttggagctcagatagaagactcagtggactccccctcaacacacacatacctttttccagtttcagctgccgtggagtggtgaaagcccacgtgtgattaaggggctggggcccctgtaacaaaaacatcaatctgtgtatttttgccctgcacttggcttctgcagggttatcctgctgctgtagattttttgccaacatcaggtcacaacttctgtatggccagtttgtgagtcaccctgaacctggtgacagtgaggtcaagatttggaccaggtagctttgctctacttcttggccacaggctaccttctgagtgcagctgcctgtctcagagttgggtgctgtagccgcagggccgactagatagcacctgtggccccatcacagccaggagcaagggcacgcccaacttggtgatggcccagaatggtcagttttgatttagcgcaccacaaacttatttattgtttattctcattcttaatctaatcttgtgttttctcaaaaaaaaaaaagggaaaaaaaaagcagtagcaaaacaaaaccttgtcaagattgcagaggagttctaaagttccagaatgagcatatctgatcaaagtcccctgaaggtcagaactgcccttgacagtcccttaggaaggtgccttgttggacaccgccccagtcagtcagtcagtccccactgccagcgtttcctccagcattagaactatcatggcttctttggttaaacaccaaatggactagttctcaaacctgtgcctttagacagcagggtcacacttaatgtagtcggagagatgctcatgccatgagaagcatgtaggaaccaaggcctgctgaggaacaaaaacctcacatctcccagcttgcacacacttcagggttctgtgggaattgcctttttttttttcttgtttccttctcccccgccacataaactcactttgttgaatctacagaagttaaatctgcatgtatagtttcattgtgcttttttttttgtatctgagtatctcataaagcagggattctcttagctggccaagaaagtgctgtttagggaagacacattaacttgaagcagactttttcagtgctacctttaagtctgtttttcttttttttttttttttttttttgagatggagtcttgctctatcgcccaggctggagtgcaatagcatggtctcggctcactgcaacctccgcctcccgggttcaagcgattctcctgcctcagcctcctgagtagctgagattacaggcgtgtgccaccatgcccagctaatttttgtatttttagtagagatggggcttcaccttgttggtcaggctggtctcgaactcctgaccttgtgatccgcttgcttcggcttcccaaagtgctgggattataggtgtgagccaccacacccggcttaaatcctttttttcttaagagacaaaatctctgtcacccaggctggagtgcagtggtgtgatcatagctcgctgcagcctcaaacttctggcctcaagtgatccctctgcctcagcctcccaggtagctaggactgcaggtgtgtgccaccacaccaggctaattttttaaaattttttgtagatgggggtctcactgtgttgcccaggccagtcttgaacccctgggctcaagcagctctcctgccttggcctcccaaagtgctgggattacaggcatgagccactgctaccgacttaaatgcttatttttgaggtaatctgtcagaaaataaaaggagatttaacagattattaaattattttgaggaagaagtcacaattctaagcgttgagtgttcatataagcaagtgtgtttaaaaaaaaagcattttaaaaagcgatacagcaaagtggttacattgtaggcatcagtgtgttcctgccatattaaatagcaaacaaacccatgtgtcataatgctatgggattgtagttgaaacctgggataaagtttctagggttgtctcattcaaaattcgagtatggcactgtagacatactgtccagagaacacagcaagagctgtggtcagctgtatgacttaaggtctagtgttgggaaagatgctgatatcctcatgaaatgtgaagcatggcaagaagcctagttaagatactattttaaatgatgggtgattttaaaatatttatacataactgaattcatacaatgaatactaagaatagacatttgcttacttcaaccctagaagtataggtggccacaaactttttttttccccttctcattggagaaaattgcaggtgattaaattttgagattgccttatgtttgtagccatttggttatatagtggaggagacttgacgaataaaagtagcagatacagcaggaagtgctaagctactgtccaagggaggagtagagaggctttccagaagggcaggagaagagaatgggtgctgaacagcccggggagtcagggccaacttgctagaggaagtgacacccaaactaaacctgaagggcagatagatttagctaggtggagtttagggacgaagtgtcagagagaatgtgtcccagggccaagccaagctatagtcctttgggaacactgcagatgctgcagtagggctcaggagtaggccacaagggaaggagggtggactctgggatagaagtcaagcgggaggtcagcagggccagaacaactaggatccagaacaacactttgctaagtttaatactggaacaaggccaagatttcatgctgagaacagggcagtgactctggagggatgggagcaggggagagaggtcctggagtactggtccaggagctgccatctgcaatggtgtaaagaaaggactgagagccccattgtcccctggacagagctgaagttgtgggccagctgccctgtgacctgatactcaatgtgcttgtactcttgccttgttccaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccacgtaagttggaaggaagggggcacacttcctaggtggctcctggctacaaagaaagtcctagttaaacttttggtaaaggtgtgaagagatactaaatttaagcaggcagtccctgtcattagggagaaactgcatttaatgctgtgtctgttttagatggcttttatacttggataacctttaattcatcagtgttgggttttcctgtttataagagaatgtgtttgcaagagaaaaatgacggtcccgccatgctagatgttcaccggtacattttacacagtgtgcatggactgtcatcagttttggcttgcttttgctggtgacttattcgcaaacacccttcctatagttccttcccgtgtgactcccacagggctgttcctgttggaaagaaagtatagagtctgacagacgatgatacttacttccttgacagttaagaatttttttggttataagaaatagaaattgaaatgttctcaattctagaaatagaattgttctcttattaaacagaaagaaaggactatttaaaaggctgtggaggaacctctgagagccagctccaggggcctggggtctgtttctcctgcacctcccttgagatgacggctttccaggcctgtatctctgtttgcacagaagggcccaccactgactggccctgcttggctggaatgttcgttccaggaatagtcactgtggccagggaaacaggagcttatagcaagacacatgcccattcacaccatgtgccaagtgttggagggaaaagcagttcttcaaaaaagagaagaagctgtttctgaaggaggtggagggattgccacggtcacttccttgctgtttgtttcaattgaggaatgaagtcaattctatacaatttattgcttaattgaataatataggggtccatcaataaagcaaaaaattggagcttatattcaaacctgggaggcagaaaagtggagggatctccaggcttgaacctagaagtcgtagtcaaatcccagctctaccatttacttaccacccagctctgacctcatcacttaacctgtaagtaaggtgatcccccaaacattgttacaggacttacatggaatgtgtgcagacaccaatctgagcacacccaatacatgttagggttttccctaccatttggaaatgtgggcgtttccacaaaggaccctggaattcttggtctttggtgactgcttgctaatgtaagtgccataatttgggtttactttaaatcagatcaatggagataaaattgcttactatctgtatctacgtaaaagcattaactattctatgctttatagtattgcattgaaagtatggatcaagagcatcccaaagaagcaggtagtgagcagagatgagggcgaggaggtgaatgcttacctgttgagaaactgttgctttcaaagttcaggggcagcaggggtgagctggctgtggtgtctttcctcttaacctgctgaccatctgtggcctgagactatgtgcatcacacaccatgccacagggaaggtgacacaggacctgtaatggagctgagagtggtatgtgttatggggcttcagagaaggaagtgaaggcttccacctcagcctggccataacagctgtcagctgcaatatcagctactccatagttggtattcaccaaaaaccatcacaaatttaaaaagtcacaaatgtaaaaagtcacaaatttaaaaaggcccatgttggatcatgtgtttagatttttaatgagaagagctggtctccccaagtaaaccatggctggttttgtgttattaaaaagaacaaaaatgaacgtacaccacactgaacacagtttgggaaggaacctctgtgaccatcactgccctgcagaagctccaagaacagattattttccccccgagaatgcaggaggtggaatgtgctgtgtgcaatgtggtcgcactggggcatctgtagattgacttgagcgagctttgactcctctaagacaagtgcccatcccatagagtggttgtgaggcccgaggcaggtgacgactgtacctgcctgagtccaggcatgtgtcaggacatgagctttcacgttattctttcctggcaagtgtaactggagtaaaggattggaggggcagggagtttgggctcccacgctccctagagatggctggctgtgctcaggaaaatgttttgaggtcttcctgttgggccagtcatgaatcattacagcagggcaggactgacggggggaactacctgtgttagtttcctaggctgctgtaacaaagttccacaaaccgggtggccagaaacaatagaaatgtattctctgcagtcctggaggccagaggtcctaaatcaaggagccagcagggtcatgctccctctgaaacctgtaggggaatcctcccttgcctcgtcctggctcctgttggtttcctggtcatctttggcgttccttggcttgtagatgcatcactgccgtcctctgtcctcacatgcccttctctctctgtgtgtgtgtgtctctctgtgtccaaacccttcttacaaggacaccagtcatgctagattggggcccatcctagtgacctcattttaacttgaatatctctgtaaagaccttattctaaataaggtcaccttctgagattgatggttatgacttacacagatctgtcttgcaggacacagttcaactgataacactgtctacggtagtagaactttcatcatgctgtttgccaaggcagtacctacatggggattttctccctgcagtctccttgaaaaaggagactcaaatgcccatgtggaggcttggtaatagcggaaatctggggcaatactttgtttgggcttgtaccctgtggcccagtctccatcacctccctcacccctgtcgacagtgagaattgaagtcagatgtcccaaactcactgcaaggtctggaccagaagtgtccgctctgtccctgggctctgtgaacttaccgaggaagaatctcagacttcctgggcaggttagaacgattatcagtccaacaacaagaagatggttttttttaaattatttgttttgcaaatgaatagcaaattacaaaaaaatcataggctaggtcttactgtattttacttttagcaaagacacaagtgtgaccgtccctggtcctttctgatgtcttgaggatccacccatttcccttcctgaagagcgttagcgggaggcagagccgtgcaggaagcagtttctgtttccaggtgcggaacacaccttgtgggagcctggggaggtgccaggctaggtgagggcaatcatctttgataccgcagatgttgcagttgcttatcatgttgaacttcgtgacgtagccggtgtactggccaaatctagttaagttttggctgttttttgtggttatgagagtctgagctgctgaggaagctgggtgtatattctgcactggagacacattagggaccctacctatgccccatcataccatcttaggttctgggtaaggccagtatgctgatactaatttcaaagcctaatctagccatgtgacttcattttaaggagaattagccatttttttttggactgaatgtgtgtgtaccccagcattcataggggaaatcctaatccccaatgctggcaataggaggtggggcctttgagagggagcaggttattagggtggagctctcatgaatagggttgcataccttatgaaagaggccccagagagttctgtttccccttttgccatgtgagggcacagcaagaagacaccatctgtgaaccagaaagccctcaccagacactgactctgctggcaccttgatctcagacttcccagtctctagagctaggcgaaatagattctgttgtttctaagacacccaatctgtggtcttctgttacagccgttgaactaagacactattcaaaccttcatgtcagattttacatatgttgccgtcttacaattctgataccgtacattgggcatttactcacaaaatccacatacgcgctgtagaagtggcaggggtgtttagatgagcaggcttgctaacaaatggtactctgtatttcttttttcttctattggtagtcacatttttgcctatccttgacaccttctatgaatttttatctagagtattagagcacgttttcccgtgactgctggagggatacaggaactgagtgttaatttcatcctctggtgatgtcttttgcttatggttaaaggacctactcccgtatcctctctgcagattccttcagaggccaacatttgtaggaaaaagaaaagattccttctctatgggaaggtgaatggacagcatcagtcaatgtcaaggatgttcttatagctggaaacttgaattctcacagtaactggatattcaggccttgtaagagttgaatacctgccaggtggcctggaagaataccttaattgcaaaacaacaccgtgtctgctccagtcctaatttgaacacagacaacaactgctgaagccgggaaagcataacagtagcttgcagggaaggcccgaggctgctgcagaggagcactgagtactgtagcttttgaggcctcagtcacagcagcgggctggaagttttcacctcattttagttttccttgaataaaaccagaaacttctgaaagtttaggattaactgaatgtattatctcctggaacgttatgtttgtttcctttttatcagagaggagcagatacatgcctggctgcagccccttgacagctcattttctgattgtttcactaaatgagtttgctctctgataagacaactttctttttgctctgtctaatcctttgttattctttcagcttaaagcttttcaagccaggccaagaagctgtgaagtaccagggtcctcgggacttccagacactggaaaactggatgctgcagacactgaacgaggagccagtggtgagtgtctacctccttccctccctccctccctccctccctctctccctgcctacatctttggggtaatatgtaacggggcagaggccagttgaggttaatgattaaggctgccattttaaagcaactctactttttttggagcttattggtattacaggtaaagatgaacttttacagaaactttttggtgtggaaatacctaaatgtgcacaaaagtcaagagaaggctaaaccctgagtttcagcagttaccaccattttggtgtttgtcttccccaccaccctgcgccttgtttggctgtagtcagtcttcagggaagtcacttgtgtggcctcacagataagcacttactctttgttaacactgccaccctgccactgtcacaggtaatacagttcacaactgtaccccagcatcagagactgactctggaccacctggggtcagggctgggcccagcctagaatctcctatccaagccagcactggagcctcctcccatccccccgacctttgccctccaccacctgcagccctctggctcgggcctagcccgacagctgtacccgtagggtggatccttccttttcttctcggtgctcagtccccgagtctctaatgggctttgcttataacatcattttgtaccattaatactctgtgtcttaatgcacttcccttactaaggctaatatcaggagattgtagactcttagaatattatgtactaaaaaggatttataatcctccccctccccagttgatgttggaagtcttcacttttttataaatcatcatgatcataaaccactggttaagtgttcctttgtgggtggtgccttctgattaatgccgagtgctcaggtccctggatgccgggtagacctggtgggtcatgctgctgtgttggagagggactggaaaaacactcgtgttcctacactgtaggatcctgatgagctaggaagagcatctgaagtctttgtaatttcaatttcaacaaatacctaagactaccttcttgtatcagctaagcgcccactgatttgaaggtggtctgtggtggtccttttggagctttgccgcttactgttgccagtttccagtgtgtctgtgcggctcttccgctctgccccatcttctctgatgacctaatcagaaacttggctgctgattcagtgcttccatccctcacctgcaaagactctctcaactcggctgggtgtggtggctcatgcctgtaatcctagcactttgggaggctgaggcgggtggatcacccaaggtcaagagttcaagaccagcctggccaacatggtgaaacgtcgtctctgctaaaaatacaaaaattagccaggtggtaggtgcctgtaatcccagctacttgggaggctgaggcaggagaatcacttgaacccaggaggcagaggttgcagtgaggcgagatcatgccactgcactccagcctatgcaacagagcaaaaactatcgtggaaaaaaaaaaaaaactctctgaactgtatggtggagactgttggtgtgtgatgttatgtcgttgaaccagagacttacctaactttagctaaaagaaccacagacctctcaggaaatttgcatctttgtcctggcaagaaagctgaatgagcaggtgtgactttcatagttttcaattggacattgtttcctttgtgaaaatattctctttgtggggacacatatattggatggtagcaaaccaattttaaggaggagttaatagcctcaaataaatttcaccaaaaaagccagtcttctatgatggctttattcaagaaaccagcagccagtatcaggacggcagaaagacctcatctcatggcccatttcccttagtggaggtggcggcctcacctgcaggttggaaagggctgagaggctgcgtccaggctctgcaagggactttctgtctcctcagtgtgggagcaggatggccgcgtgtaatccccccatgccaccccagaaccacagtcaccaacttgccatattttagtgtctccagcaatagcaggccccagataattgccagaaacaatgacaatgcgccttattgtggaaaagtttaagtatatacactttatactgcaaaccagaattctcttagctttttaagtgaaaactttaaaaaaagttctttatctgtatacctaagtaacttagtacatacattttttaatattcacgtgggataaatttagatttttttaagtgttgtggcaatattcaagaaactcaaaagacaatttgtcactttgtacattctactgcaatttttgtatttccatgtttgcttctgtattttttcttgaacagttatacaaacatgtttcatctcattaatgattttatatatttatgtggtctttatgttgatcatgtcttatattattttatcatgtggatttgccataattcaactctaattctgtcagtggatatttaggttatttataccttttccatcatcagtaatgatgtagggaacaagtttatctttgtaaaggactttccacccccccttcttttgagtgatatttttagaatatagtattcccagacataaaattataaggccaagaataaaaaaaaagatcatttttatggctcttgatgaatatagccaggtttcttaagcaccatatcagcttatgctgccactgtagggcaagacgtgacctgtttctgggatgcactgtggtgttcccatgccgggggactgctctggagtctgccaggaacccaggaagcaactagaggccccgcatgtgccataaatgaacacttcatactgaaaggcccttgaacatctcatggagagtggcacacggtattttatttcaccttatgtgcacccattgactgttcacttagccattcttcccttgggcattgttttgtgtgggtatttagcactttgaaagtcttgacgcgctggcagcagaagggaaactttgtggttctttatgattccagccctgcacagctttgaactgtcagcacctttaaagcctttaacaacttagcttggatattctttttaataggaatatgaacccccagataaaagctgagtaatatacacttaatgtgtctgcagcagaacactgattccattatctttccctcatttctggttactttggttggaagccacagctgtacctggtctgaaaagttgagaaatgtaggattgtgactagacagctgcacacattgctgtctgcttgggtcctggcagaagcatcttttgaaaagcccctttccccctctttctgtatgagacttagtcatatgaattacattctttcttgaaggtgcagcttatgttcatgccatggttttctctctgttgcctttcattcacctgcattttccttctcatcacctccttttctctctgatcagtcttccacagttgtgtcttcctcacagttttccctgtcatttgtgtaaagtaaggataaccaggccttcctggtccctgagtttctcattctcagctttgtccattttgctaccctcgtgtctgtttgtgtgttttttgaggaagagtctcactctgttgcccaggcaggagtgcagtggcatgttctcagctcactgcagcctccaccccctgggatcaagtgatcctcccacctcagcctcccaagtagctgggaccacaggcgcacgtcaccatgctcaggtaaataaaattttttttttgtagcgatggggtctcactctgttgcctaggctggtcttgaactgctgggctcaagcagtcctcttgcctcagcctcccaaaatgctaggctgtcacctaggctggtcttgaactgctgggctcaagcagtcctcttgcctcagcctcccaaaatgctagggttacaggcacgagccactgcgctgggcactctggtgtctgcaagtgctgaccccttcagaatacgtccattgggcgttgtattttgtattctttgtgaagtatccaagtacgtttcaaagaagaggacagggtatagggtaagactgtcctttgcattgtctgctttgtttggttgggttttggggtagggacagctatcacttggctgccctggagactcagacctagagctttcactgagggtgaggctgacgagggggctttttgctgaagcttccagagggcttgacgagatcagttcctgacctggcctcactcagcacagcagcatcgtacaagggttccaggttgttgggtgagggaggcatctgcaggcggttccccacagacacagtcacctcctggatggtttccctgtgtctccactgacacacccatgactgttttatttcctcctgttagacaccagagccggaagtggaaccgcccagtgcccccgagctcaagcaagggctgtatgagctctcagcaagcaactttgagctgcacgttgcacaaggtaagggggacgtcctgatgccagcttcagagaatcactattattccttggcgtgctgggcttttccttcctgctactcaagggctcttagatagcagcatcagtggcactgacaaagggtcactctagaggagctgttgggaccgttgttcagtgcacctcctctaaaacatgagttctccttttgtctgtgcccttatagaaacgccgagtctaatgctaagcacacgtgacccgcacactagctggacagtgcatccttggctaagagtgtttattgacagactcacctcgcttgattgctctttactttattgcactttggagatactgcatttttttacggattgaggattttggcagcccagcatctggcaggtctagcggtttttccagcagcttgtgcttactttgtatccctctgtcagcatctttttagcaataaaatattttttaattaaggtacattgtttttaaagaagtaatgctgtagcacatttcatagactatagtgtaaacataactttgatattcactagggaaccaaaaaatttgtgtgacttgttttattgtgatattatctttattgcagtggtctggaaccaaacccacagtatctcggaagtatgcctgtgtattaatgataatcatatgcttaatgacctcaggcagaaacaaaagcttctctctgtctaaacagaatttagattgggcacagtggctcatgcctatcatcccagcacttggggagaacaaggtgggatgactacttgagcccaggagttcgagatcagcctaagcaagaccttgtctctacagaagattaaaaaaaaaaaaaaggctgggtatggtaagcgcactcctgaagctgaggtgggaagatcacttgagcctggaaggtcaaggctgcagtgagctgtgatcatgccactgtactccagcctgggtgacagagtgagatcctgtctcagaaaacaaccaaacaaaacccagaatttaatgacaccgttataacatgaatcaaattagttactctttacacttaaaagatctttctataccacatcccattttttgcaaatggtctcctaatatcagaatgatccccataaaatttccagtgtgaatacataagtctccctttattcacacatagatgtgtttcagaaaacttggcccaacaccgaatgacttgaaagcaattttggcttcctggccggctcccattaccaaatgctaccatggagagaaatccccttagaagactgggttggaaacgtgagaaatggcttggattgcctctggccttgtgacttgtgcctgctgggagtcagagcccctcccccaccacacttactgtccacagtaacttatcgtgaggccttcagccttttcccacttttgctaaaagttatttcatccataccagcgccctgacggcagaactctagcatgctttccgctacgggaatgcattttcagctgggattgtcttgggctctgagcagggtgtgtttcccaaatcacctgttacggaccgactccggcaggacagaccgactccggcaggcctagccagcgcctccctaagtgggtcactgccacacagctgtgtcgtgtaggtaccatggtggcttcctgcccttgctggcttcccatcagtactctgattaggttcccagagagcctgtctccaccttacagtgcaggatctactgtgcacctgcacatggtttcagctttgcacattttttaatggaagttgttaacttttaaaggaagtttttcaccattttcttcaagtgcattgttgctgtgctgatgagacagtagctgtgagccttagtgtggcagagtcctgctcagacgccaggccacatgccactggttagttctctccccggccacagcctgctttcagtttggtatcagcccaatgtcagggtagaacagctaaacaccttctgtgtccaaataatgatgctgtgagggtttgtttgtttttttccccgtagccaagggggtgatgtttcattttttaaacttttttttatgataaaatataatacagatcgagaaaacaaatgtagggcttaatgaatttttatagcgtggtcacactgtaactactgtccagttcaagaaataaaactgccagcttcccgtgtcccatgcagggcacagcccgccctcccttctccaagaaggcacttgcctgacatttgtggaaaccacttgtattagtccgttttcactgctgatgaatacacacccgagactgggcaatttacaaaggaaagaggtttaatggagaactcacagttccacgtggctggcgaagcctcacaatcatggtggaaggcaaggaggagcaagtcacatcttatatggatatcagcaggcaaaaagagcttgtgtagggaaactcccgtttttaaaaccatcagatctcatgagacttattcactatcacgagaccagcatgggaaagacctgtccccgtgactcagttacctcctacctggtccctcccacgacatgtgggaattcaagatgagatttgggtggggacacagccaaaccatatcaactcctttatgtgcactgaagtgcacattcctgagcactatagttctatatgtgtatgtgtttatatatcttttaaggctcttttaacctgcatgttctccagacatctctttatctttcttgctgaagacataggtggtttgacctgtagagctccccgtggtccagactttgctaattgtgtccccgtagtgtggtctacatgtttccctgatttctctgtttcctggaaattggtagttgggtctggggacaaaatcagtttcagtgtgatgttttttgggggcacaagaagacctcatagctggtgggggcacagaacgtccagttgtctctctttgggatgtggtcgaccatgacaggcagagcctgggtccgtccattccttagggctgccaagtgccgaggctcattcaagcgtcccttcattttttaaccaagagaaactcaccctcatttatcacctggttattcagcggtacagtgcatataggagaggtgggagaaatgcctgattctttccttttattacagttttccaaataatgagttgattgctgattgtccatcaaagatgacaaatttggttttgagtattgttatgaagtcatgaacagaaacacatttgatggagtccctttgtaccaattaaagtgctcatgccgaactaagatttgctaagcaggacaaagatctgattcttcaattaactctctagtgaggtctgacataaattacagttcctctttcccccgtctctgccttggctctccactccaggcgaccactttatcaagttcttcgctccgtggtgtggtcactgcaaagccctggctccaacctgggagcagctggctctgggccttgaacattccgaaactgtcaagattggcaaggtgagtgaaagcccttattaaactggaaatggactgctttgggctggattaattagcagagtggcccattattcattccgtgtgcaaagtcgcaaacttgatttattaattccatttagtgtgccacttgataattcatttcaccttcacagatggcagtctgattttgagttttgctggcttttccacagcctagagataaattatggcctcggctgctttgtttattttgaagagatggccaaatctgaattggcagccccagagcccgttctgcaaagagatggggtagagccttgtagaatgttcactggacgaacttggagaccgtccacgttcgacctcacccaagagctctctctaaaaggaccctggctctgtgctcccccaagcacgcagaagaccctccctcagtttgcactgtgcctgggattctttccagcatttcctactttatacagagaagccaagagtggtgtctgacaacttctgtgtaactggattttctggaaatatccagtgtagctccagggacatcacttttattcttctacactttccagcacccaccagacaccatgcatagatttcctttcttaaaaatctcatttttctaccttgccatggggctgatttgtatccaaaagtaatgctgcgtgtctaggactgaatgatggttaacaggatgatctacttgggatggtgagatggtcaaaagcataaacttgggggttgggtagacctggctggctgaccttgggaaaaacctctccacgcctcggtctccccctttgcaaaactgagctaagatctactgtgtggtgtctgggcagatgaaagtacactgcttagtgtgatgcttagcatggggcagatgcttggtaaattgtaatcacttttgttgtcagttaaatggatatttcactgttgcctcttaaacgcttacgataatatatactaattatacatgttattatcagtttatatttattgaacatttcggggaagtaattataaaataatcttgtctactgtcttaccccattccttgtatccttacttaattattgtatgaaattttatgggagattcttttaggtttatatccatagaggatcctagcagacctaggcgtgagcagacacaagcccaggtgaccacgctgaagcccttcatccctggcacatgtggctgggttacactggacccttaaaaatgcttgtcctctcccgaccttgggctgaggcctcttgtacttcagttccgcaccttagctgctctctgacgggtcttaggtgttgaaatagtatttttacccccgtttgctgacatagtgaataacaacttagtcctgcctattttagtgctggtagaaaataaaaaagaaagcaatgacttagaacaagatgtttcatgaaaatgttgggcaagcagcagctttatgagatttaaatgaaagaaaaagcttgaagagctgtgcttgttggtaaattaagtttataaaattaaggacggattataatcttgacatctttgcagtcttacctttattatataccaactactcctgtttaaaattcacttcttgctccctgttgattttaaaaccctctaagcttcagcatgagagtaaattctaagctggcatgtgaactggtctgggtcccagtcaccgacagccaggctaacccccctcccaccaccaccaaatgtcaagccagggccctgactcaagctaccaggtgctgactttacttgctcgagttaaaatgttgcttcctaaaaaccggcatgtttaactgagctattaatacaataaatcttgcctctaaagtctttcctttactccttttagctcaggtatgttttagcatagctttcaggaacattctcttcaaaaactgcaccttgctggcagagttgctacagaatgtggattttgaaaagaatatttgtaacgtacaaagtgtccagtagccccattagcaagaaggttcatgaagaaactgactgggaagttgatctgcttttattctcaggttgattgtacacagcactatgaactctgctccggaaaccaggttcgtggctatcccactcttctctggttccgagatgggaaaaaggtacgtctgcacttcttagtactgagaattcttcatctcttaaccccatcaggctgagctactgagtggtttaatgggcacagtgaattgccaatcttgattgttagggcactggtttggagaaatgtgtataatgaaacaaacgtctttctcttaattgataagatttgggttgtggagatgaaccttgaaacatttcagtggcccaggttatcactagaataacccacatcttacagtcacagggtaactgtgctctggttgtaaacacaaaccttcaggcctttgaacagagctaaggcttgcacttggtccggttctgcctgcctccctccctccttccctggccgatggtcagcagctcagagttccccatcagcacaacggcttgctggcaggcctctgccccagacttctgtgatgtgtaaccccgtggagggaagaggggcctgtacagttctctcaccaaagccgaggcattcagttatcctctctacattcccgtctaaatatgaacatgcagactttgcaccaccgctaagacatctgggagctctgacccgggcaagcaggggttgcaggaaggcttaagtgattcagaacacctcagtggactcactcagccgcgtgcccgtgtcttggccaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaaggtgggtgcctgctggagtcgggatccccataagtggcccgtggcccccggccccccacctccccaccctcagaggcctcctcaaatgctttggacaaaatgacagtttggggacacagtcatctgatggttggctccagttgcgttttcaacacgtatttttcatcgactttcacatgctttcaggggcgaatgcaaacaaaagctttccttttgaaaacatgaaatggatgtgagacaaatcccaagacaatatttggtgtcaaaaatctctagagaatccttcctttccgcttcattcattttaaagaatgactctgctgggcatgtttctgctatgaaatctcgactgctggccccggggccctgattctattcctgaccttgctccgggcattttcctttacccgttgtaaaggcccctagaagacctgtagccaagagggcatccgcagcgatcaggccagtgactgtagctgtaacctgcctaggcagtcctgatgcactgaggggcttccttccttcactcaggtagcaggaggtttcagattcatttgttctgctttatgaagcccttgttatgtcacaggcactgttctaggccaccagggaataaaaataagaccggtttcctgcctctgaagcatacaggtctctgaggcaaatggtgagaagacacacaagccaatggcagggggctggggcagaaatgtgtgcagggcttggctgctagagagaagtgggggcaaatgggcaagaagtgtccctaaggagctgattgacgggatctgtgctggacagataggctgggcagggctgccactgaggggctgcaccaggagaggcacaacccgagaatcagccggcatttctgcagggccagagctggggctgggggaacacagtgggagacaggtcagggtgtggtgtaggatccctgagagtgagagaggagctggagttgagagtctgtgggcagctggccaaggattaggaactgtatcccatattgacagggagcccatggaggctctgtgcagattggagttgtaggaaaatgaccggcatgcacgtgtgctggaggtgggaagctgctctattaggcctttaaagatgatgcgttccctcatgctgcagccgtgactgtgcgatggcgaggaggagaaagccagcataaggagtccagccgctgtgcagcgcggagagggagggagggtccgaggcgagtctgattcccgcatatctggtggaggatggtacccagcacaggggcggggccagagctcgaggaaagggatgagcttggttttcaaggtgttgatcttcaaggctttcggctgtgtaggtggcagtgtccagtggcagttccaaccatgagcctggggctgcggcaggaggtctgcactggacgagagtgcccgtgtcatcctcttcaggtagaagtcatgcctgaaggccaggagtttggatttggaaaaaccagtggggccaccaacccctcctccctggtggggccacaccaggcctcctcacccctacaaccctgtccctagttgggctcttgtaggtcggggatggcctgagtgttgtttaaaagttgacgttttggttgaagaagtaaacagctgattttgtagttgtcaggaccacttatgttagaggagtgtatgtgtcatggtggttacaaaggtcatcccaaattgagtataattatataccacggatgttttcatcgcagcaccatttctatttataatgcagttttccaccatgaagtgggtcttttcagtgcgtgtggcgtcatgtttctggacataaagatggtagtgttccacagtggcccccttggcctccgtcactgacatgttactcgatgccagactcaaatggagcagccctggtacacttagccacgtgataaatcatcccattcctgctctcaggagagaatcgcagatccatttttggagaaacacatagacgtcattctgtaaagaactgtcaagggagaatggctttaaagcagactaccatgtagcacctttcccttaaattctccagccagagcttccatcagcgtttttcacattgacttagaacaggctgctttccatttttatgttcaatgtaaaacaggtatcattgcctttgctattgtaactaggttctttctgttgcatagagaggatgtcacaaagggtgctaggagaatagggtggccagtgagaaaagcggctgaggatgagacttcagtgggtatcctggagactccaggcttagaggtgcagactcaagtgtcagacacccagggctgcctggtccacaccacagcgccctggagagttttcaacctgcctcatccccaaaagacagtccccctccccaccttcatcccctgtacagtgtccagccacctcctcaccacatctcccaggcttgggacccagggacttgcattgatctctctgcccttcagaggctgccagcctccctttgtgtgtagcctatgaaatgcagattgtgtaggtatttctgtgtgaccttggagcctacgtaactgcatttttaaaaaattactgattcgtgtatctgcaatcccaaagcatggccctgctcaactttaagggatgtacttgaactgtggctttttcctcccttgaagggcactgtgttggcactcactgaaaataacttcgatgacaccattgcagaaggaataaccttcatcaagttttatgctccatggtaagtggctgtttaattagaaactactttgtccatgtgtactaagtcacatcatgtttttcagctcatctgccacccctccagactcaatgttgggcacatgttacatttatatgtaggtcatgttgtaggaaataaggaaccgttatcatgctcctatattcaaatattttaaacttcaatggccttaattatatatggagaatgaggctacagttatatcaactttgattatatatggagaatgaggctaaagttatatcaactttggagaaaacataaaaatggaggcaaattatgatggccatattcagttttgtggtatctgcacttttccaaatagatggcttttctttttggctaaacaatgagtgtcatgatgtagctttgctcctcggttcttttaagtactcggatttcttttgtagagaaatccagtagagtctgttagagccattcagtatgctacgcagtttcctgaacctgcatgccacgtggtcttggagaccagagcagaaatggattgcaggtagtgtgagatccagacaaccttggttctaagacttaccgtgaatgactgtatagtaaacttggatgtcctttaattcctttgaaccccagttccctcagctgaaaaatgggagtaactttttgtcttcacaaataaaacaatccatttggaaaagcagagtgttaggacaacagtagattgtttatctaaacatgataaaggcgtcacttttcttgtttgttacactccacatgttcctgagaaactaaccataggggtaaaaagttaataagcacaggacttgaacgaaccatagcaatgcctttcaaatcatttgcaacatttaaaaacctaaagctccacagatcaagtatcaaaaaggaggatcccctttggctgaaggggagccatccatacggcaggagggggtcagaagagacaagggaacagagtcgggtagaagggagggtttgaaccaaacttaatcatggccttgatgctcaccccacatcgctgaagtaccaaggaggccttaaaatggttttgaaattgtgagaccataagcaatcaaatctaaaatgtctttggcattcaagtgaccttttagaaattgtgtggcatctgccctgttccctgttcctctgctcctgtgctttcataaaccagttagcacagttcaccatggcatggaaatggtctcagaatctcaacttgttttgagactggcttgcttctgtcacattatctgaaagtctaccttggatcaacttttgggttcttcatttgggataggaggaggaagagttaatgtgcacccagtgggagaatttggtattttacaaatttctaggcaattgttgactgtcccatacagaagaaacagagcttgtcttggcagcagagtgtaggtgaatgatctcgacccaggatttcaacgaagctgccatttttctcgtcttaggtgtggtcattgtaagactctggctcctacttgggaggaactctctaaaaaggaattccctggtctggcgggggtcaagatcgccgaagtagactgcactgctgaacggaatatctgcagcaagtattcggtgggtacttggatggatgcttatgggagctctcagtatgggggcagatcccaagggaactgtgcctcaaccacgataactcactctgctctcatcttctcaacaatgtggtttttatgtccctttgagttgtttgtttggagaagcaaaagagatcctctctcaaagggaaggcattcttcttcgcccgctttgtagttagtatccatgtttcagtgcaggttttcaggccttgctgtctgagtaacaaggccgtgaagtaacagaccccacgccatagactgtggggcttcccacaccgcgactcttgatgattgaccagtggtctgtagcctttgccataaatacccgagtcgctcatttttcacacataagccagcattataaaatgcagtggctgaatctaagaatcatttcaacataacctcctttctgaaagggccatgccagcaagtcggtcctgtgcttgggttaactactgccttcattccaagctgttagcacagtctgatggcctggaagatttgtcattttttttcttctttgttattcagacacttttggagccctttagatggagaatagacgtaacccagacatagtttccttatcattaaaagataccagttgttttttgtgccctaaaattcttagaaacgagttgccactgaaacatgtatcctcaagaggatcttgctctcatggtctggtctgcagaccaccagggcatcgccagggaggtcattggaaatgcagactcccaggcctgctcaatccaaatctgcaccttcagcagatccgcaggtgatcgtgtgcacagtaaagactgaaagcgtctgctttagggtaaagtcgttcctttgaggctgatctttaatgatgtcattttgaattcagaagtgaacacacagccccacggctgtgctttctaaacagtagtctgctcctgttttaatggaatatacacctttaaaaattagccacagaatttttccagccacaacggtaggagtgtatctggttttatttaggaagcaatttgcatgtgatctggaccgctggtttgcaaacttttttcttttttgttttaaggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaagtctggtctttccttcaatgttacagcaaaacagatataaaatagacaataaattatagtttatatttacaaaaaaagctgtaagtgcaaacagttgtagattataaatgtattatttaatcagtttagtatgaaattgccttcccagtacatgattgtgaaaaagacatttagaaaatattctaaaatttaatctgagcctcactttctacaagggaaatcatgatttccgttcataaacagcatgctcatccccctaacaccatt

SEQ ID NO: 815 - DNA, 791 bp, Homo sapiens
atgccaaaaggaaagaaggcctaggggaagaaggtggctccaacccctgctgttgtgaagaagcaggaggccaagaaagtggtgaatttcctgtttgagaaaaggcctaagaattgtggcactgggcaggacatccagcccaaaagggacctcacccgaaatggccccactatatcaggttgcagcagcaaagagccatcctctataggcggctgaaagtgtttttctgtgattaaccagttcacccagggcctggaccaccaaacagctactcagctgcttaagctagcctacaagtacagaccagagacaaagcaagaggagaagcagaggctgttggcccgggccgagaagaaagctgctgacaaaggggacatccttattaagagaccacgtgtccttcgagcaggaattaacactgtcaccaccttggtggagaaaaagaaagttcagctggtggtgattgcgcatgatgtggatcccatcaagctggttgtcttcttgcctgccctgtgtcataaaaggggagtcccttactgcattatcaaggggaaggtaagactaggacgtctagtccacaggaagacctgcaccactgtcgtcttcacacaggttaactcagaagacaaaggtgctttggctaagctgggggaagctatcaggaccaactacaatgacaggatgagatccgccatcactggggagggaaggccctgggtctcaagtctgtggctcagatcgccaagctcaaaaaggcaaagactaaagaacttgccactaaactgggttaa

SEQ ID NO: 816 - DNA, 4286 bp, Homo sapiens
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccaggtaagaacagagcaattgtttttttccagtgtgtatgcaagaattggcatgggggagtgatgcctttctttgtaagtccaggccacagaccagactggaagtggcttttggtttcaaagaacagtgttcttccctttggcagaaaggtacgccttgcctctttacatgggatggacttcatataccagagccacctattcaaggggtagggaggcaggaagagggaaacattgtgtcttgtttaggatccttattgtgtgtatcaacctcagtcagtgcctgggcgtgttgaaggccttggcttgggttcgagcctgctgggagaaacaacctgcagtaggctgggtcacagaggcaatctgtgattttttggtcaggacacggaaacaaatctcagttggggtatatgtggacaaatgaaactggaaacaaaggttgctccttctgtcatttattaagccactattatattgtcagaattgtactaaacagttttgagaagtaagagaagttgaatagaatacattgtccttgtcctccggctaccaggtacaagttacttgtcactgttatttttctagcacaggtgacagaatatgcagccatgaagcaatgtgagatgaaagcacatattaatgagcagaaacaggatgtaatgtgctaagaacagaatcccctttgcatgttagtttcattaaatacaaaagaggaacaaacctggccaggagagatcattattctcagagaatagaaaccgccctgagtttataatgtccattaaacaatacaactgaaaaaaaaatcagcacagatgttaaatgatgatgaaaaattcagatttcccccctggtttagactactagaggaaatagagaagagtatacatgctgagaaattacaggctggaacttcatctgaaattagctactgagtgagggataagtggggttcacccaggaaggtcattcttatggctcagttcagagttggaggaggcttctgaacttagaaaggaaagtaaattacaacccaacattaatagcaattatctttcaagtcttgacttagatgcaatgtcttcaggacgtccttcctgacttacctacattattaactccatttgaatttcctttttattgtagttgttgttcttaagtgcataggattggtttaattttacccaatgagttcacagcacattgtaattattggcagtagtgcaagactctctcgtctcttctcttgcctccgttctcattctctcccctccctagagaatccattctaaacgtgtctggtaagtctctaagtatgagagtggcttttagaaatatgtagcattattgctctttatgtgtttttaaaatttaataaatgtcattctctgttgaatcccattctgtttcttttctcacttgacactgtgctttttgagcatactgaggtcaaaggcctcctcttagatccatgtggtctgacgtaatttaccaggcatgggttttcccagaggagggggctggttcatggttttggttttggttttccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaaggtgagctggaagctgaggtctggcggggctcaggaatgtcccccatgtgaacctggccatggctcttctttcttacaagcaattttctgctttaggataaatggttgtctgtgtagatgttctggccccagctgtgatatattatcctcacaagtcagccactgtgatcttggtctcagacccccaaggttctcagggacttcgagggctattgtgccctcaaagagaagcagtaattgtgggagtacctcagaaagtctaaatcctcctgacaggcattgacataccctgttactgatcttgggggctgagacttgcctatactttgtgttcacttgggtgatctgggaaagagattagacatagtgatagtccctaaagaatctcctgtcccagcttggtggttttctttcacggtgtctcatttttcctcccttcctagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagtgagaattagtttctagtactctctgggcctgactcaggactatactgactcaatacagagcctgtgtcacttctgcgtttatcttggtcacaacatgaattattctttcccttgatctgggacagtcacagaaaccagagtccttgggttagggtgggagaaaacatggcagatatctatcctcatatcttccaagaaatgaggagatctaatcacctcattatgtgcttccaaccctatgaactggtgtcctctaattctttggtcttagtatttaggaggcattcttatgggctgtgagaatctgtaaccgatggggggtaactccatgggtgccaactttggtttcgaagaaccttttctaaatttatttatttttctctagctagcattggatttggtgtctagtacagattctgggattccaagaaagtgctttaaatattgggatatttttactaatttaaagacctgtttcccataggagctcagtctgaatattcttggagaaagatgctgagtggcattgcagccttcctacttgggctaatcttccttctggtgggaatcgtcatccagctaagggctcagaaaggtaatgagcctgtgaggagtgccctgccacctgtcccagaccttccccactcccaccttccctaacgtcaatgatctgaggcaaggaaagctgattgtgcctctcagggatcaccgggataatttttttctgaagctagaaatgggataagcagagagagtgctgaccttgccagccatttgttcttccctcgggataatcatattgggtcctaattggggcaatccattcttttctcgatttctttccaggatatgtgaggacgcagatgtctggtaatgaggtaatgtctctttttccttgtctttgagtggcagatcattctcccggttctttggccagagggagatgacatgggggtagggaggagtaaggttgctgctgtctggatgggactgtcccctgagtctctggaacggctgtggggggtggtgaggctgcctcctgagaccttcatcactgtgcctccaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 817 - DNA, 8468 bp, Homo sapiens
gggccccagcctagaggggcgctcgaggggaagcgagtgaagtgagggctccgccagagcagcacccccttccccgccgtccctcccggactggccggttctcgtcagagattcctttgtcttcgacgctggtccctccacaccaaggtgggaggctgaggtgggaggtggcagagcggtgggagtgggagcaaggccggagcgtgggtggaggcgctggccgcgggcttgcaaggatggcacaagggagacatccaggacaaaccatggggaacacagctgccactgagagaagctgcccggaggaggaaggggctgcaaagttcaaccaccaggcaaggcaagtccacgaacaaaatcccggctctaaaaacagagcagcaattgtcactgtgggttagacgctttgagttacctctattttcatttatgtctaagataaattcaagagacaaggagaaagtcaggaggttaaaattccagcctctggtcccagctccctaaagccagctcccttcttgtctttgccaaagtttgcttctatgaatcagtaattaacccccactttttttcttatgtcagagttccttcagtcacaaccaagagagttctgactaataacacaccttttaatccagcaattttacttctgggagtttattccaaagaaatattacataacaaaagagccatatgcctcacaatattcactgtgggcttgttcataaaattaaaacaatcataactataaatgtccagtaatggaggcagggaataaactggcatatttatatgataaactactatgggccgggcgtggtggctcacgcctgtaatcccagcactttgggaggctgaggcgggcagatcacccgaggtcagaagttcaagaccagcctggccaacatggcgaaaccccgtctccactaaaaatacaaaaacaagttagctgggcgtggtggtgtgggcctatagttccagctacttgggaggctgaagcaggaaaatcacttgagcccgagaggtagaggcttcaatgagctgagatcgtgacactgcactctggcctgggcaacagagcgagtctccgtctcaaaacaaaacaaaacctacggagccttaaaatgttatatgtagggttttataacttgaataaagacttcggttataagaaagcaagacacaaaatcatatatatatataatatatatatacacacacacagtgtaatcacaatatgaaaatgtacatagaaaaaaaacacttgaaggaaatccaccaaaatgttacatctttgggtgatagaattacatacaagtatttttttctttctaaaacatttatgtatttcccaatttatctacaatgaggataagcatgtattattaaaaagtatgaaaacattgattttaaaattttacatatatagtatataattatatatacataatacatatatatatactatatatatatatatagtatatatatatatgtgaaattgctgctgaataggaaatcaccgggcctgggtgaaagatgataaaatttacttgagcaatttttccactaattgaatgatttttctgcaatttaaaaagggtatatggaagttaaagaggatgggtcaatgtttatacatctgtattagttcgttttcacactgctgataaagacatactggagactgggcaatttacaaaagaaagaggtttaatgaacttgcagttccacatggctggggaggccacaagtcatggtggaagattaaaggcactcaagagaagagagagcttttgcaaggagactcccgtttttcaaaaccatcagatctcgtgagacttactcactatcacaagaacagcccgagaaaggcctggccccatgattcaattacctcccaccaggtccctcccacaacacgtgggaattcaagatgagatttgggtggggatacagccaaaccatatcaatgtccaagatattagtgaaagggaagggcatgccacagtaggccagaggagagaaaacatctgagttttagaatacacaaaaagaaaatgatgagatcgcagctgattcttgattggtgaggacttgctggtttgtgggcagaagtaatggaacttttaatggcaaagggaagaatacactcaaacattatttaagataggaggtaagggagtaatgggtaaggttactgcatcatgaaaagttttgtttacaatgggtttactgtatttatcaggataatattttttaatcctgaagaataggtgtgcaaaatgaatttaacatcttcacatttggcccaaggttgttgataccagtattattatcttaccttagcaataggatgagtatgcttattttgggttggaaaatgcctaatgatcatgtagccccttatttggggcctattcctcttctatagggagggaaggaagaatatcaagaaagcctcatgtctaagtgccctgtatccctggagatctttatgtagcagcagagaatagacactgataaaaccaagtttcgctagtttgagaactgttcagtcttgtgggaggatctggtagaagggagaatgcagcaatatccttcaagtaatactacataccataccttgaacaaggaatgtagcataaactggtgaggacctgtgttatgataaaaggcaaagcttttgctctgggattgaaatctaggactctctgtggggtagatgtagaatttaccaagccatacacagagaggtgtgggtctgggcttaaggaaatcttgggtcattccagttcccctcccttgattcttcccctgccaggggagatcccttgctgatctcaccttgtgtgggctttttatcattgtccctccctcacctattgaaagctgtacacgttttactgggaatgaaatgggaggtgtcactaggttgagggtcagacactggacattcgtggattcacagccttcctctaacaacttgaccatctcaccaacctcaccaccctgttttccaatcactggaatagattatagggaaagagggggaaccgctcatggttctttttagacttttaaaattaaagtctgttagagccaggggatatgatgcttcagtactaggaaaatgtttggttatctacagattcttgttgattaaatgaaataagcgcaaatgtttgggttggatatgactgtgttggcatctagatggaaggtgggaactgccttgcttgatatcctgcaatttatggaatgcagtgaaatgttatcttcttaagatgtcttatgctataatgtaccgtggtttcttaatattttccacaaaaataaaagacggtggcagagaaattatctttttaaaagttattacagcagaacagaaagcaatgatctttgctttgtctaaaatcaaaacaccaacataaatatttgtatgacacttgggctcacaaaatagaaaaattttctgacccatccctaaaaagaaagaaacaaaaaaaactctagagttttttttttttttaatatatgatgaaatccagaaggtgcttttatctcatagcacccataccagaagattaatctctgtggttggtgtcttgttctggttgaaaatgcgtttgagccgagctttggaatcctcactagttagaacatctgttccacagttgttaatgtttgtttggtattacccaaaagaaggcagcagaagggaagaatttttaacaatgagtcccaagatagactagaccagcagcgttgcttattttgaaaaggcattttttttgtttttttggagcaatctgacctgtatgtaaaaaaaaatgggcaggttgttggaccaagagatagaggtccatctaatactggaatgtagcttagcttgttttcaccttctcaattttttcccaggaatatttgtttattgaattattactgcattctgtactaccagagcttagattttgaatttttagagatttaaatgtttaactcaaaataattataagcgagagactaattctacagtattaaattagaattattcaagagtaaaaaagttctagctgtcatagagagaaagtctaggtaaagtaagtaagtatattagttgtgaatttctaccctagccaagaaaagagagaactgttccttcttataggctctgtgaaacagaattaaattaatcaggaagtaaagtatctccttaatttgctaactaaggtaaggtttaagaaaaatcaagctgacctgcatctactgggtagaaaaattatatttaaggcaatactcaaattattagatgatgtttttaaaaagatcagagcacaacctctctgtcaataatgccgtctttgaaatattcttattataccttcaagagttcaaatggagataacttaaatcgattctgaaagtcacccagttaaaaaccattagacctagcatttgaaaacttcgtagaaactgctgggtattattgagacagggtctcgatctttcacccaggctggggtacagtggtgcaatcatagctcactgcagcctcgacttcctgggttcaagcagtcctcccacttcagcctcttgagtagctggggacacaggcatgagccaccatgcccagctaatgaaaatttttttttttttttgtacagaccaagtctcagtatgttgccctgggtggtgctccaaaattaaatagaaagagggaaagatcctaatccttcagaccatctatttaaaaaccgtgaacaaactgacaggactcttcagctgaaagaacagcaattccctttttaactaaagtccctttcctattcactacttcaactggtcctcacaatatctcttttaggcctatcaaagcaaatatttttatctccatattcctcagtttccagataagcaaactgaggcttagagaataatcttaccccatgtcacagtagtacttccacttagtcaactacttcagaaattctaaattaccttgtacttttctgtaccagcttctaattccattcttcctatcctccttcctttctttttccctctcatttcttctttcttccctttcctcctacagtaattgggatgcatctgtagtggtaggaattattctgtgttgttagtgttcacataaaaaatatttatacccatagtggcaggagggctgagaactattcatagaaatgctggtattaagtggcattaatatcagcccttcaattctgccttatttctttactgcttctactgaaaatagaaatgtggccaggcgcagtgactcacgcctgtaatcccagcactttagggggccaaggtgggcaatcatgaggtcaggagatcgagaccatcctggctaacacggtgaaaccccgtctctactaaaaatacaaaaaattagccggacatggtggtgggcgcctgtagtgccagctactcgggaggctgagccaggagaatagcgtgaacccaggaggcggagcttgcagtgagctgagatcgcgccactgcactccagcctgggcgacagagcgagactccgtctcaaaaaaaaaaaaagaaaaaagaaaatagaaatgtgacataccatacaaaacataaaacatcacattacatattagtgctgagcattttttatcaaacaaaaatacacatggctttgcgtatgtgttctgcaggctatttacaaaatgtcttacgcaaaacaaaacacctggactgcccagaggaaagcttctggagtaaacctgattgcagaaagcaggtattagtgaggtcagggagagcaaagacaggagggacataggggataaatggttggctgggtgggtgacctgcggcacaaaagaagttttgctgatttgcagattcaagcagcagtggttttcaacttatttttttaagcatgaagtgctttgttcagataaatttcactccaaagcataaaacaaatagcactaaagaagcagagttctttggctgaagcagggtggggaaccctagagccttccctctgaggccccactagtggcccctgtgatgggaaaagcatagcacagacttgaggtttttgtacttaaccatcctttaaaataagcaggcaaacacaatttcttaagattaaagtatgggccccacagcaactatttcaccaacagcccccaactcaagctcactccagctcagggtttcagagagaagaggcagctggccagggatttctctgtttgctggaaacctgattacctatctttaaagctgagtgtaccctacacaggacaggggtgtgaaaataggtttggcttcctagggaaatggtgggggttgtaggattgttgtgggctgtatcaagtttatccagtcctaaaacaacagttctgtttagagaaagttattctcaacctgtatccctcagtactgcactgggagattgatcatactttatattcctttaacaacccactattttcaaagcacactgtttttgcatccattgtcttgttagatccccactccatgagacaagttagacaggtattatgatcccattttacagatgaggaagctgaggctcagaaagatgaagagaatgctgcaaggtcacatgactaatacacagttctgattcccatccagagttttaaacacgcctgctgtgtacatagagcttgcatcctagggaggtagtagtaaaggccacagatttggtgttaccagctttgtgtccttagggaacatcagtgtcctcattatacagcatgtgtgataattacctgcctcacgacttcataggattttgaagaacaatgagacgatttgtaagagtactctgtaatgtgctgtctaaggattactttctcccttccccaccccaacattttggcaagttctctgtccttctattaacttggacctcacttttacaaaccaaataaaatttgtttcacattctctgtattgtgcaagcctcttactattgtcagctgctggtcagcatccacagcagcagctagctccccttttgcaccaaaccaaagctctttatctctccacatcagagatgtgagtatgcaccaccaaaggtttgtaaggctgccttacccctagtcccaagcagtgtccacagggactgtgggtcagcctgatgtcttagcgaggccttaagaggtggcagcggggaagctgggcctttgcagagtcatcacaggccagggtcttgtcttttcctttgcagaatcataacctgaatttggcaagttcactagaaggtgatcatcgtgctctgctgctaagttcagagcggatgactttgtaatgtcaaatggcaattgaattattttgtatagaagttcagaattgggtttgggcttcttatagatgggggcctcactgagaagagcaagttgcagataataaaatttgtttgataatgaaatcaaagtaaaagaaagttggaataatttagggaatatgcatgttttataaaatgaaaatattcttgttggtttttcaaactataaacattattatacatgttcattgttacaaaaagcaattcagacaacacggtaacagcagtatacacagaagagaaaagcatccatccagagaaagctcttgcttatgtttttgagtattttcctccagctatgcacctggacaatgtactagaaggccctgaaggacttctgctggtagcagatggctgaagctgtcagggcttgggggaggcacaagggtgtggaggagggttatgtcaggaaaacagctctgccaatttccttccactatggcagtgggggatgtctataaggactcattgcattcactgcctatcagtaaatacaggctctggggccattagttcttcctgaacacaagtgcctaaactgctgtacaatcatagtattcaaattctactttaaaagtccttttgcttatattatctcacctaattctcacccctcttttagatgaagaaattgagaaacagaaagtatgatgatttgcttaagaccagatgacaattatctgcagaatgaagacaatcctgacctccatcagtggatcccttcgccacctccacagtctccccattgcatggacacagacacatgacagatgcacacatatgtgcaaaacacttatacagaacacactcctccacctccacctcactaccacgcaatcccaagacagcattgcccttctctggacccagccactcggtcaacacatatttacgaacattatgctaggcactggcaataaaataatgaacaccagaagacacagttcctgagtctcacagagatgacccaggatcattcagagtctaggatgaggcagggattaggtggggatgaggatgataagagcagcgttggggaagtacaggataagatgagaacacacaccaagggcacctaactttttctctggaggaccag

SEQ ID NO: 818 - DNA, 47538 bp, Homo sapiens
cctcgtcccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtatcaggggcctagcagtccctgggccccaactcgcggctccaggattgggggtgtaacttgagggatggcactttcctgtccgtgtttccccgttcttaggctaattcaaaaatcgcttctaggtagctgatgcccagcatttgactttcctctaataaaccttgggtgagagatgttaagaccgggtgttaaaatatatgaattccagaaatgctccctttagcatttctttccatctcatttttaaggcctattgaactttcttccttaaaagattcccttaaagaaaatcatttatactctgtagtacccagtgtcaaccctctactctctaatccacacctccaatttaattggatttggagtgctgccaatgtctaacttcattgcttttcagttttaccaatattaggactgttggttaatacggtccttgtcattggaagagctccattacaggttgaacggccatttgccaagggagttgtagaaagaattgctgtgataaatgagaggccccttctgatatttgggattatataaaaaagaaactttaacagaatgtggtttattcggttggttagaacagtctttactgagcttcaattttggttggtaggcgcatttaacatttgagtagctattgaatactaggtgccagtggtacagaagtggtcgaaacagatagggtcactgccatcattcatgattcccctctcaccctgcttttcttaactggtatctgctcattcatcagaactgtgccttaagagcagtaagtaggatccatgaaggaagacttcctttggaaaattattttaagctgaactttaaaggatgagctataaacaccttggtaagggaggagggggaatagcctgtggtagtagtgaacactgagaatttcagggccatagagagaggtccaatatggttgggaataaggagccagagcaagggggtcagcaggggcaggccagatagtgtcttgctgaccatgttaaggatttgtttttcctgaaagtgtaggaagccatcagagggttataagcagttcagtgatatgacgagaatattcttggtagctgcattaataataacttgtgcaggtagagaagtgatggtaagatgttgcagagcggatgtggaaggctgattaggaggttattatggtggtctagacaagaaatgatagtggcttagagtagagtgatagcagtggggtaaatgaaaagtgaaaggattggagagaaggtagtaggtagaatcaacaggacttggtaatgatttggctatagtgggtcagggaggggaggccaaggatgacccttaggcttacttaccttcatggattagcaccaggggacagaaaagaagatagcaggaattgtgataaaaagtataagccgacattttctttgtttgaatttaataaacatttcctggatttttgtgtatgcagactcagtgattagtgctaaggatactactacaatggctaacaaattagcatctgttatgtgtagacagtatgttaagcatttcaggtatgttctcaggaaagcccgatatgaaattgttatagctcttactccttttttactgatgaaactgaggtttagataggctaagaaccaagggcataaaacgtagaagtagctaaatcagtaacgcagtcccaagttaaattcttaaccactttattatactacctcccagagactgactttgatctcagagagcttacacagacatatatagtcataaaatgttaaatgtgacaataaaggtacacactaggtatagtgctggcaggagacagaaggatcatcaggggacatttagctgaggagctgatgttagaggtgagtctgcaagataagtagccgttgctctacaaggcggcagaggagagaagaaggggccccaggcagatatgttcatgacagttccagcaggcctgaaattagcctgagctatattgctaacatttgtgcatggcattgaaaatacactgaataataatagttttgtgactatagttatatttattaatagtcacaaaactattattattagctttaatatgaagctattataatagctttgtgactgtgagtccaagggctttgggggcagtttgtaccagtttgtcaacattatttattggtaacaatgagattgatgatttgctcctggtcttcatgagaccacacccccaacccagagctctgttgttgagactagctgcgtagcaggaatatgcctatgtgaccagcaaaatatttaaaaatgcaatcaggactctattttgggttgcttggttccagggtgttttctttgcacacttgggtggttccagatctgagagagtatatgtctggccacacacctaacaaagggaagccgaaggagcccacacctgaccttttcagatctcttgctgtgaggcagcctttggctgtaatgttttatattcttttccttttggggctcttttcagtcccaagttaaattcttagccactttattatactacctcccagagactgactctgacctcagagagcttacatagacatatatagtcgtataatgttataaactgtagatttataacataacctacagtaataaactgtagatttgcaaacactgtcattttgatccgtgtgattctttagcaaaccctgttgaactgcactgtcagtgcagatgtaaagcaaagacttgttcagagaatttctggtagtctggtattttaggaacatagaacgagtaagggtgtgaataaaagaggttctgaagctacctgggaggaagaacatgtgaatagtataccattgttaagaggtttagatttgtctgcaggccacaggtaattatcaaaaagtttttaagtgattgctcaatggggaatgaggaaagatggggagatgggcaccccttcttcccaggagacattcggcatcattttaggagaagggcagctacctgcatctagtagttagagaccaggtatgctgtttaacgtgtcacagtgcacaggaccatacagcctcctacaacacagaattattcagttcaaaatgggaataatgcgaggttgagaaaccctgagttcgagggagaagatattgggtagtgggaagaccttttaggaagttgtggcaatagtcctgtctggattgtggtttcggaatgcgatgaatttgagaggggcaaaaagattgagagatttgtgtgatcatatggatagatagggacagttagtttgggatgatcctcagtttcaatagtaggtgattggacaggtttaaagggatactgttaagtgagattacttgttttaagtttgatggaagagaagtggggtgatgataagttctggtgctattcggtttgtatgtatgtgtttgattattcagaatacaatggtcaaatacgtataattcagtatagcaaaatgaagttattttcacctggagaaaaagttactgactttttggtgaggatggggattggtaaatccccaattgataagacacttttatatcaaaacattttatctgtatattaacatttacatatttttacagtttcataagtgcataattattttcattagattatcaaaatgatatgtaacatagttcattagtcatcttctctcaagtgagaaaaggtcacacagatccttcttttaaatccaaagtttgacctagaatgtcaggatgctaaccaagagagttcaaggttgaaaataacaatcttgtgctccccaatcacatggtggtttgggaacccttcattcaacccaatgtgtatacgttcactctgttcacctctctgcactccctctttcttcctactcagttctttctcatgtaaggaagcctttctctttaatcctttcccccttttgtctcttacaatacttatccagttaccgcaggaaaaatctctccctcctctgtacaacccaaatggctggaattgtaactgattaagcataagccgtggaaagtagttccacagttctgttcagactcatatcacctacctccaggcttccattcagtatgtttgccattaagtactggctttctagataaacagacttgttgtccttcatgttattttgtttttgctttaatcacaagagtttcaacaatattttatttaatcagttacgtgtctctcctcaaaacaaggttgtaaatgattatatacttttagaatagcccactccgttactcaacttatagtgtagttcaaaacaaaatgtatatcaaattccatataactgactataaaagaacttaataaatgtaatctatttgtaatttggcagtaaaatgagcttaagttctatgatagaagtatgaatggggtgtaatcctaaggattggcctaccttgttacttcactgtgtgtgtgcttggatgatgctaataggaaagtgggttagaaaattttcagaaggaaaatattgcaggcagtaagcttagaggttaagaatatgactttggagttcaagttctgcctttcccacttaatttagatgaacagtcttgaatagttcgcttatttaacatcagtttttcagtctgtcaaatggaaggaaaaaagtatattgtagggttgctgggagaattaagtgatctaatagatctccattaattagcacagttgtctggctagttcaaagtgaataaaagttggagaatacttgttcagtttctgtaaagtttagttgaagtaaaatctcccaagttccatccactggtgaaaatttaaaaagatagtaaaagtcctttgcccatcaccttattgccattttaataggaaatctgattaaatctgattaatttttcacacttttcacagtgatttttcttttttaatctcttacaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccaggtaaataaaaaaatcagcaatataatgttggtatatttaaaaggaggaaaaaagcataatttaatatcatgcactaactgatgagcatggaattttgagactgacagtctttaaaatctatcttaattcttacatgtaggcatttcacagagaacttcagacttttgtagtgaaaaataatgttgaaagattttatgaacttttaattgtaaagagaaagaagcattaaaataaggaggaagatcactaaggtagaaacatcagtggtaaaagaaggttgggaaggctgagcagtgttccaatcttctgaagcattttctttaatccctgaaggaatgttgctgtcatactcaggaggctggtgtaactggaagcaaaatgatgcctaaattagtagataaataataccatatcatagcctttataccattacttagtgttactcaagctgctgtaacagtaacttgtgctgtaactttaggtgaaatattgaagattaatggtaagtcatctcacaaaaatagttacaaaagctaaattcagatttattttggagacatagagaaagcgtaaaaaatttaaacccagtgaacaactattgcttaggtgatgaggactgttttatttctagttcaaatacagcaaaatccaaaatgcttcaaaatccaaaacttttttttagctccaacctgatgacacaagtggaagattgttacatctgatctcatgacacatcattgaaaatatcatatacagttgccttaaggctgcatgtataaggcatatatgaaacataaatgaatttcatgtctagacctgggttccatcacaaagatatctcattatgtatatgtagacattccaaaatcagaaaaaatctgaaattcaaagcacttctggtcccaaacattttggataagggatactcaacctgtatgggcttagatcgtatctaaaagttactcaattaggcatgaaaaagaattatttaccacttattcgttaacatcttaaactggtattttagtgttcccaggttctatttagtctcttggccaaagtcatggtgaaagaaacagctttaagaatgtgtaaaagccttaattcataaacctgttgttagaattagcaagatatattcaaatactcttaattttagaaatgttctctttattttaaggtcttgtgtgaaggacaccttgctttgtaaaatgatatttctttggggccattaccttaacctgtatccattccttcatgaattttaacttgtataaggtggcttgttctaaaaacctaagtgggtaaatataagaaatgaatggtaataaagcagttagtatcatacccgtctttatccatgctacattttttatttttctcagtcttatttttctactttcaaaaagataatgtatcatataatagggatcattataaagcaacttttcatactttaaaattgaaaattaccagctagtaagttcagaacaaaattaccagctagtaagttcagaacaaaattaccagctagtaatgcagaataaatgataaaagttttactctcaccattttttacctgttgataaaatgatggatttagagtaggcaatgatcagcagtcactactaaaaccattaagtaaaaggctgatggggaactttatactgagtggatcagactgaatgatcattcacaaatggagagataactagacattatgtgccttatcataatatgcagtaagaagtacacaacattgactactagacgttcccacccagaacattgcacctgaattccatcaagtctctagctccaaatgccagtttacaagaaatacagaggataaaggaataacatgggaatgcaatcaacaaaatccaggacgtgggaaatgccacaggataggggttgatggcaaggaaaaaaggaaaaacaaggaagaaagcctaaagattaatgaacacttacatcagccaaatgattgtgttaaccttacttggattcttacttgaaaaccaactttgaaacaataggggaaatttgaacactatttcctgactttaaggaactgttttagattatttcatgtgttataatactattggggttatgtttttaaaaagtgttatcttttagaaataaagtataaaagtatttgtagctgaagtgataaaatatctgagatttgctttaaaaataatcggggaatgtagatgaagcaagattagccatgtgttaatctttgttgacatggtgggggttcattgtacttttctcaatacttttgaatatatatggaagttttcactgtaaaagttttttaaaaatcacatctcaggccaggcgtggtggcttacgcctgtaatcccagcactttgggaggccgaggcgggcggatcatgaggtcagtagttagagaccagcctgaccaacatggtaaaaccctgtttctactaaaaatacaaaaattagctggatgtggtggagtgcacctgtaatcccagctactcaggaggctgaggcaggagaatcacttgaacctaggaggtggaagttgcagtgagccaagattgcgccattgcactccagcctgggtgacagagcgagactccatctcaaaaaaagtcacatctcaaaagttgtagaatgcatgtaatttaatttctgtgattttctctaatccagtagttcttaacccataccccatggacaggcttgaaggagttcctaaatattctgcatttgggtcaactccttgcctttatgtgtactttccaggtgaagaatccttgggcaatatgccattttgagaatatagagaaagcaaatcctagaagcacatctctctctagctcctcatcacaaattaggaatcattttagcacagttttgcaaatttttcattcctaggggcctgaacaaagcaaggacaacaaaaatatttgactcttctaataggttaatgcagtttgttggcctcataatttcttacattttttaaaagcacttttaatagaatattttaataattattcctttcatacttactttggcagaacttcattaaacattattttctaatttctatattccttaactaaaattaaaacaaacttagatttgtttttaaaactcttaatacaggcttgttgcataaaataataataaaacatatattttaccactaggattaagtttgcagcagtagaaaaatattaaaccatggtatacaaaaaaactagtcatttaacctttctcaaaacagatggtataataaatgtataaaaaggcaagctgttatcagctaaaggctcacaaattgattacacagtgaaactgaaacttgcatcctgttgggaacatacatattggtttagttgactggcatgagggaaaaggctgatttaacaaatagataaatgtaaaaaaacaaagtcattcctattctgatagatccctttcagatttaaaagttactaacgattttgatgttgtggctgttttaaacatagttcaaagaactttgactaattcagcttttttttgtactgtgctttgtttatttttatagatatttgggctttgacttatattctcattggtgagctcactgccattttcttcctaattcttctttaaagaacttgggctggaaattctgtagtcaccaaccttagctgataagtatttctgctattgttagcttagtgttccatctgcccccttactgatgccatggctgtgacatctcagttggggaaaacagctgcttcatgagatctctagccttaacagttgtcccagtgaaaatgagcaggggggtttcattgcaaagacaactggcataaatgtatgaatgaatgccagattagtagcatgttagtcaaaagaggaattgagatcaaattgaaagaaaagctgaatatgatagatgaagtctacagaaagtatcacacatactgactgaaaatatttctctgcagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacacgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaacaaactgactttacttgtttctgtcaggatttaaatctttctaaagctccttataaacttaaagcctagagtacagttctgtaatgagagtgattatttatttggtattttattaaaatatctgagggactgtccaagaaagaaggtgaaagagaaataccacgtctgtactgcctaatttgtaaccttctctttgcattccttactgaaagtttgtgtaggtgaaaagcagttaaatcatcagttgctctaaagaggtcttaatttttaagtaaattacctttagtttgtatattacccagttgtatcagtgtttttcttaataatgtagtcagaggggacagtctggttcctgggcataattctccaaaaacaacagggaaataactataaatataggttaacatttattgaatgcctaccttgtgctaggtgctgtgctgagtatttgtattgacacatttaatctttgcaatgattctatgaaataaaggtattatttccattttacagatgaggaaactgaggaatagaggggttaagaaatctcatatcacacagtatattagcagagtttgaatatgaaccatagcagtctggctccagagccctctttctcaagcactatgcaatattgccttacaaaaaaccaattaaggatagatctctgaaggcttagctatcttgatttcactacagctcagtagcagttcagtgctttggctttggagtcacagccaagttcaagtcatggttgtgtgactttggattttattaactatatatttctgttttccatctgctgctaaggtgatgccatctggtataatgagaatgaaatgagatgtttattaaacactgaggatcagtgcctagcatatacaagcacttagtaattatatttttatcattagtctaattctggtctcttgatctttctttagttcctaaagtccttactatggtttctattcatgtggctcttacatgaacaatacatgacacaaatatgatagtgtttgaatgtctgtcatgcacataatagtctgctagaaatttcgaaaatgaataagactggctgggcacggtggctcatgcctgtaatcccagcactgttagaggtcaaggcgggcagatcacctgaggtccggcattcaagaccagcctggccaacatggtgaaaccctgtctctactaaaaatacaaaaaatagtggggcatggtggcgcattcctgtaatctcagctactcgggaggctgagacaggagaatcacttgaacccgggaggcagaggttgcagtgagccgagactgcaccactgcagtccagcctgggcaacagagcgggactcggtctcaaaaaaaaaaaaaaatgaataagacagtagtctcacctccaggaacataacctagatggtgtagataggatagctgtatgagcaactaatgttacacaggtaatgaagcagagtggactctaagggtctaagatatttacagggtgctagaggaagaagagaatatataggtccaaagacttatttcttagggagttttacatcatctccccacagcagaagccctggttatgtgactatgccagtaattgagtggtttaatctccagtttagggatatgggtattaaccagtccctgttgctacagattgaaagacatattctttaattttgctaacaataaaggtgatgtttgatctcctgagtaacttctccatctcaggagtttccaaattctggaggaaaatacaaggatgttatcctatttttatcattaggaatcagcttccttgctgaaatttagatacaaaagtgacactggtctggcatactctgtttttagtgctggatgattcctaatgatcactactattttgaaaaggcaacagcataagaatttgattaataatgaatggttcaaagaacaaagtctacccagaatttcatcattcgttttggtgtatttcagttatttttatagatatttgtgtattgtttaaagaaattggtattgtactgtctataacaaatttttacacttttacatttgtgaaatctatcatatagaagagagcattcagcatgtacaatttaatgagaaataaagttataaaacagatactcatatacccaatgctcaggttaagaaatgtacattgccaataccttagtaagctcctatgtatcctttcctggtcagtttcctgaatcaccccaagagagagaaccaatattctgcttgtaatgcaaataatcttttctttgtatttttaccaattaagtatactggttgtcacactttttaaaacataatttctaaaccatcataaaatgatacttttgtaaatacaaaatcatgtacttgaatgcattggcactgtcagtttactatcagcatttctaaatgtttatgcatgtttgctcactttatgtgcttatctctccatcagccaatgacagttgatcaatatgggatcaatatgggaccacacttcgagtagtactgatgtctacattccttaaaaatagtctaaacaggtagaagtaaacattaataaaatttaataaagtattaaattctatttaataaatagaaatgtcactttttttgtgacttgctgaacatttagtgccatccctgatgatgcatatggctatagtttttgttactgtgtttattattaacataccaccactatgtatttcttccatgaaggcatttggatcattctaccttttttgctattttgaacaaagccattatgaacattcttgtgtatatatgtcaggttgtacatgtgtatgatctcttgagaatacatccagcaatggaattggtgggtcataggatatgtatatcttcaaattaactaggtaatacctaacttttccaaagtaattagtgctttcaccagcagcattaaaaggttccacatttggtattgttagactaaaactttggaaaatctaggcttgtaatggtacctcgttgcttaatttgcatttccatgaggttaattattttttctacaaatttatttaccatttggatttcccctttttgcaaagttgctgtttaaatcatttgcccatttttaaaaattttattgactttttggttaataaaattccttcatatactgagactacttaatcatttggtaataactatttcaaatatcttctcacagttatttatcgttctgctcctagtgaaatgtatccatctttttctctattttttggtgtttttgtgtcttatttaaaaaatacttccctctccttaggtcatgaatatcttctgtactgtgttctaaaatatgtgtagttttgtcttccactcaaattgaattttgttttgtgggtgaggtaggtatccaggttctttttttttcccttgtttcttgaaaagtcatctttctcatttggttgaacatgccatttctgtcatctgtgaaatgctcatatttacatgagtctatttctgggctctcttttattccattgatcaatttgcccatatatcagtaacacactgtcttaactactaaagcttttaaaagtcttgatatttggtaaaataagtctttttataccttgttcttcaagattttggctgtgatcagttctttgcacttttatacaaattttagaatttcaacaaaacaaaattgttaggattttgattgggattgtattgtatctgtgaacaaattctttatagtagtgcattttttggtgagttaatgttgtctttccattgtatctttgaataaagtcttaaaattttcttcatagaaatactgcatacatatattttgttaatcttatatctttttgtttttgatgctatcataaatgatatcttttaagtttttaattttttgttcgtatgtggggatactttttaaattgatttttctattcaaccttgcaaaaatcttttttaaagtttagtaatttatctgtagattcttttggactttctataagtaatgacaaatttgtctttctattgtccttttctttttcttgcctaattaaatttgcagggacctccagtataatgttgaataggtcatgtgtaggcattcttgttttgttcctgttctctgggaatgctttcaaagtattctctaagcattttatgatacttttattaaatttagaaatttcccacctattcttatttgctaagagttttttataatcataaatgatataaaattttgaattttcaaaaagctctattgagaaaaatcatgatttttctgcctttattctctgaatgtagtcagttacatgaactggattcctattattaagccaaccttctcttcctagggtaaaaaaaacctggccacgatgtggtttgactgcttttaatagctggatttgttttaagatttttgcttaatatcaaggctgttttagccttataaagtgatttggaaactggctttcttttcttgttttctgggagagcttgtatataacatttacattacttcttccttgaatgtttattagaaatcataggtgaagtgtgtttggggcctggtgtcttctttatgggatgctgattcaatttctttttattaataaggttcagcttttctgttgtgtaatattggtagattgcatattcctatgtatctttccattacgtctacactttcaaatttgttagcactgtgtttttcctgtacacttaacatgtgccagatctgtaaggatggtaccctttgtattgcttatattgcatctgagattgtttgtatcttttttccttgactagtcttgctagaggtttatcatatttattgtttttgctttacaaagaagccaatatttttgtttttcttctttgttatattttctctattttgttgatttcagctttttcttttctatgttaatatgtcatattattgtagtggatggttagctcttcaaattttcaactttctattctgatttacatatttaaagctatagatttccatgataatgctactttatctcttgcgttagttttctatgctgggtaacaaattaccacaggtttactggtttataacagcataattttattatctcacaatttcttggggttaagagtttcagcatggcttaactgggtcctctgtttagggtctcacaaggctgcagtgaagtcagctgaactgcattgtcatctggagctcacagttctcttctaaattaatcagattgttgataaaacttagttccttgaagctgtagaactgaggtcctcagctacttagggctgctcttttatataagcagtgtaacgtgacatgcctttttaaggtcagcagaacttctgactagaatctgtttcagagaaggccagaaagagttcacttggttaggtcagagtcacctgggatagtctcccttttgattaagtcagagtcaactaaataggcaccttaattgcatctgcaaaatcctttcacttttgccatattctcttactaaatgtaacaggcgttgtccacacaaaggtatggatatggggcttggaaaggatttcaggaaccatcttagaattctgcctactactaactccattctacaagtctcaatatctagcattttagttattcactaactgcaaagttttttatttcattatcattactactttgatccatagatactatttggaactataatttccaaacatgaatatttaagttttcctttattgttgatttttaacataattgaattgtgatcagatgatatattctctatatgatttaaattctttgaaatgtgttaacagttgctttatgacataataagtggctggtttttataaattttaggatgcttgaaaagagttctacagttatttatgttcattaatcattttagtcatgttcattaattttcaagtcttcagtatccttagtgatgatttttttgtttttggtatatatctcttgattactaagagaattgtgttaaaatgtagctagcatgattttagatgtgtttgtgtgattctttcaatttctctctttttctattttgtattgggatacaaatgtataattgttatattttccaggttaattgaaagaagctttatcattacaaaattatctttatttccactaataaattttgccttaaaattaattttatttgatattaatgtagctataccagctttcgtttggctagcacttgtgtcgtatatcattttccacagttttactttcagtctttgtgtatatttagtttttagaggtgtctcgtttatatcatattgttgttactattagtatgtgtcctatctgttctatgttcctttttttctactttttttttgatagttttgtttttgttactcctttttttcttctacctatcagatgggatgttgtatatatttctgttcatggttgttctagaaatttcattatgcatctctgacttatcaacgcctaaactcgcccagacttctgcgcagtgcagtagccttagaacactttaatcccatttactttcctcccagcttatatatgtggttgtcacatatgttgtatctctttaaatgtaagttattactgttgttttatatagttaatattgacttagatttacccacaaatttgccacctttcttactctccattccttgctgtgtctttgagcttccatctggagtaatttttcttttgcctgagtatatgtttagaatttactttagtgcaggtcacctggtggcacatttactttgctcttgttttttgaaatgtcgttattttgccttctttttgaaggactttttttttctcccttgaaatggatggttatctggaaaggtaaagataactttcccttgtattctgacttccactgttactgggaagaagtcacctgtcagtcttttgctccatttagactaatccatttttttttcctctggctgctttcacgattttctctttgtaattataattttttttttttgagtttcattgtgttgtatatacgtgaggattttattgtattttcccacttaggctttgtttggcatcttagatctgtgggttgatacatcagttctggaaaattctcaaccatcattgatttgttcaaattttgtttagaatcttacatctatatccatgagcgatgttggtctttagttttctgtttttgtaatgtcttttgtctgattagtatgatactaatgctggcttaatagaatgatttcagaagtattccctccttttgaatttttttgaagagtatgtgtaggattggtatcatttcttccttaaatgttttggtagagttcaccattgaagtcacctggacatgaagttttctttttcggaacatttttcactacaccttaatttctttgatagatttagggcttttaaaataatctgtttcatcttgactgtttggcttttaaggattttttccatttcatataaattgttgaatttgctggcataaagttgttcataatctttccttagtaaccttttaataactggaatgtcatgtccctctctcatttctaatattggtaatttgcatctgctctcttttttcttgacttatctggctagaagtttattgattttgaacgtcctagtaaaccatcttttggttttatttctgggggaataaagtaccataatcaagcttagtaatccttcttcttaccttcctccaggattttgactagatgggattctttgtctaatgaagtgacctaaaccttcatttctacagaattgagccgttgataggcctgtctttactgggttgctgcagttttccactgactaggactgttagcactaagaggcattccagtgaatttcctcgtttccatatatagcctatatagccttcttgtttccattgtaaaacagaaacacagttttcctctgataactggaattagctaccctggccagtccattgagctgcttttctgttactttaatggcatgaggaacctcaaaaggccagggccagtctcggctcctaaatcatcaaaacatgattatttttcctgaaggaagtgttctactcttggactctagaatttctaaacccaccaagcccaacattttgggaatgggaagcaaaaattattcacgtagattcttaggtatactattgaacagaaacactccttctaccctttggctctgagacctgtgcatcctgatagtggggagacagctccatatattgactgcttattaaattaatgtaccacattctataggacaccaccctaccttttcatgatgttgcctcccagatatctctgtaaccgagctctcattttgccactcagctgttctatcaagctagttactttaggagataagcatgtgttaaaaccattgaattcacttccattgccataaactgtgtacctggttggaagaaatgtttttgggattcctatgcaatggataaaaccttcagaaatgtcaagaatattagtgccagtggaaacactgcaggcagagaatgcagatttataccttgaatgtgaattatctttgtgaagacaaagtgctacctatttcttatggaaattgcccaatgtaaccatcatgttaccgggttgccagcaagtctcattgacagtaatgccatattaggaacccagccttggaaatgtagtcacactccacgttgttgccaggttgggcattcggcaatgatagtagccaaataatgtaggtaaggagaagaccatactattgaacctctgtcactgctttgatagccacttggtacatgggcccattaaccaagccctgggttggctggagaaaaagactgacatctaccagacaattcatcttgttccgcttattattgaaaatcttctccacctgatgcatcctgttaggcacttatgggggatatgaatatcttcacatgccctcaccactccaagagggttatctgtaagtctcacggacagatcttttacaaattttccattttgttctttccaagaacctaaaagctggacaatccattagacactgcctgtaagtcagtatatttatcagtttgtcatgtcgtcccctcctttcttgaatgtgaataaccaggtatgtagctagaaattgcccactaggaagattcgctgtccccattagcaatgcacggatctgaaattgtctcacttctttacatatctgtctgtctcccagattagactataaaatctccatgagaactaggactgtgtctcctgttcgcacaatatccctaatgtctagcacatagaatatattctaaacatatgtggcgtaagtgattgatgcattttcttgaacatttggagagaaaatgttaagcaattaaacttgtaaccaatttaagattttttttagtacatgtgactgtattatgaagaacaatgcaaaatttggagcaatttacaagaagatggaacagttcaagtaaatttgcccatgacactagtgacttcaggctcttttatgtatgcaacctaagtgatgaatagggaagtacgtgtttatggaatctgtcattggtggtatttcagtgggaaaatgtgaaaagctctgattttgaagggttgccagagaaagaggaacaggcagaggaaactgaaagaagaattttttttttttttttttttttttgagacggagtctcactctgtggcccaggctggagtgcagtggcgcgatctcggctcactgcaagctccgcctcccgggttcaagccattctcctgcctcaccctcccaagtagctgggactacaggcagctgccaccactcccggctaattttttgtattttttagtagagacggggtttcaccgtgttagccaggatggtctcgatctcctgacctcgtgattcacccgcctcggcctcccaacaggcctgaaagaattttaacaagcaggatgagcataaaggcaaagtggggttgtcaacatcaaggaaacagagtgttgggaaacaatggtcgactttgtcaatcgccaaagagactcccaggaaaaatgagggcaacaaaagtatcagttggatttaggaggccactgcttacccaaagagttcaggtagaattgttgggaggtgcagtggttggagaatcaactccgtgaataatgaattgtgttgacacggtacataatacggtatttctgactacattggcggcatttcactaagtaattactacctgaagtgcctaccttcagtaaggcatcctgttgttggatggggaaagagaaggaggaaataactcttagctttacctgtactgtgcttctgagacccaggtatggaccttcactcccaatttactatccatggtctcatccgatgttcagtaactgggttctcctttggcagggagtagggattgcctgagaattaaaaggggaggggagatttctgaactggacctcttaggttatgactagattgggtgcctgaggcagcaatggggctttataaggcttctttacgcttcatttaactaattgcttttttgttctctcttattcagtggagttccaatctgttcggttgtggagaacgaacctgagaaaaaggatctttcgcagggtagtttttgggggcagaggctgatgtgctgcaccccctaatcaggggtatggttggctgcagtagtcaagtgagagggccgcaaagggaaaggaaaagtcgagactatcttagggaaccaggagagtcgctgtacctctgaaagatctacggtttgtctggtctgtaaggagcaaacacggtggaattcctttccagatttttctgggcctcgacctctggcttttggggtacatgccaaaaaaaaaaaaaaaaaaaaaagcgcagggagagtccactagcctcggtgacagttccccattgcggtttcccctcctccacccttctttgcgagctccttccctctgcagagagttatcccgccacattaacccctgactcacagctggaccgccccggcccgcagcgccacgtcccgggtggggcctgccacggcaaagcagcagtccggcctcgagcggcccctcgggggcggcggggtgggcgccaacagcagtcaggcctgacaagcggcgacctccaagggtgaggcctctgcgggcccccgactcacgcgcgtccgggctctgcaagcgcggtggggagcaggctgctgtggtcgcggggactgggttgcggcgcgccgcgtacgggacggccccaaactctcgacgcccggggcaagacgcccaccccctgggcgctctcgctgggccagaaaggaagacagaaaagccgcgggctgactgtggtggcgctcgcctgcaggcaagtaccgggcgctagggcgggggccgccgccgggggcgcggggtgggctggggccaggccgccaggggcgcggggtggtctgggggccaggccgcctgcgctacctccccagcctacccgacccgacggcgcgggtgctggcgctgttgtccccagcggggcgggcaggcctttccgtcacttggcttactctgaagggaaaatccacacagctgtctgcctttttgtttcattttgactagaaaacccattttcgaaaagacacctcagaaccataagcaaatagcccagagtcttaaatgctctaaaggctctgcatgagcccctgccaggcacacagagccagtgctggaggttttggcatgggttttcctacttggctttttgtgcaaagctaatttggataaaaataatttgactggcagctgtgagctagttttcagtgtattaggacctctccagctttccacggtagtaaacttcttaaagaaagtattttaaaatattctcatatttattattattttttaatttatccttttaattttgaaaagcaagggtgggaaaggctatatgatctggaggtaaaaatacaccattatatagagttgaagtgtcatcccctgaacccacattgcacgtctacacaggagaagaacttgtccttctccaagtgtttagtattccttagattagtgtttttcaaacaagcctgatggtaagacgcatttgggacttttgtttaaaatgcatccccccacctctgaaggtttaatttggtaagcttgatttccagaatctgtatttctatttttttattgtttaatttaattttatgttctgggatacatgtgcaggacttgcaggtttgttacatagataaacgtgtgccatggtggtttgctgcacctatcagcccatcaatccttacattttaatattttgaagtagtaggatggttataaatggagttaagcaactccactttatatctcattcaaatcagaaaatagataagcaggtatagaatattgacacctacatttgaagcaaagtaaatgtgacatgtacgccttaccgtatggaacttgaagtataaaccatgtttacactgttgaatcatgggcatctgtgttgagtcatttgttccttatgctattcttaaaatgtattcatttaacaaatatctgctgttaaatcttctgtctttaatcccccctagaccacacatcccattctaggtcccgctcccctactttgcttctttttataacaaacaaaaatcctctttgaaagatttaatctaagtctccattttcattttccctgtttcttcctaccccctctcatctgaggctttttgtccccattaccccctgcatggtcctgatgttgccaatgactgtcttgtgaaatccagtgtctgtgcacagttctcatctttcctgacccctcagtaacatttgatcactccctcctcaatattcttttttcttcactaatgttcttcactaatattctttcttcttcacttggcttccaggtcaccatattctgcatttcattctgcttcattgtgtctccaggcttccccaccactaaatcttagtatgccacagagttcatttcttggccatatttttctagccatactttcccccaggacaatttgtatcccaagccatattccttggctataaataatatctatcagctgatgacttccaaaattttattcctagctttagttcgcttctgagctccagatgtatgtgtatgtccagctgtttactcagcatctccacttggaagtctgataggcatttaaatttagtatggacagatagaactactgatgccagattcaccaagttctccctctgtttcccctcagctccctcccttatctcaataaacagcctcagttactgccattcaagtaggccggaattctaggaatttactcttgacttctctttttaggtcagactccgcatccaagcatccaacaaaatctgttgactctacccagatctgcccacctctctctccctctctaagctaagccacagtcctctcctacctacatgattgagaagtctctgcctctgcccttgctcctctacagtcttttccaaatagcagtgatttttgtcatacatactcagaactttcatttcccttcaaaaccttctggtggcttcttatcagaatcacaaaaaaaaagaaagaaaaaaaaaagaaaagaaaaacaggcttacaatggctttaaagccctgtgtgatctagtccctgactagttctctgaactcatctcctgacttccctctcatccactccactgtagtaacactgattgtgctgctgttgcctttgcctgcagctggtgtctgctagaccattgcacactgtactccctcacttctctgttagcatgctgcctcaggggttactgtgctattgcagcaagatctcttttgctgctgggcctgtgcggtaggttgctattaaatactgaatgctactctctagtattccatgaagcttatggaacctttaaaacattgttggttgcttgagttccctaatattaaaaatgcacaaccatttttcttttgagcctaattttgataagatggacagtttgcctttaagttctatgtttttataaaatctcttcctgatttggagatttgccctttaccatcagttttcatttttagatacagaaaatggaagaaaaatatccagttcactaaaaagaatatgtaataatatttggtggggggcagttactttgcccccctccccccaccaataggggcaataggaaataggaagcaataatctaacatttggagactctttgaatggtaccagcagcaggtagtttatgggaagaagaaaaataaagacacttgttcagagaataatatacaagtttctaagttctgcagtgactaagccaatgtcagagttgtgaagattttataagatattatataaattgaacttttttttttttttttttgagacaaggtcttgctatgttgcccaggctggtcttaaactcacaggctcaagcaattttcccacctcaacctcccaaatagctgggcctagaggcacataccactgcatctggctccagttctcttttgaggactatgtagaaatgaaaaacaatattttcatctttatgaagaggtgtagcaactaaaagattgtttaatttataatccttatttctcattttaatctcaaggaactggttctgttatcagtagcgtatgtactatcaccccttcttgtaaaagaaaagaagaaaattccttcttatttcagaattaggatttaagatactttaataaatatttccaatataagattaaattaaattaaataataagtagatttggaatatcgaacagagagaagagtaggggggttaagcagaaactaggagtgaagttattaatagtatcaaaacacttgccataagcttctgtctgttggccagagcactcattaacgtggagcttcctagcaactgagtgaagagatagggtccacaagatgaaaaagcagtgcccaggtgaagatcggatagaagcatttttttaaacatttacttgctcaaggacctgttttaggtacgatgaagatgaatgttctgtcctttggtacttaagaagagtgttggagaagccctgtttggtttagagttagcaaacccatgctcttggaatatttgcatataaataaaaaacagatgaaatagagctaaacctggagataggctaaactcatttggaacgtagagatagagcatgtaaggaagacacttaccaaaggtgttggaaaagatatatataaggaagatactatttagatggaaatcaaatcaacataattgacataattgttgacaattattgacctaattgatatttataaaaatataaagcctagaaaatgaatttttatttactaaaaaactattttttcagactgtgtgatcattgttcaaaaggtgaacatgtatgtgtatatatgtgtacatgtgaagaacacgtgagttcttcacatatatatgaaggaatacatatatatacacatttatatattcttatgcatataccattcacagaggatcaatgttacctttttggtattcacttggcccatgaacaacatgggtttgtattatgtgggtcccctcatatgtggattttctccaacaaaacatggatcaaaaatgcggtattccaggatgcaaaacccacacatacggagggctgactttttgtatacgcaggctctgcaggctgactgtgggacttgagtattcttggattttggtatatgcaggggtcctggaacccctggaatcagtcttccctacccttaagtataccaagagacgacagtacttctttctaatctattttctctgcattttgtttaacaaagctgagatcatattctgtatactattttacagtcagttccttttctttaattacatttcattttcgtgtcatgagaagcgtttttctcatgtcattaaaattgttcataacattcataaacatttttaatggtttaataggattcgatcatatgaataatgtgacatagttaatattatcattccccagtttttggatatttttatttttacctccaatggaattttgactagcttatgattgtacaagatctcttatgataataaaatatagtcatataactcatacttcaaatatgccagaaaatatctccatagattgcatgacaagagaaagctaagccagtttgagaaactgacaaaaaggtctgtcaacctaaataacagagggagatagaggctctctaaaagaaagtaatatttattcagaaatgggcgttgcagtgggaatatgtgtgccatagtaaattgtgtgtactcagggaagtaaaggcagacaaagattttcaaagtaaaaatgaggaggtttacataattgttttgagataattatttttggcttgtgggtaaataacaagggtggcaccagtctgaaattggacaggaagttgctgggcagttgttcttgcagaagtactttttatataggactgtgatggcatttgtgcaaggttctgtttttgtttgtttgtttgtttgtttttgagacggagtctcactgtctcccaggctggagtgtgcagtggcgtgatctcggctcactgcaagctccacctcctaggttcacgccattctcctgcctcagcctcccgagtagctgggactacaggcacccgccaccacgccaggctaattttttgcatttttagtagagacggggtttcaccatgttagtcaggatggtcttgatctcctgacctcatgatccacccaccttggcctcccaaagtgctgggattacaggcgtgagccaccgcgcccagccaaggttctggtttttggggagacttttatgatagttctggttactaggcatttatatttaagaacctttccttcatggcctttcctggctctgattgtccggttttttaacactagtaactccactttgattctgacaactcttacagacccataaagacccatgtgcagggagctggaggaacaaagtggagaaaagcatgagatgaggttgaagctgaaggagccaggctatgcagggtattatttgtcatatcaagaaatttttatatcaagcacagtaggaagccaatgcagggttataaatgggagtaactcaaatcagatgttttgaaagatcatcctggctgttgagtggagaatggattagactgattgagagtaggggaccaattaggaggcagtgcagaagaccaggatagagacattgatctagaatgaaaatgtggtagagaggaaacttgaaacaatttgagattatctgttagagttagatacacaggacttggtgatcacttggaagtgcaggaataggagagtaagaggaaggtatcaaggataccccaggttttgggtaataacaggacaaatgataatgccttttaccatgatggagaagtctgggaaaatgaggtgcaagctaccttccaggtcagcaagtaagacaaattaagagtgctgggcaatacatattataagagatgtgaaccagatattatggatatacagaggatgagtacttaattcaacttggagataaaaggaaatgcaatccttgagtagtgtcttgaatcataaagaggagctattcatgtagatggttgggcaagggtacattctaagatggagcatggaggcaacaacatgacatttgggaaaaccgtaaataggtggatattagaactctcaagagtaacatggtaggagcaaattttatggataaaaggagagattggatcataaagggcctagaatgttattctaataagatagagtttttcttgaaggcattagggtattatcaaagggatctttaagcaagagaaaaacaggatcagttttccattgcagaaagatctatctagaaatgatgtaaagggaaagagactggaggcaatgaaactagttggatattatgggaatttgtaatcctctaaggaggaataatataggtcttgaactaaagcataggcagggaatggagagaatgggaaaagagacagatatgtttaggaggcagactaaacatatctattagcaggacttaaagtttagtgggtggagttgtggggagggtttgtttgaatgggtgaaagaatatgagaataatttgtaggtttccgtcgtaatcggtagagaggatattagtatcattgaccaaggcagagaagattgaggaggaaagattgattgactgattgattgattgattgatccatctgtctgtccatctgtccatttaccctgtgcttattgagtacctattatggcccaggtactattcgcttgacccagtaagcaaactttggtcaacagagggaatgactgtaccaagcccagtttgatatctatcactcatattagttcttgtggcccagcctctattggaatcatgtcagaatagtgtgcagagtcaggggtgctacaaacctagagaagggagtgctgtttggaaacaactcacagactgaattgagtctgtatccatcatctcagatggggatgagcttgtctcctaaaaaaaaatctcctaaagtcatgatacgcctttagccagcatttatttcagttcatccaattgtaagtcagtcctcctcccaggctgcaagggtatttatggtgccttcttaatgccaaaggattttcaccaattcctaattgcctgctatttgtatcctctttttctgtggtcatttcttgaaagtacttttagccaaaacatctatcatatattttttttctaacaggtctagccactgtcacttttatgtctttgttatgcatgaaaactgtttgctagaaaacaacattttggcaaacagtataaacaccttgtcaagctgccattcagactgaggaaaacttagtaagttgaataattttgtatttcttggctgagagccaatgacagaacttagtctcctaagctgactgatctactagcaaaaaatgtataactctgctatttggcgtttaaacacacatacttacatacatttatttatttaaaagtataaaaagacatctaagacaaacagtgctctcatgaattgtattgcataggaaagcacacaaccatatgtgtgtttgggtgtatgtgaatatgtatgtatacatacacacagtttaaagcaagcatatgcaaagatgcacagattcagtataatttgaacacagaattgggatcatactgtaagtattgtaatatattttaatttgatcatttttaaaaattaagtaagtagataatgttacaaaggtcattttagtcagaggaatcacatttcaggcatggatgaagttacagagctggaaaggctggacatcctggcagaagagaaaaggaccaagcatgatactcatatttttgaaaattgtttttatatagtaataacatagaacacaaaagcgcatagagcaaagtatatagttgaataaataaaaaaacaatcaaccatgtaatcattttctggtctacaatcatttttcctaaagattttcttttcctcactactctgcagtacctcttttgttgtacatcgtgtccatatatgtttggatctgtttcagagctccttatcccatccctttagcaatttgtctaacattttgctgtattaccttgtcttcactgttgtaactttatagtaagtgttgatgcccaatagaacaagtcctcccatcttattcttccaagtgtattgactattcttactctttatatttccatagaaattctggaattgaaccggtaaaacccaaccaaaaaaagtcttgttgagattttgattgttattgcattgaatctatatatcaatttagagagaattgacatctttactatattgaatatttcaagtaataaacatgatatatatgtgcatttatttagtactttccttttatattttatctcactaatatttctgtgtggaaatcttgccccttttttggttagatatatgcccaactatttgatattttttgatctattggaaaatgacattttttttgtaattttatcttttatctttgttattggtattcaaaaatacagttgaattgtttatgttgatcttattatatccattttcttgctaaacttgcttatcttttagtagttttggtaatttttaaaatttttggatgatagaagactcttttatttccagtttgctaagagtttttataatgaatggatgttgaattttatcaaaatatttttatttttaattgtcaatgtgattacttacattgatttttgttttaaatttttgagatagaatctcattctctcgcccaggctagagtgcagtgacaggatctcggctcactgcaacctccgcctcctgggttcaagcaattctcttgcctcacccacctgagtagctgggattacaggcatgcggcaccacacctagctaatttttgtattttagtagaggtggggttttgccatgttggccaggctggtcgtgaactcctggcctcaaaatgagccacccaccttggcctcccaaagtgttgggattacaggcgtgagccaccacacccagccacatcaatcaatttttacttgtcagatcaaccttgcattcctaaaataaacccaacttggttgtgatggattatcctttttttaaaaaggatccatttttctaacattttgtttgtgatttttgaagtaataatcatgagttagactgatctataattttcctttttgtaatattcgcatcagttcttggtgtcatggttatgctggcctcataaacatgagttggggaatgtttcctcttttttaatcttctagttttattatttttttctttacatatttggctactatttgaacctggatttttctttttggggagatttccaattatgaatttatatctttaataataattgagagagagggttaggaagaatagctagtgggtgctggccttaatacctaggtgatgggatgatctgtgcagcaaaccatcatggcacacatttacctatgtagtaatcctgcacatcctgtaaatgtacctctgaagttaaaagttgaagaaaaaaataattgaattcaggttatttcttctgtgtctgttttgagaaattgtctatttcttggaatgtgtttatttcgtctcagctttcacttgcgtttatatatgattggtcataatctttttattacattttacggtctgcaagatcatcactgagatcccattttcatttctgacattggttatttgtgctttcttttactttgtatatgactctagattagcagctattttctttcatcacgttaaagctatcattatttctcttgagaaacattcttattgttgcatcttttaaggtaatctattttctcttgctgtttttaagacttttttctttgctattggctcttagcagttttactgtgttgaagctagatgtggttttctttttatttattttccttgaagttcataggacttttaaaaatgtgtgatctgatgtttttcttcaatattgcaaagtctttacattatctcttaaattactgctttgctttaattctctctcttttcatttgggactccaatttacacatttgttacaccttctaattgtatagttgttctgtgtagcttttacctgctttcttgtattttactttctttttttgtttctctcccttattctgaagggttttttttctagcttgttttctagttcatgagttccttctgctgctgatctaatctaatgataaatccatccattcaattcttaatttcaactattatatttttcaattttagatttttttcttacctgccatgcctttttttaaagtttgcagttatctgacaaaattctcaatctttcctcctcttgtgcaatcacagttattaataaaagtttgaaatccacatagatttatttctattgtcagctgcgtttgctggctttcttgtcttcttccagagaggatttaatttttgcttgtgccgggttcctggcagcactaacaatctgtgatcactttaatctgatttcagagatggcagttattaaaaagaatgcttccattcctgggaggatcagtctgtttttagatcactcgtacacctaggtgtagccttcagggtcccaacccaaagcacacaactggagtcacacttttgtctcattaaccatgaggggcaaaaagcacagcactagctttcctcttctgaaattgaaaaatactctagggggagagtcgtctctgggtttctgtcttctggatttgggttctataattcttcactatgtcattagttctctgatgcttcaagcctattttttttttctattttgtctagcttttctagttatcctcagcagtagcattgatccaaattacctagtccaccagtactagaagtggaagctgcaaatagccccattttgatatttgagaaacaggccaagaaagagcatttagtaaaggagactgagaaggaggagatgagagagagagactgacacatgatggtatagttaaatggatcttgggaaatgcctttagtgactttaaagccataatagagagttaaataacttttcataggagttatttcctctttcctttgtagcctatatctttggaatagaaagaaaggtaagatgatagttctaaagggaaagatattaaataagtacgacatgcaagtaaaagcaggagagcaaaagtacaaacagaagaacctgaaaaatcttaaagaaaattgattgtcagcagctcagacatctgtatacatctgtagctaatagataggatatggatgggtaataaagaaagtgaacttgagtttttaatacaatgtatcccctgaaaggatttcccttcaatttagaaaatgtacattaatattgctttctatcaataagacaaccaacttgtacagaaatttctgaatccaggtatgggaagcactgtggaaaggtttcatatttcatttcttcatagttagataatggtccttttgtctactttgtaatcttttctgttttccatattatgtataatgcatatgtcatatttatattcacgtaactttttcttttttgagacagtgccttgctctgttgcctaaactagagtgcagtggtgcaatcatggctcactgaagccccaaactcctgcgctcaagtgatcctcattctttttaaatttatttattaaatgttttttgtagtcatggggtcttgctttgttgcccaggctggtctcaaactcctggccataagtgatcctcccacctcggcttctcaaagtattgggattacagacatggacaactgcaccagaccctatattcacataattatttaaaaaatgtagtataagtgatcatttttaaaatctaacaaaatatatttggattggttactctctattctggttgagtcaatgatttatataatagggatgatcaaaagctatctgtttggctttctctctaaagctacagaattctgtcatatctttggagctaattaatttattcattcacaaagcatttcttgaatgctaactatatgctaggctctggggatatagtgatgaataagacaagttgatcgttgttctgatcgagtttgcagtctagcgagaatgatgagaaactaagcagataaccattcacataaataattaattgtgattagtgccatgaaggaaagatacagagtgctaggctttgatagatcccataactctaacctttctaatgcaagctctaatagctaagaatgaaaagtataggtactggcttactctaactgtaaataaatgccaataggtaatatttgatatttgataatccttttatttaggctgggcctttgccatccttattgattctctgcaatcccccaaagaaagaaaacaaatgacagccaattctcaagaatgttatttcaatctaagatgaagatggattcaaattcaactcattctgttcctgaaaatacttattaccctagttgggattttttaatatttccagtgtctaagaagtctaagaatagtctatgtgtttcttatctggctggcgtggatctgttctactgtgtcctgacagctcggcagagcttggcacactcccgtgctgtagttgagggatcagcacactttttctgtgaagggccaaggagtaaatattgtaggctttatgggccatatggtttctgttgcaatactcaactctgcctttgtagtatgaaataagccacagacaaatacatcaatgaagggacatgtctgccttccaataaaaatgtatttacagaagcaggtggtagagtttgttttggatgttgtatcaatcacagtttagttgtggacaacagaatctactctagttagtttaagtagaaaggtgtgtcttatgagatattacaagatgtacagtatcgttgggaaagttgaagaactgcactctaggttgggtttctagaaacacctctcaaagccatataacagacttgtctactggcctggggcttttggcatactcagaagcctcctgccaaatcaggaagcagccagctccttaattatgcccactctaccagaatcttagccagcaaaacaggtgcttcatgttctgcctcgttgcatatttaactcagacgtgtaagtacatctgatgctgaacttaaattacgtttaggaaacctagcattgagggagtctgggagatgaaagtttttagtacttgtggtacagaaagtacaggaagatacagtaaaaagagacaggaataagttttcgatgaacaattctttagcagatactgcagcagatctacagaacaccactttggctaattaacatcatggacactcttcttttcaaacctaaacttctagataacagcaatagctgtaatggcatgctatctcccaatataatgcagctctccttcatataaacaaaagtggactcaccttctctctaaaaggtacaacgtgaagtcccataggtcactttatcatctgtaatattcatcacagacattatcctgtgacccagcacactcaagagttaagtggcctattcctcttcagaaaaggagtggtggtggagagacagagcttacccagtgcccaagaggataagaccttaattctaagacgcttccacacgtatatttcaccctctttactagcaaattcccttcagttcgtaagcattccaagtatcttctcttaatgaaagcctctcctgaccctgcatttagttatgagtattggcctctcctttccctctcagccaaccttttcctctgaatgtcaaggtgctaaatgcagtggatgctgatttcttggcagccgtgggtgctgaccactgctgaagccctctcctcccttggctttcagatgccattctgtgtctgattttcatgctgttcctgggccactcctgttccgttatgggcccctcaccctgcatatgctcttcagtcattggttctgtctttagctctctctctcctctcttttcaatacctattctcagttactcacatgatttaagcaagcaactaacttgtatccccaatctaagatgctcttttatgccccagacctacatgtgcaagtgcctactggatcactcttggaagccatgggcacccaagctccataggtcccagactggatttcttggtcacccccaacccactccatcctgattatattgcttttctcagtgaatgacaccaccacccaccaagttacaaaaagcataagcttgggaggcatccctgactcttccctctatgccatccccattacctccactatcacttcatctgtttggggctctgctttctcaccgacactattgtagcagcctcttaactaattgttctcccagtctagcatcttccagtcctgtagcctagtttctttacaaacctaaacttccagacaacagtaatagttataatggtatgccatcttccaatagaatacaactctccttcatataaacaaaagtgcactcaccttctctctaaaaggtacaactcaaagtcccataggtcaccatatcatctgtaatattcatcatcaacaattttaggactattttaacctgtgtcaagtcagatcagatcactcgcatttaacacctaccaggggctatctgtctgccagcatgatgaaagccaaagtcctgagcaaaataccttaggttccttataaggaacctcttttaatctactttacctttcccctgctcttacttctttcccttcctcttctgcctcctccttcatggacttgagccataaatgtccggtgcaaaatgattctaacatacagtctttgccctctggtacctcagtgttttttcaagtgctgcttccactgcctagaaaatgtccacctgtctttgtcttgcaagggtgaagcgtcccgtgctgcagatggccctcctgagtgctttcatggcacctgatattctgaataaagcacctgtgcagtgagtcctaattgtcttgtttaattatcctggcttcacatctctaaaacctagcatgttttgctgcagaatgagtttccaccaaaatatttattaataacaaacatttattaacaacaaaacttattgaacacaggaatcttgattttacatatatttgccacaagatggtgctgttcagatatgaacgaaaaaggctctccaaggctgaaggattcagtactaggtgaaatttctttaaatatgttaaaattttaatattgctacattcatcggtcaccctacttgaccagtcatataagcatttgaagtcggttaagcactgtctttctcttgaactgttttctttccttagcagctggggtaccactctcttctggttttccatcaacccatcaaccttactgactagtccttttctgcctcctttgctagttctttctgttctgtttttttttttttttttccaacactctaccttaattaatggtttcattaatgatttatgaattgcatgttgtcatagcagtaatgggtagaagtgactaacaaattgccataaatctagcctaaagacagatcatcaactatccaaaaatcatttgtaacacaacacaaataaaaaatcactgtaggaatagttaatcttaataataatgacaacaataactccaccttcataatgttggagtgccatagggctcagcctttctttttctatctatactcacctccttaaaatcctgtatagtctttaatgatctcatattgtctttctcaaatacaatctatacaaagataaaggccaaatatgcatctccctgctggaacctttctcctacactccagactctatattcaatgcctagtcaacatcatcagcaaatcttctcagttctactttcaaaatatgccccaaatttagccacttctcaccacttttactactaccatcctggttcaagccatcatcattttactattgggtttctgcaacagactcctaactagtgttcctgcttccacccttcccttcctgccttctattcctgccttctattctcagtgcagcaaccaaagtgatcctgtgaaaactagtcagatcatgtcactcctctgctcaaaatcctcccctggcttctgctctcgcttatctccttctaggctacccttggctccctccagccccacggcactcctttgcggtttctatattttccttatagtgtttggatccttgatttgtctatagcctccctttttatctaattctgttaatttatctcatctttgctatttttgtttcattgattgcatattctttttagtacctcctagagcaaggttattcaaactgcttgtccatgataatctaagaagcatgcaccagaatgtaaaccatgctgcttcctgctttgagagtgtcttgctaggaaaaaaatgtcagctggctaaacagcatacctactgatgtagttgatttacatcctggcacaatctgcttatctcctcattgactggtaagaaacagttcagagactggcatcttgttcatggactacgctttgactagcaccaccctaaaatataaacatttgttgtataaatgttttagcttctttgttatgtatttaatagcaataatagctgctaatgtttattgagtacttactatgtgcccagcaccatcctaagccattttgatcttcataaaacccctaaggatagggactataattattttacagataatgaaataaaagcacaaatatattgattaagttgtacaaaatcacagttattttatagcaggaaggagatttacactcaggcagtctgattccagagtgcatagtcttcatgaaatggaattttaaatctgtttttgtacgctatgattctcctttatattcttttatatttcctgtaatattttacatattcaccatagcatatttgccatgttgtttttttcattcctcttctgtttaatatagagaattctactggggtcctcttttgcatagatatgaagtggataaattctggactctccttccttcttatctcaggcctattgatcttcccttcagaactttagtttaagggtaccatttggattgattatgtttcttcacatttctgttgcctgaggggatggatatgattcactctgttgggctttggtcaacagtaattggtagtttttctcttatgtcttttctggggcaagggatagagttggggtgtcattctatcaagttataagtttttttaaaaaaggctcagccctacggagagcaatttgaccaaatgaatcactgttacaaatggaaatcccattgggggaattgttctatagataaacttgcacacatatgaaatgctttttgtacagaattatccattgcagcatagtttgtcctagtagtagactggaaacaactcacatatccaagaacagggaatgattatgggatagccacatgctgcatgattatgtagttgtaaataagaagaagttctctatgcgctgttacggaaagctctgaagatataaagggaaaaagcaatgtatactaatgtttatccactgctgtttgggatttatatgtcatgtatacatatgaataatgatactttttttgaaaaggaaagaataacaagaatattctttcaaaatatccttgtttgaattttgggacatttttgaaaaaaggaaagaaaaataagaatatatattcatagagaaacagtggaaagatgcaggagaaactgataaaagtggtcaccagcaggagaccatgggaataagtaacaggatggatggagacacaccaccacctttttttaaaaaaagtaaatgaaaatgtatatacatacacattttaatttttatgaacagtggtctcacatgcgtctcccaagtggcaccctcactctccttccatttagctgaagcaaggaggtgaaacctaaattttttaagcctggtgttcattgttctgatggaggaggagaactttaaaggaggctttccaggattcctttggccaaccttccccagatttccttcaccacgccatgcctttcctttgttccagtagagccctttttactgatggagttaactggccaacagtgaagcacagtcgtgtcctctcacttcctcccagccctgggaaccacagtgcactaaggaatcctgaccatctctccatgtctgagtcacagtggtggtgggaacagcacaactttccacagcttgttcccttggcagtctccttactccctccctccagattagaagatgatggtaaagttttatagacattgccactagtttttttctctcggtctgattaggtgggtgacactgcttggaagttggaacacatcatagatttctgaagtcttttgctcttttttgctaactggtatttaagaaaaataagtcgaagttgtaattctttgtttttattttaaaagattttgtgatctgccttgacacactatcttaccctagaagtttttcatattctttataaatagctgttatattccttcaaagcacttgtcttaccggctagtgactaagataatggtgttgaattcagtgataagtgtagatcattttaattgacagtaaatagatgcctctggatggtttaactattgttttctcattcaggggaaacttctttctgcaactttgcatagcaaaaccctttttttttacgatgcagtaacaaaagtcagcagtgaatcctaatcaatgaagagagtccaaattaatttggttttattattttggatggatatatgtcacattttagagttattatgccttagaatacctcttggtaactagcacaatataccgtggagcgagaacctaaagtacagacagagtgaatgacggagtggtcagcagtttcctcactagtcagaggcagctgcaaacatttttactcacatacattgaatgaaattctctgtttttttccttggtttttgttcccatgacagttttcaccacttttgttgaacagtttcttctaaacctgaattatgtaggcatatgtagccatgttacttatgttgttatgaatgttataatttcttcttgaggtatggcctttgcccataaagaacaagtagaaatgctctggaatatagtctgtggctcacatttgaaagtatgaaacctgtatttatatattctaaatgttctgtcttttaataaaagaattccccttgaaactgcctgtctgggggattttattaggaatattgccaatgttttctgaagacttatttaaattagattcacatggtatacttttctttcacagttgatctagttcttccactctgaatttagaatttttttaaataaaagaatgagtctaggccagacgtggtagctcatacctgtaatcccagagctttgagaggctgaggcgggaggattgcttgagcccaggagttcgagaccagcctgggcaacatatgaaaccccatctctaccaaaaaaaaaaaaaaaccaaaaaaaaaaaaaattagccaggtgtgtggcatgtacctgtagtcccagctactccagaagctgaggtgggagtatggcttgagcctgagaggcagagattgcagtgagttgagatcacaccactgcactccatcctgggcaacagagccagaccttgtctcaaaaaataaataaataaataaatgaataaataaataacaacaaaaacaagaatgaatctagactataatcattctttgttgatttcactggagaaagtctcaagtctttgtttctagagttcatttccaaactgagatgttaatttttccttaggtgaataaatatattttcttcagtagttacaggattcgttggaaaaagatatttcttacttttcacacactcttattataatttattctccattagattcaccatcaccacaatgcctgactccagacaaacaaaaaaaagctccgaaccagtaaatcctggacatcatttcacttgacatttcagatcttctgtttatgctgtcagtagagatgctgccagtcattgttaggatatttgtgttctattttgtttgtgcttgatacagaaatatatttatgcttaattgaatattcagtttctttatattttcctgtttctagtctacatggtaatttgataatggagaaattagatttaaactgcatgaaaagataaagcggtatggtacctatcacaaaaataccaacgtaatttatttcaatctggaggtttgtagtgctaatataacaccatttacattttccgaatgtctcctattatattaaactggaccctttatttaatgttcccttcgctgcctgtgatagcccttgtaaagctcacaaaagattagtagtttagcttcccaattatctgtttgtcgtttatgtatttggatctgtctattataatctttttgagcttttcagtttgaatgaaagtttccatttttaatgttttgattaaatttataatattcttctgttttgttacttcttttagattgaaaagaaatgctgagaaatacataaagttttcctcttctgccttggatatttataatgggtatcgggaagtctaaaataaattcctgccctctttctctctcttggggtaaaaggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctttactcttga

SEQ ID NO: 819 - DNA, 86273 bp, Homo sapiens
acccacgcggcgcagctcccaaagttgcagacagcccggcgaaccgcgcaatgcgcttcttctgcctgcagcagagaaaaggaaagaaaactccgcaggggctccgttggcttctccacgagtgacaaccatgttttcccagatagaagaccggagccctgctcctttgcgatccgccgagggctgcagagagcatcctcatccatttgggcacccctgcccaggaagagcccggccatccctttccggactggatccttaagaggtgaattttcttccgtggattccgatttgctccgtctgaccagcctaggcaatccagcatcgcgtggtaccagtgccgctgggcacactggcttcacgccggctccgcctcaccagcaagcgcattcccaggtaaaaattttaaataccttagaattcttctgcctagaccctctaatcaagaagtttacccactttttctgtaaggagccagaaagcaaatactctagaatttgggcctggaactgtctctgtagcgtattcgtctttgttttgaaaatgtaaaaaccactcttagctgctggccttacaaaaatagaatcatgaggactgtgaagattagagcctaatcactaattcacccagcacagaggctagagcgccagtgagtcctccgccccttcccaggcccgaccatagttttgcagttaggacccaggttttgtgaggactgggacccacccaggtttagttcacagtctcttgaatccctccctgcacctgcacctctgctcctccccctaggccggtggcccttggtgagtttctggcagtctcctaggccaccaggaaacactccgaccaactgccacgccctcctttgctccaaaatgacaagctcttttcatctgggagcaaaagctgaagtccccacatttgaactaaattagtttagtgtaaaagtagtacaagattatctcagacaattgtattttaatagtatttttttctagtgataaatgtaatatatgtctactatggtcatttggaaaattctgagacgtatagagcagaaaagaaattctccataaccctaacccacaaaaaataacttttgaaatgcttgtgtattttttaattcttttttaatgcatattataggacaacttactgaacatttggatttttagaaatatttttaataaaacgtgttgaagtacagcatacaaaaaagtgtacaaattacaaatacagttcagtaaactttcaaagattaacacaaacatgtccgggcaaccacaactcagctcaagaaattaactaatagtagcattcttcatccccctgttagttttgtctattctgacatttcacatgaaatgaattacttggtaaatattttatagtatttggtttatttccctttatattatatttgaattcatccgtgtcgttgcatgtaacaagtcttttttacaattttattctatgctgtatgaaattcagttatatgagtatacacaatttattctttctactgttattttttcttaattacagatttattgagatataattcacacaccatacagttcatctacttaaagtgtgcaattcaatgtgtacaattcattgctttcagcatattcgcagatatgtgcaaccatcaccacagtcaattttagaaaattttcatcacctggaaacttcataccctttaactatcactcccgcaaccccacttccctatcctttctagccccaagcaaccactaatttttctgctctatagatttccctattctggacatctcacaaaaattgaaccatatgatatgaggtcttttgtgactggtcccttatgctgatactggacattcgagttctttccaggtttggagctattacagataatacttccgtgaacgttattctgtgaatcggttcacatagatacacatttctattgcgatacatatctaaggtatgctcataaccagctataattacagtgccaagcagtttttcaaatttatagacctgccagcattgtatgatgagagttctcattgttccacgtcctctccaacatttagggtttatgtggttttaatttacatttctcggatgactaaagataaagagcatctttcatgtgattattggccactcggatatcctctttagttaagtgccttttaggcattcacccacttttctattggctaatcttcttctacttgatgtgtatattctagataagtgctgcaaacaaacaccttttcctaattaaacgcttgcattttaacttcccatttttagattttgataaaggtaaatcttttatttttattgaggtctaatttatcactctttgttcatggttagtgctttcgctaacctgtcagaaatcattgtctaccccaaggtgacaagggcattctcttatgttaccatctggaaccttaagttttttcttggaacacttagatgtgctaactacctaaaattaattttggcatatggtgtgaagtgaggactagtttttttttttttttttttttttttttttaatgtagctatccaactgacctaagttttttttggaaaagaaagtcctttccccactgctctgcaacatcacctttgtcataaatcaatagaaatagacctacagatgttggaatcagtagaaaaggaattttaaagatatttatggctattttaaattattaaagattcttactaagggtagatatgataaatgaagacagggaatttcaagagaaatacaactaatagaagaagaacaaaatggaacccctagaactgaaaattataataactgaaattatttgatgggattatcagtagattggacaacagtaaggagaatcaggaagcttaaagataggtcaatagagggccaggtacagtggctcacacctgtagtcccagcctactttgggaagcctaggcgaacgaatcatttgaggtcagaggtcagaaatttgagaccagccaggccaacatggtgaaaccccatctctactaaaaatacaaaaattagttgagtgtggtggtgcacacctataatcccatctactcgggaggctgaggctggaaaattgcttgaactagggagatggagactgcagtgagctgagattgtaccattgcactccacctgggctacagagtgagactccatctcaaaaaaaaagatagatcaatagaaatcatccaaatttaaagtgcactgagaaaaaaaaaagtttataataaacagaacatcagtgacccatgaaataatgtcaagacatctaacttacatgaaattggacttttagaagtcaaagagagaaactatcaggcagaaaaatacttgaaaaagtattagcaaaggttccccaaatatgatcaaatatatttatccagaatgtttacttgtttaatgaagagttgatcccataacctattttgccattagtggagtttagaagttagcataaaaggttataaagtgttacatctccatgaatgagcagcagggcatttaaaagtcacattgattgtagaaaaaatactttgctgggtggaagggtcctgagcatggctattcttttaacataaatgttgcctgcccactaacattaccaccaccccaatcatagtaatgccaaaattcctcacagtttttcaaaatatcccattggtgcacagtacggccctgcatccactgagaacccttctctcctgtgatctgccactgcctcgctgttccaacctttctaacctcatcttctaatgctctatgtatcaaacctccctggcctccttccagatcagggctttggggattgctttttcctcttccagaatgctcctgcccccaaatatttatataactgactcttccacaggtctttgttctgatgtcatttttctcagtgagacctaccaatgaaacaaaccaaacaaaaaacttgtacattctctcagcatctggattagtttgcagggctgccatggcagagcaccgcagacccagtggcttaaccctcagaaaattattttcttagctctggagactagaagtccaagatcaagatggcagcaggtttgatttctcctgtggcctctctccttggccagccattgtccactttctgtgtcctctcatggtttgtcctctgtgggtgagtgcccctggtgtctctctgcatgcccaaattttctcttataaagacagcatttagattggattagggcccatccaaagggcctcattttaacttaattgcctccttaaaaaccatttctacaaatatagttaccttatgaggtactaggggttaggccttcaacatatgaattttgggggtatataattcaggccatacaccatctcttgtttattttcatctgtcgcccctcccccccacctttttttttttttagatggagtctcactctctcgcccagactggagtgcagtgaagcaatctcagctcactgcaacctccaccctcccgggttcaagtaattctcctgcttcagcctcctgagtagctaggattacaggcatgcaccatcatacctggctgtagcccttattttaaattcaatgtactgtaatgatttacttggtttattgtcttaactttctgttccactggaatacaggttcaataaggagggattttaatcaattttgttctctgaagtgtcttcagaaccaaatgagtaaaaaattatcattgttgacgttttcacttcgtgctagcatatgggcaatctcaatttatttctaataactccctgtatctttcagagcattccttcatgaatgaagaaagccctgatagtgttccagtaatttatgttttttatgtttgaatttcttaacaaaaagaattataccactaaaagatccagcttttttgtttgttttactttttgaaaaaaaatttatattgttaatagagacagggtctcaccatgttgcccaggctggtctcgaactcccggactcaagtgatccaccctccacagcctcccaaagtgctgggagtacaggtgtgagccactacacccagccaagatccagcttttttaccagggaaaataagaaatttaatatgcttgtttccaaagcaacaaaagctttacatgattaagtagactgagggctcttccatattagacgaaaatatccagccaaattgctgaggactccctcagacaggaaaaaaaatgtttagagccatcctcacaaagaaattttcctgtttaattataacctaattatgacaacttttttttctttaggtggtcaggctcaggatggaccatgagctttcaaaaaggaaaaaggtggaaatcctcaactatgctgccatctgaataagtgtttctttgtagatgcacagagtcaaggaaaattacatccctgcattatgtaatgtaccaacaacgcacttacccactgttttaatctaggttattcttgaaagcagagcctgagacaaaggtagacacattctatttatgagtctaacacccaggagcaggaatgagagataggggagtgaactggggaaaagggaaactaagtccgagcaaaaccagatactgctcttatcaagtggtccacccctattaatggctacataatgcagaactttctcaggattcttcttaaactttatctcagaactgtctgcctcagggagaaaggagaagtatttctccatcagcagccacctcctgtgtgttgagggctgctcctttggggcattaacccactgcctccaccaccccaaccctctgggctgcaaagagctagctgacagtccagctggtaccttagcatcacacattgctgcatcagagaggtcttaagacaggaagctagagtcttggtgcatgctcgaagtgagacggtgtcagcacagagcagggtaaaatcttcccgttaactcttcaccagagctatgactggaatcagaggttgaaaagatgtgagactgtacccaagaagcatcttataagcctacgtaatatactgttagactcatcgaaatctatttcctcccttctttataatcaaaacttcagtgtccagaataaagttggcagaagggttaaattggaaagttaaatgtactagaaggtgtacatttataagttttgaccttgagtcgtgttcaaggagaaagtgacattggaacttggaaaatttaaaaatgattctacttgaaaaatttgaccattgcatagaaatattagctatcgtctaatcttttgtaatcttagaaacaatcgtgaattgtttggtgaaaaatgaaaaaataaccatttcttatgtctccgtgacctttatagaccaatgtcaccaacttttcctaaggtaattgtttcctactgtcaaatagctctagtgatataaatcttaacaatcaatgaagggaaaactggtggaaacataggaggaaaaatactgggataattttcatcacaaagtattggcattaacattggttagaataggggagaaactgcatgacttgacaactggacattcctgtatgttgtatgaggccctgtcttaacagaaatagtgatgtcatcatcatcctctcttatttggtcttgaattgccaccaatcggataaaacctttgaattatttaactcaatatatgttaagtttctactatgtgctgtgtattggtactataaatatgaataagacataagatattacattcaaaaacatcagaatacatgttcttttaaagtataccccaaaacatttaccatgtgttctggggcgcatgttaggctggatcacaaatcaagtctcaagaatttcaaaagattgaaatcatatagagtatgaattaaaccagaaatcaagtacataaaggtaacaaaaaatttccaaaatgcattaatttaaggaacatacacctcatgacccatgagccaaaaaataaatcacggcaaaattgcaaaaatattttgaaatgaattttaaagaaaatacttagcatattaaatacttagcatattaaagctctaagtacatatgttagaaattttaccgaaaggttggctatcagtgtttccagaagccagggaaaaagtttatacaatttgatcgctgaggcagggaaacaaagtgagacctccgatcgccctgcctttctgaggtgagcactctggatcccatcgcaggagatcagagtcttgctgagttgaggagaggaagattggagttgatactgagatagcttgaattttcaggacaaagtatcaacaaggaggaaggtagacaaaaaaatccagaaatctatgtagagaccccattgtgtacattgcggaacactaagcctaacaattctcaaaattagcgtgagattgggaaatatctaatttccatccagccacagtggagagtcctgactgaaaaccaggcattcgctaaagatcccagaaaggttgtgtgttacatacgtagggctaaactatcctgactaaaaactacactacacttgctcctcacccccacaaaaagcttaaaaacaagcctcaatagtataaagctgatctgtaagtaactaaactacctgcagaacaaagtccaaatttattagttccagtactccaaaaaaaacacatgtaaaaaaaaaatagatttacaagacatttatttggggaaaaaaagaatgcctgagggttgaaatggagaggaagccagagagacagagtcctcagaatacataaaatttctggcctccatggaggtgtgatggttaattttatgcatgtcaacttcgctgggccacaggatgccccatatatgatcgaacattatttctggttgtgttcatgaagctttttctggaggaaattcgcatttgaattgatggactgaataaagcagattgcagtccccagtgtggatgggcttgatccagtcttctaaggacccaaataaaataggtggaggaagcttgaattttctgcctgactgtggcgctgggacacccatcttctcctgcccttgaactgggactgacaccatcagtgctcctggttctcagaccttcggacagcagacttggggccttctcggcctccattattgtgtaagccaattccttataataaataagggtttatttattgataaatccttataggttgattataaatccttattaattgattgatagagccataggttttattgatcctgtttctctggagaaccctgactaatacagaaggagagagggaagaaaggcgggttgagtagcagaaagcttaggctgtagcacaattccgataaagtttaaggtcagctgatgaagaacactcaaaccaaagtcgcccattggaggagccccctacctcacaggaataggcctgcattattagtataccttcttcattcagttattgttattcttatggaaacaacccatgggaaatgtagccttggcatgactgtatcaatggattcagagagcagtagcggggacccccccagtcaattacgttccacagcaagagatctcagtggtgcatatccactgctggctcagtccaccccttgggctgcacagctctattcaggcctagctgccaggaagattactaggtatcattgtcaactcaggctctgtgcccagtaaacctggaaatgtctggatattcttccttgccagcatatagtcataaatctatttggggaagaacttgccatttcatcaaagtctgtacatgtatagcagggttcttcctcctagtgacctgtgacctagtaacccagccacctatgggttcttccatctgtggcttccttacctgaaaagtgcttcaggtctaggaactgagaaagggattgtgatgtgtcattggagccagtgcggttccattcgtgccttatttggttataggcgttaagcagcattcttgttagatgcccatctattttgcctataggggtgttactttcaattaattatctcctaaacaccctgtgaatcaaacccccttaactacccctccaatttcaccagttgttatagtaattatggcctcttgacttttggtaattaagcactagtcctccagagccctctattacttgagggtccattacccctgaatcatattaacaatcccagctctgtgaccacctcatttaccatcagccctggtctaaagagtaaagccactactgcacttagtgatactggtaccttctcacaggctcattcttggtggccttagtgaattgtcactatttcatgacatattcatcacagtatatccatcacatattcattcatctgacccttatgaaggtgtgatggttaatttcatcacagtacatacatgccattgtatagcaggtccttaactaatatagcaacaccaacgttctcaggcagaaccaatagaccctgttgaagggcaggcaagcccagagcaaaccatctatatgcagttcttttaacagcctgcaaggcactgtaagattagggagacgtttatcgaattatgttctgtggaaaactagttccataggatatgaactgatgtcaggagaaaaattaaattagaaatttgcttcagtgccagattctcaaagccattcgtatgtgaatgtttagtgcaactctccaaaagagatgatttgatgtgttacatgtggcagtagtatgatgtgcagcccagatcccccttcaaagaacggcttgctccccacttgctgggtgtgatgttagcaggcagcctgcagctgtcagccctcttcaggaattggcatagctgtagaaaaccacttcacctaaggtcacacttttttgtggagtggcccatagccaaggattgatcagtgtggagatacaaagttgttctcttgcccatctgaggacatctccgagggccgttttaactccagagctccctgtggggttggccaaggctgtcattggacctacattataactcattttctcccaattccgcttctctctctctttgaacaaatgtttggcaaaaggcacttcttaataaatatcctgcaattaaagtatatctcagaatctgcatcctggagaatactgtctgagacaccccactttctaattttgtttgcccatcaaagcccattccccgccccccttttttttttgacagaggcttcttctttcacctggaagggagtgcagtggtgcaatctcggctcactgcagcctctgcctcccaggctcaagcaattatcctgcctcagcctcccgagtagctgggattacaggtacccaccaccacgcctgtctaactttttgtatttttagtgtagatgggggtttcaccatgttagtgaggctagtctcaaattcctgacctcaagtgatccgcccgcctgggcttcccaagtgctgggattacaggtgtgagccactgtgcctggcctaaaaccctttttcatagagtacctaacaagagtaggccttaagaaatatattctggatgctggtaagtgcaggtgtgagaactaagtacctatgtggaaagtaaggggaggggtacccgagacttaaatctcagcttatgaattcctttgagatttgaaactagcttaattttgatgtgtaactctaatgcttaaagtactgcaggatctactatctatggaggtgctacggagaggatctaaatattatgtgacctatgcaaataaattttcttttctctgtaacagtgtttaaaactctaagataatccgtggttgtcaggtaaaatgcactcatgtctatctgacagatacaaatgttttgcattccagctgcttttagatatttaacgggagaggaaaagagaaaatatgattaaagcctttgaaagtccatttccaagaaataaaaactgcagtaggaattctacaaaactgaaaaatcttcaggactggaagatctatccagaaaagcccagtggattataataacttattaaaatatttgtttggcaagccactgactaataccactttaagatatgaatgcattaccaaaaaaaattggagtgagtagtttttacaagtctttgaaataatcatatttgtattttgacactaatttgaaacaaggagctggcttgaaatattaaacctaagtgatcagagacaatgagctatcagactgcatgatcaacgtagagcaatctccacataagatgagatgcatgcagcctctacaaatttggcttggggaggagtttgcttcgctcgcttgaataagccactgtctatggctcacaagggtcccgttcttaatgaggtggtgcgtagcagcaacacactgtgaatccaaatagcagatggcaacactgttgagtaggctggcagtctgatgtctagccaccaactggcagcaatcattattaaactgattcatgtgcccagggaaaatcttcataagagtcttagcaaatgtgagcagcaagaagcaaatgatctgctattcctatctgctatgagtactacctatatttcttaaaatatttttccccagtgcaacctacacaaagaaatggcatgttatgtgcactggaggccctattcctttcctatagatgcatgtatacctttaaacatgatagctgtgatttctctatttggtgaatagctttcccttgacggaaatagcttcatagcattcaccctatggatttgttgcacatattcaatgataggcaagcactcatagattctgtaaataaataactgaacatattctatctcacataatgaagcaatggcctacattgctcatagtccatctacatgagacaggtaactcatccttgggtgaaaagtttgttacactcacacttggttaggaaagcagactaagaaaggctctagctttagaaaacttatgtaaggatctttctacaagaaaatcttaaaggtatacatttaaaagttaagtctttatgctgggtgcagtagctcatgcctgcaatctcagcactttgggaggccaaggcgggcagatcacgaagttaggagcttgagactagcccggccaacatggtgaaaccccatctctactaaaaatacaaaaaattagctgggcgtggtggcacatgcctgtaatctcagctactcaggaggctgaggcaggagaattgcttgaacccaggaggcagaggttgcagtgagcagagatcacaccattgcactccagcctgggcaacagagcaagactccgtctcaaaataaataaataaataaaagttctgtctttacaaaccaaaatgctaaacaaatagcatttttttccaaatgttgaaagtatgtgttgtttgtaaccaataaagccaatttccacaactttatatgttaataaacaagccttaaggtaaggcttttattgaaaaacaaaaccctgctttattcacttacaaaatacttacagttaaattaaaaaacaaaaattctagccattctctaaatcttcattacatttttaaaaattaagatactagaattcttttacatgctcataataacaaggggaaagctgcagttaaatgtcagatattccacatgttaaaaaatatattttattttatgttccatttatggtaattttttaatagaagcaaaatttaaaatcttttttaagaagtaataaaatcactctgaatggattatttttggctttatcaatttgataaatcaatccaggctgaaatatcatttataacttctagagtgagtgcccctgctcttgtctcaaatatgagagtgattatcaaccaaagttagataccccagccctggcagtcaaactcaaaagcaagcttgcacgccgtctctcaagtctctcagcattctccccaaacaagaaatcaagtgccagagcttatacacttaatatttgagaccaaaaaagaaaactccaaacaagagatttactcaaatgtgcttgtctcccagttactttataagaagtaaatccatgtcagaagaaaagatgcccatgtcttgttctgcatgggaaataagtgccatgtactaaaagaagcctaaaaatggtggcacaagtttctttaaatggctaaaatccctcaaaatactgaacatctcatcagaccatcaagagttatgttttttgtcacacattatgaaattctagatatcccagcctgggcaatatggaaaacctcgtctctacaaaaaatgaaaaactatccaggtgtggtgccccatgcctatagtcccagctacttggtaggctgaggtgggaggattgtttgagcctgagaggcagaggttgcagtaagtcatgattgtgccactgcacttcagcctggatgatagagcaagactgtgtctcaaaaaaaaataattctagatatttgaaaaataagatagggtgatgaatgtttatcaccggatattagggtgtactcaatggtaagtataaagggaaaccagcaatgggtaggctagttcaaaagatgtattatatttccagatattctgataacagtgataaagacttgatggtgaataggtatgtcgatagcagtactgcagatgctcagtttgagtaagtcacccacactaccaaaagatgaatattctttttgagaacagaagaattctagtaatcatgagctaaggatgctggaaattcattcctgaaaatgtatatgtaccaagtagttgttttctgttctcccattcttcattaaacctgtccttatcaagaacaccaatgatgtccatcttgtccaaatcaacgtttcatactcagactctcacttactctaattctcagaggcatttaatgcagttgatcactaccatcatctggaaacacttccttggcttggtttctagaacaacagtatatgactagttttcctttttccttattggaagttcattgtccatctcctgtttagctccttatcaaaatcctgacctttgacatttgactgttgttcttaaatacactgtgtagattctgatatctgaatgaactagacactctgctatgtacattctaatgaggacagggactatgtgtgtctggttcactgccaatgtctaatacatggtggacattcaaatattcgttgaaggaatgaacgaatactagaacaacatatgcagtttgaatagatgagtgtaagtataatgaggatgatctggatattaaatagttcctaacattatttaattgaggtaggttttaaatattagaatcctcatctttttagagtatgaaattgatatttagacaggtcaaataacttgcccaagaacacacagctacaaagtgtcagagctgagacgtcttctgctgtgctagtccaaggtcatgctcttgactcagtgctatacttattgataaatacaacagaaaatgaggaataggaacccgagttcagcttatatttctcctggtcctctgctacaactgcggttgatgtttctgatggtagcaggactacaaatactagttgttgttgttggttttttttttttttacattcagaaagaagaggatcgtgtcctcatctgtaaaatagaaatgaaaatgctaccaatctaccttcttttgatggtaatttaaggctaaaataagataatcgacatgccacatataagtcacaataccaaaatcatgggggattttcatgtattaattattactacttggaggtactaaaagaagatctgaagtggagagacaaaaaatgtccttactgattagagaagcaggaagaaggcagtcaagaaggagctagaacattccttactgacctaactcaggaaaaaaaaagaaacgcaatattctgtggttcccctgttaacagataacaaacacccactacacaattaaagaattaaaagttcattgacttagccatactacattttcttttaaaacaaaaatcataaggacaaaaatctgctgatgctgtgagataaaaccgatgattctgcagtcaatttgttttgtacctgtgtggttttaccttccattcacccactgagacattacaatcagtgtatcctagggatgattggagataaagtaggcagaggaaattaggttaatgaggaagcatagagaaaggcagtcctgggacctcctgttcttcagaatatacaggtctttaaactgtaatcaggtagcacagttaggaatattctcaaaatttactttcaccactggattccagcttgtaatattcaattactatagaaaatgatgatcagaatggacttaaattctgaaacttcacttagggattttattcaggttatcttcttcctttgttggcaatatagccatcaaatctccattagggagagatacccaggtttcttggtcatggttgtgtctccactgtgagtgtcacacaagacatataagtcagttaacaaaaatatttcctaaatgaaagaatgcagatggctgactgggttgagctttggagtcactcagatcaatatttaaatctcagttgaggtacttagcaaataaaagacagcctcagcctcaatacgctcattatttaaattgatagagtcctcacaagggagttttaaagatctcatgataatttacttaaagtaattagattgcctggcacagccagttttcaataaagcatggccgttattatcaaagttgctaatcattgaaatggcaataccaaaattggctgtaattttattttcactagtttttgattgtttgtaaaaagagagatctgtatgtgtgtttagagataacctattctagagatttaggaacctatccaacaaccactttgtcttttgtgctgctacagcagaatgactgagactgggtaatttataatgcacagaaatgtattggctcacagtcctggaggatgggaagtccaaggtcaagatgccaatatttggcaaggaccttcttgctgcatccacacatggtggaagaagagggtgaaagaaggggctgaacttgcccttttatggtggtactgatcccacccatgattcgggaaccctcgtgacctaactcttacaagtcaatggtacttaaattttaacatgagttttcaaaccataaaacacctccaaggtggtttttaactttacttattaattgattaaattaattaattaaattgggtccaaagaacaattgctaagcatttactatgcgctaagatgaatgagtgcttttcttcatttcaaagtcttcccattgctttagtctctggagatcagctttcatggtgcctatacttgagtgatgagtagcaaggccatgtgaagtcgaagagacatgaacaagaaatgtgacatggttcatgatggctgaagggaaatatggctgctaataaatttgcagtcagatcatggaagactttaaatgatgaagtgaaatatttggacttcattcaagccttttggagagaaatgtcaaaaacattaacctcacaatgaagtgaaaaacaaagctagaagtcttgttgtagataacaaactgactcaaggaacacacatattgttaagactggaagaatggcatttaaagttctttctagtagtgtttgaaatatatcagaaggaaggaagtctggaactaaggtcataaaaggtaggaagctatttcaataggtcaagagtgaggtaataagaggctaaaccaaggcagaaaaaaagacacatgagatatgctgggtggtgctccacgactcttcataactttgggctaactcctttaaagccagggaatttggttaaataaaaaaatggaaatccacatctgtctcaacatttgtactttcagaggtataaatgtttccattttaaaaattatacatgaaacaaatagcaagttaatctggcatactgtcatgctagccagaaatgtgtgtgagcagttttgtaaactgtgccttcttttccattctagcattactctgtctttttccatgctgtccttgtcttcctcctggattttcagttgactcctcccttaaactttagatttagctggcaagtacaaaaccccttgcaaccagcaagacatattcttctaactttgaatctggcccatttttgtgtgatgacactttcctaaagagactaatattgtatctgtgagaaaaagtccgatgtgtgacttttcattataaaaatatccactgagtacataacattactcaaaaaaacaagaaagtgtacagaacaagtaaacaactaaaagggcagcaagacaagatgaatgtttcctagtcaaaacatgagaatacattttgttatctgtgaaatgtagaaaggttatcccgagagatagctaaggttaaaaagtactatgagagatacactcacacacaattatagataaatatactaatagagatatataaataccaaattcatcatattcactcttccccaatggctgctcttttgtatcccacccaactccactctattattcattgggttattaaaatcagagacctgggaagcacacttaacttgtcccttcccctaatctcccatacctaattactaaaaatcttctagttatattctattaactaaatttaccttgcccttacctaattcctttgcccttacctaatttgtataggataaagtacaaactctttagtatggcataaaggtccattagatagagccacattacaaccttatctcctatccttcccccattatatacacatgaacttgctgttccctctgcttggaatgattccaaaaaggagcaaggatcatttcctctgagaaccctacaatgctccctgcagcccaagcatactttcttaaagcacttaatacttaccctcaatattttctataacttacctgcctctaccactagacttaatgaaattcttgaagttagagatgttgctgcatctatcacagtgagaatcatccaaagcacgcacaagcacacaccatttattgtcactgttaatatgactttacgattcaactaccatcattagcatctcttcactatttcaagagacttctgcccaggaagattaccttacaagtgataatacagtattgttcatccccggaacttctctgaaatccatcaattcttcactagaaaatattaaccagcagttcacatcctgagattctttacataatgaatgtagatgaaataaatatatttaaatatattacaattatagtaatgtaatagggaatggaggagacttattaatgaataaaatgtacaaattaaagtacactttactctctttctctatagtgtctgacaattattcccactactcaaagtaaaaataccaagacaatgagaaggagaaaatcttcacaattttctgagctctgtaaagaaatgctttttttcaggtaaatctttgatcaaaacaaaggcatggtcaaaaatatccttaaacagtcaatcctgcacagtgcttgagtctatgcaactaccagtgacatggaaattgactgatggtgatttttaatataccaaaaatttttagaacaaaaaataaccacacatacgctgatctgcttaaaatacaatacatgttagtatttactgggctttcattcatctcatctccttttcttcttttactcaattcattttacctaaactctcaccctttgcttacttctaataatctttctctctgtcctgtagcaagcatgaactgccatcagaaaaattgcctataaattcagctttccctttggttagtctctataacctttttgctttaaatgaaacttggcagtgccctgagaacacaacttacccttgatccttctctcatactctatcttggttgattccagtgctacagagaaaaaatgcacaagataagcttggaatatcttgtcatacacataacaaagaagatagtgaagacacccaaggtcatattaggaggacccaggagctaacttagagaggctttcagtggtcaaagataggaacattttaacatcattaagaataacactacaatggcgaggcatggtggctcattcctataatcgcagcattttaggaggctgagacaagaggattactggagtccaggaatttgagaacagcctgggcaacatggtgaaacctcatctttattaaaaatacaaaaactagttgggcatggtggtgcacacctatagtcccagctactcaggaggctgaggcaggaagatcccttgagtccaggagattgggtccacagtgagctgtgattgtgccactgcactctggcctgggtgatggagcaagaccctgtctcaaaaataaataaataaaaagaatcatacctacaatggattaaagcatagcaaatatgtttaaatctgtgagttcctaactatactaaaaattattggggatgccagggaatcatctcattattttgaaaacatgattttgaaacaatcatgtatttacatgagctgtaacactgttctattaaataggagatgaaggaaaatttctgtttgtaaaactgttctaagggatttccaatctcagccatgcatgataaaatagctggtattgaactaacccttctgccaaaaacaactataaaagctggttgacatacaaatcaactgtttgaaggcattggcaaacaaacagtacaggctggactttctcagtccctgaaagaaggaaagcacatatggtgaggtctgtattcatgctatgacttttttctgagagcatttttcaaataatgactaagggaaatatagctcaaaccaaaagtgacagtcttattggactgagaggaaagaggtctgagttcagagcggccaatatggcttggaattgagtctcaaaatttcagatagtaaacagattgagagaaggatacaaaaatcttcattcaaattcctcaactcatgttaccaacgctagcacaaatagtgacaggtgggtaaatggagttaaactgttgagcatttttatatttgacagtaactggtgaagttactaatttaagactgcaataagatatggatgaatatattataattatatggaaagcactaaaagaattttcttaaatatgtaactaaaaaactgatagagggaatatggaataataaatgacactgattaatccaaaataattcaagaaaggaaaagtaaaatatcaaggacagataggacatacagaaaacaaatagcaagttggtagacttaaatccaactatattagtagttatatgagatacaaatggaccaaagacttcaattaaaagacagagactgtcatactaaattaaaaaaaaaaaaaaaacgaacaatcaccagcctgggcaacatggcaaaacctcatctctacaaaaaatatataaaaattagctggacatggtggcatgcacttgtagtcccagcttcttgctggggctgaggtgggaggatcacttgcacccaggaggtcaaggctgcagtgagctgtgttcatgccactgcactccagcctgggtgacgaagtgagaccctgtctcaaaaacaaaattccacagtatgctgtttacaagagacacactttaaatacaagggcacagaaaacttgaaagtaaaaatatacaccatggaatggtatggaaaatatatataccatgcagaaactaaacaggaggatgctagtataattttattaataccaagtaacgtagactttaagataagtgtattagtccgatctcaggctgctataaagaactgcccaagactgggtaattataaaggaaagaggtttaattgactcacagttctgcatggctggggaggcctcaggaaacttacaattatggcagaaggggaagcaaacatgtcctttttcacacggtagctacagagagaagcagggaaaagccccttataaaacaatcagatctcatgagaactcacttgttatcatgagtacaacatgggagaaccacccccatgatctaatcacctcccacaaggtccctcccccaacacatggggattataattcagattacatttcaagatgagattttgggtggggacacagccaaatcatgtcaataagtattactggaaatagtcaaaatgataaataggaaaataaaacattcctaaatttgtatcacctaatacagtatataaagacaacagtgacaaatccacaatcatatttggaaatgttacaatcactgacagaacaagcagacacaaaattcaaaaaatctgtaagaaaatagaaaatttgaacaatataatcaaccaccttaacgtaattgacatatagacaacactatagccaacaactgcaaagtgcacattttttccaagcgcacttagacatttaccaaaataaactaaagcaaatctcaacaaatttcaaagaattgagtatattcttatagagtatgttctttgaccagagtgggattagactaaaggatggggacataaagatactagaaaattcctaaatgtttggaaattagcaatatacttctaaataatctattaataagaggaaaaaatgcaatggaagtcacaaaaatagtacaggttcttacaaatcacttttgtaagttgatatgcttttgaattatccatttcatacaacagatttttggaaaactttagaggaagcttgtggtcttactccatttctctaacctttttttttttccaattataattccagcaactactagacttacgtttttaaagaactgtgaagggtctgtctgagatttttttctacttgctaagaagttagcctattacaattttaagatgctggaagaaggctcaagactcctgggtcagagctaaagaaatttatttcttacaacacagcaagcagcatgagcttcaagtttttcattggtttccatgtcttccaaatctcatgggagtgatatggtgcatctcagatggatgcagctcactagggtgaccacctccctcatttacctaagaccaaggggtttcctaatattcaagatttactttactgtaaacaggaaagtctcaggcaaattctgacaagtttgtcatcctgtacacacaagacttatataagagctgagattccctgagcttaggagatagcagacctttaaagggactgccagtaacttgtccatcctttgccctggaaagagacattatctttattattctaaatagaaagcaaatctgtcctttgctttggagggagacattatctttaccttccaaaactgtttgccatgcaaacacacttaagaagacatttcagaataaaagctgtccatgtatctgctctgaagatgtacagaaatgcaaaagatctgtggaaaattgtttcccaacaatatttttataaaattacagtacagttatagcacattcatctctactaatctgtatgctggcttagaagaggaaaatcctacactcttctaaattttcaccgagtttcctttcttaataatccaatacaaaatgtttgctcattatttttaataggaagtttgtgaaaggcacctaagtatactgaaagaggtcctctatctctcaagaataagttgctattttgtctcagtagcaaagatttaacaaagaaaaagatattttctactgtcacaatcatccaaggacatactaactaaatccttcccttggcatctagcaaaagaggtcagggtctgtgaataaggcaagggaatttaggagtgggaggagtaaatcagaaaacaaaaccaaaaccaaaaaaaaaaaaaaaaaagaaaaagaaaaccccgtgttccttttggtaaatgaagcatatcctaggagatcaaactaatctggactttatggaaatgtgtgcagtcaatttccttggaattcatcagcccgtaggttctagtcactcatattgactgtaataatgcaaatttcagtgttcttttccccgacccagaagaatttcagtgttctttttccccacccaggagaatttctaggaattccaggggaggtttcacaagcactcatctagtctgttcttaccgttcgtcatcttttaccactgggtaaacactgcatatcatgacgtctctgggatgctgggggcctcccaccacagctgaggcctgagtcccacaaaatacaaagcctcaccacatcgtgttactgcattaactttctattgccgtatagaaaactaccacaaacatggtgacttaaaataacacaaattatctcacacttctggagctcagaattccggcatagctcaactgagttctctgcttagggtctctcaaggctgaaatgagatgttcacttggctgagcttttgaatatggaggccctaggaaggaaatctgcttccaaactcattcaagttgttggccaaatatggactgaggtccatgtttctctgctggctatagccaggagccactctcagctctttaagaccacctgcattctgtggcacaacccgcccctccctaatcttcaagccagcaaccgtgcgtcaactccctgtcatgttttaaatctctgacttcctcttctgatcctacagaaaacactctgccttaaaaggggtcatctgattagatcaggcccaccttgattatccccatactttaaggtcaattaattcacttgagactttaattacatctgcaaaatcccttcaaagaagtacttggatttgtattcgaatgaataagcagaggtcagaaatcttgggtatggatgcatctttaattacatctgcaaaattccttcaaagaagtacttggatttgtattcgaatgaataagcagaggtcagaaatcttgggtatggatgcatctttagaatcctgcctcccagttactgtgtgaagatcctctttcatctctgcttcccactattttggagaggtgcagtaaaaagcaatgtttgtgcatttatatgtaagaatttttcgaagatcagatctttggggatttatgtatagacccattgctctccatagtatttcaaccaaaacataatagggtctttgctacaagtcaaatgaaaatacaaatgttgatgctatatacagaatcgcacaatcacgcagacaactaacgctttatcacagagtcagactcatcctctcttaggacaaatattttctcggaaatctcagtccttcaggaaaactcttttgaggagatggccttaccagtacaccaggcacgcccagacctgtctgaattccagttaagtctacagcctgttctcttactctatttacatactattgataaggaatctccaagcttcctgtctcagagaatatcaagcgctctgagctgctgctttccgaggaacacagagagcatgtttcttgctcagcggctaaatgtctgacttgtcatttgagacaaatggggatttatgcttctctcgtttctgtgcttcctcaaaggacaagcatcagagtttttgtgcttggaaagagtaagggcaaagtaccaattaaccaaaacacattgccagaaaggacaggtagagaacgattcagtgtcatttctgcaagaagatctgcaggtccagagccaagtaaaaaaattaggccttgttttctaaatatagcatggagaatagcagaatcaaaacaagaatggcatttgcattatgggaaggaatgatttagacctttccttttacttttttcatccagtttgctttaaacacacagctcagttgtgaactgactgaactgtgaagaaggcagacagaaatgtaagtgggaaaaaaggccaccaaccaatctttaatatttttcaactttgattggtaactgatgttggataaaatcacccttgccagaaagtaacttcaaaaagcaggacacagcactagtactcaggctacataatatgtgtcatatttttttttcaaagtctaagatccacataatgctgttcattgtttggcaaaaacaaacaagttagattttgtgtcttgacttctgaaaacatgtggaaaatagccaaatagattggtcagtatattgtatgtttttaaggagttctactaaaccactcattcaatagacagttgataaaatcagccaacaaaggcaatgaagaatttaatttcagaattttattttccttttatgagtctcaagataatttacgtagaagagaatgatgggcatgaggagagataccttccaggtttatattctactccccctcaaaactaaggaatctgagccacaaccaggttatatgtttatgcttaaccaaggaaaaatgatagaatctcctataacagatataataatcctataataattgtccattcctaactctgtggtttcaaatcagaacaaaaatgaaaaataaagtaagtggatacatggggaaaaggagaggctattttctgtctgtgaagaattaaggtaatgaattttcacaagaagaaatttgacatcgaatctaaattattggaagacaagtatatataaatcatttccatatttatgcttagccagccatggcttccaaaaaataggtgcaagtattaaaattcaggtaaaatgagaagtaataacccaaatcacttaaatcttagcttctgttaaccatagataaagacgtaaatagtacttaatagctgaaaactaccaaaagagctttgagatgtaatggttaagtgttgggactggaagtcacatagactcatgtttggtgcctaattctgccctttttgtgactgggtagctataggtatttttcttaacttctctgagcctcagtttccttgcctataaggtataaagaacacctttcttgtttttctactgcatatgtcttccatggcctcctttcttcattcctcctattgtgagataatgtggcagagactgactacatagtccccaaacctgtttcttatttctgggccagcagctgaatgatggtgtccaatagccatgcatccaggtggcccatatgacaggcctctccaacagaacagaagcagaagttatgtgtctcatccagtatgaggcagtttcttttcccctcacagggtaatcttggaggccacattttgaagatggcagaaatactacatagaaagtctagatccttgggtcaccatttggaagagagctgcctgaccaggaacatatgtaattgactctgcctacgtggaaaataaatttatactataataagccattgagattttggggttgtttgttacagcagtattattaaccctgccactgaaattggtacttcaaaatggagcattgctataataaaaacatgaaatatgtgtcactagcttggcacgtgggcaatgaagagcaagaacacagtgataacaggcagaatgcctacagagtcataccatacagtgacataatatctattaaaattgtcatctgccataaaatggaaggcgtactacatacctacttagcaagtaggtttacggggagaggttggaaaacggagaatgaatagcatgcgttggttgttactgactgctggcagcaaagtattacaagaaaaaagctcaggaaaggactggccagtttggggaaagactttaaagggaatgaggagtacagaaagtcaagggctggctgggtggaaaagtcaactatttctgaacttgaaatcatagaagatgatatttaaaaacagacacgaagcctagagggaagcctagtaccctcttggatagaatgactcagcctttcagcaaaaagatattaagactggtgttcccactctagcctggcagcttcaaggttgccatcattaagttgagtatgtgagacagtgagctgaagaagcaaagtaaagcaccctggagaactatatctaggaaggtactttgggtttgataaacacatgaaaatgagtaagtagaaagctactacatttttttgagaaatacattgtccagtaccagaagtctgaaattaaaatgtcggactttcaagacttacaaaaagcttgagcctttaacttccatgaacaaataaagttaggaaagttgtataactcccaaagagggcttacacttaatacccagttcagagaaggccatggaaaataataaacttggaagaaactgctagagggcaaagccaggggtcacagaaagcaacagactaaaaaaaaaaaaaaaaaattctcaaggacagtagaaattggcactaatcaaaggacttctcctactccagactgacaaatcctcacaatattggctaagtggaatttcagaattgccatagcctaatgattttcctgtgtctttcattctaccaattttttaatgagaatatttacaggttgtcttgtgcctgttttactaactgtgcattggggatggagggtagcaaactgatcactgtcttttcagatcatgggctacacaaccataaggagccacatctaggactaaaggagagaatttcacatcacttgaacatcttggacctagaactagaagcagggactgactcgatgagatcttgtgttttccacttaagaaaggggctcatttattctatgtgtgggaggaagcatgaaattggtatttgatgaccaaaagggcaaactatggcagaagcttatagcttatatgatacttatcaaatgttttgttgttgttgttgttgttgttgttgttgttttctcctggggatactggtaagctacatttccagccctcttgtgtgtaagatgggaacatatgtcaagttcgcaccaatgtaatgtgagcaaaagtgatgtgtgccttcctgcctgaggcagttgagagcagacgtgtcttcttcacactatccatcactctgaggcgacagtaaaggcccttgttgaggatatcagagctttctatgaaggagagaaggcctgagtctctgacacagcagcacttggaggagagccattcaggaagactgcccaacatctgcattagactcatgtgaatgaaataacttgtattatgttaagccacagaaattagcaaattgtccgttactctgttagtagcctctctaaagaatagctgtgtctcaaataatttggccctcctttcccattagagttgatggcctcagtatggttacctgaccaaattatcttacctaggaatttgaaggtggaacatgtactaagtcagtttgctaggaaaagccaaactttaaatcgatgtggcacccgggggcccaaatggtaaattagtgccataagcaagattaagttgtagagaaacagaaaatccatggggaagaaaaaaagagacaaaaacagaaaccaaaaacaaggtaagttttcagggataagcaggagacagattaaattagcagaggagagctatgaatatgccacgccctgtggcagccatggatatgcgctccttgaatctcccgttaaacaagaattcgccaaccattagcacctccaagatatgcctcagcctttagctgaggttgtgttcttcctgagaagcttcagccaattactgggcacactgtgggtgtgagggcctggcctttaatgcctcatgtgagactcctcaaatggtaatctttgctcacaatctttgcccattgttggattggttgagactttgtcaagtctgcatcacggtttgaggttccccctgccctatctgagttcttcattctttcctttcatgtcagagcaacagcgtgatatgaaggtttttcctccccactcttgcttcctctccgttttatctttcataggcatttctcctccaataaacctcttgcactttcaagtccatttcagtgttggctcttccatgccagaatctaaagtcattttaagatttttagaggttctaggtatgaaaaagattgtggtgtccctaactgtaattgtaaatataaataatatttaatcataaaatatatatgaagcatttcaacaaaatccttatttttttcataatgactcccccaatgattcttttgtttgtttgtttgtttgtttgttttgagacagggtctcgctctgtcacccaggctggagtgcagtggcatgacaatcatagctcactgcagcctcaacctcctcagttcaagcaatccttgcgcctcagcgcccccaagtagctgggactataggcgcaggacaccacacctggctaattttttttgtaatgttttgtagagatgggggtctccgtatgttgcccaggatgatctcaaactcctaggctcaagtgatccttctgcctcagcctcccaaagtgctgggattacaggcatgagccaccacacccagccccaatgtgtttttgcttattattttgaatttgaaatttcaaatcccccccaaaaaaactacctctattttgcttgatctttaaatacatacttattatacctttggggtaatacagaactgcttaagcctcactttgggctcaatcttcaccccagtgaagttaaaatctgaaatggatttgggctgggataagggattgagcttgtattagttatatattgctgtgcaataaataaataaaccacaaacttggcagctgaggacaaaacatatgtattatctcacagtttgtatggattaggaatctgtgtatgtctaaggaatctgtgcacgtctagttggggcctgtcttaaggtctctccttggctgtgttcacaaagctggggtctcatctgaaggctggatggggaaggatccacttccaagctcacttagttgttagcagccaacaggcttttgaactgaaggtctcagttcctcactggctattgaccagaggctaccatcaattccttgctaaagggacctcttcaacctggcaccttgcttcattaaagcattatgtggagaaatcaacagggagagtcaactagcaagatggaaatcacagtcttttgtaacttggatcagggaaatgatatgccctcaatgttgccagggaagagatcacacgaggcaataaatatcaggaggtgagtctcattggggccatcttagaggctgcaaaaatttttaaaaatttattatattgattagttgaacatttaaaatgctaaaagttgaacaattattcttggtacacattaatgcattttaatcagtttctttgcttttaacatcatgtctggtatttttctgaagaatgtgttttttaatataatatttaaatcttttttaaataagattacctccagtgttcttaaagttacattttgtgattaataaaattgaaatcattatattcttcattggaaaaaatgaaaaaggaacaaatcttaaaccaaatgagacagtggcataaatcaggacctctctgggcagagtagaacaatatgtacttcttaactacagaagcagagagaaagggagagatagagatagatagatagatatagatagatagatagatagatagatagatagatagatagatgatattgatttcccatgcagatgtcaaccgtcctcataactggaggatatcatatttctaatggtgaaacactagcagcaaaaagtaagggataccaattgtgagaaacaaatcacaactgcacatcaaatgtttgctgacattggatctgtgctgtcttccagttgtgccatcctattttactccttaagaaatgaggaaattcctatttgggggcatcaactctccctcgagaaaaacaaagctgctaagtaagattccacctagaaaaggggaaaagcatatatcagagaaacacatttatacccccacacaaaataatagcatgagctgtgttttagaggagatagggtgccaaaccaaattcactcctcttaaatcaaagcttccccaagtgcaagtacatggccacattggggaaccagatccaagttagagaaaaaggaaatttagtgacaatgactgtttcttttacccttcagggaaaaaaatccaagtagaaagcatctcttttccagttcaggttgaagagtcctttcctcctgtcacatgtttagttgtcccctgaggttagcggtgcaagctcacactctccagaagagccacaccaacccagcctaaaatggttacttagcttcattaaatcaggtcacagtgaaaaggataagctttaattatccactgaagtgatctttgaatccagtatctctgttttctcaacatgatctcgtagcaggaattatttctctcaagaaccacaagagggagtattcttacttctttgtcactgtccatctctgacactggatagacagtacccttctgcgtttttttaatgataagacatattattaaacaagcttcatttttattcatctaaaatatgagtgattatctgtgtgtctttcctatgtattatatccaggacattttcttaaccagccatgataaaagagaaagcagacagtatttcatactggttctttctctcacatttattatctggggattgtgaaggaggatttctttgtcaagttgtgttcagcaagtgcaaaatagcaatggatgattctccctaactaggaggaaaggaatcatttatctggaaataattataccactgctttgagctaaccatctgcctagtccttaaaaggctaaaagcaaaccacaaacatgattctgtccattttcatcatatgcctatgaggtaaagaggtgataactaatactttcttcaatgaccaaagtgcagtacaaatcaggaaagtatcgatcttatgtaagataccacattgactgtgtcaactaaagtaatataatctgctaaagtaagcaaccccaaatacccacgaattcacacacacacacatacacacacacacacaccatacacaaggcttatttctcactctggtcactgtctgatgggagttgggtaactagtctgggctgctttcttccaagtgatgattcagtgattcaggttccttctattgtgtcactccatcatcttcacactgaattttctcttggctgtcaagtaaagagtggcataatttcaggggctaggcttggaagtagtatactttgcttctgtcccctagcctggctagaacccagtcacatgatcaacttagatgaagaatgaggcttccagtatgccaggaaagagaatgcacaattactgagcttctagaccaggagtttgtcttgtttttggtttagtttttgttttgagacaaggtctcactctgtcacctggctggaggtgcagtggcaccattttggctcactgcagcctccacctcctgggctcaagtgatcctcccatcgcagccttgtgagtagctaggaccacagacaacaggtggcgtgccattaccactagttaatttttgttttttttgtagagatggagtttcaccatgttgcccagactggtcttgaactcctggactcaagcgatccacctgtcttggcctcccaaagtggtgggactatagacgtgagccaccacagctaatctaggcctagagtttttgacatggttttcatgggataccaaaagttctgttagcttagatggaaagaaattccattctaacctcaaactgaaatttagcatttccttccattataaatgtaggtatgatagacactggtagtgcccaaagccatttctactcagtccatctgatttcagtgcagctgacataaacaattccatgcatactatcagcgactctctgcaggtatgacatctctgtggtttttgttttgttttgtttgctttaaagatttatctgaagtcttggaaggtcactcagtagatgcaaggtgcagctcagaagtgcggagggttaataaccatggggacaacactcaaaccatgctaaacagtagtgtttatgtaaacagaccagtctcgagttctttagcaagattattctgaggcacattctataaacttcgaagtttgcaagtagcattgagttccagttattctcagcagcaaccaacacagtaagatttattggcttttctctctttcttgtcttattctcctcactgtctcacttctgtttcctgggactatctcccaaataaactacctgcaccaagtcattatctcagcctctgatttcatgacaatccaatttaagcattggtgtgggaagaggctctagaaaaatgcccctcattatagactttgaaactgaattactaaacagtcagatagcaactgtcacatgtggcaagtgttgggaaaggagctaactcctagattgttgtggcctcacaatgactaagaggcttatctatggcatattgggatgtggtacaggtgaaaggcgtatgctgcatctatatcacttgaatggtatggggtaaatgtaatgaaaagaacgggatatgtaggtatgactgagagcctagaatgcccagcttatcctaaactctaggtcatcaaaagtagtctctgccccttgctagaaaagcagccttctattgccaggagaccatgcagtgatcttaaagtagatgcttgtaagataatgcttaaggcctgccctcacttcccttcattgactccccttcccttcactgactcccggccagtagctaaagacctcagcatagtccaagcaaggaagaatacttcttgctacaagagtaaatagcttaccaaaagatttgcaaatcctggctcatgtgtactgacaaaagctgggagtggatcttgagaataatagacctgaggatatggggcataatataagcctcacaatggggcagatgattaacatggttgcactctctcaaaagttaatgtactagcaaggacacctggagccagttctaagatgacgctgcaatgattcttttgagcttggacacgacactgtcttacaataaatgagttagagatgacagattgtgttcagggagttgataaagggaacaaaatgatcatcaaatgggcatctttaaatcgattaattatgtgagcaatgagaacctactgcctgattatgttccgtggaaagggaagacacatccttctttagggtgcaaggaatgcaccagtgagggggacaccagcatcactgagacactcttgggtgactctactttgtagcccaggattgactggggtagatgctatcttgggactagaatccttagtgtcagtggggatggtagaattgcataatagtggagaacaactagtagcatttaactatcagaggcaacattgatatcattaccataacagaaagcaagagcatagttgccacttgtttgccttgatttgtagagatctgtggtcatggtcattagaccatcgtgtcctcagagcaaagtataaaaacagtgaaaagaacaccatatgctttagcagtctgccaaaaggctcaatgcattaaaaaaaacaaaacaaaacaaaacaaaaaaaaaaacagctttgatcaatcctatctctgatagtctacctacctgcttaccaaatattcattttgccctttctgctgtacatagtatgcagtcacagttcaaaagaggcaattcaaaacagtatccactcaatacatcaagttcattccaaatcttttaaaaattacaaaacaataaaataagtagatatgtattttgttcctacagtaagtgataaaactccttccatagcaagagaaaacagagcttaacaaaacactcagcttctatttcacaaaagtctagataccttttgctatgtaacaaacctcttcaaaacttagtgacataaaataatagcaatatttatatttcccagaaatctgaaatttgacaaggcttggcagagataatgtgccaagcatcttctggattagctatggatgtcagctaaaacacctatacgtgctgtctatatgtgcactcacaacatggtggctaatttccaatgatgagtttctcaagaaggaaagccacaaggaagctgctgacttttttagcctgactgtggtggtagtgacacagcattacttttcaatgcattctattagtcagatgcaaatgacaaatataacactgaacaatattaaagaggagggtagttaaagcaaaccttttgatgaaaaaagtgttaggccgggcatggtggcttatgcctgtcatcccagcactttgggagaccaaggcaggcggatagcttgagtctaggagtttgagaccagcctgggcaatgtggtgaaaccccatctctacaaaaaataatacaaaaaaatcagctgggtgtggtggtacatgcctgtggtcccagctacttgggaggctgagataggaggatcacctgagctcaggaggtgtgggtggcagtgagccaagatcacgccactgcactccagcctaggcgacagagtgagactctatctcaaaaaaaaaaaaaaaaaaagtgataaaaagtttgtggacatgttcacaaaccacaacatgcacacatagttttcccttattgatctaactggctggctacatgtattaaaaaaaaatacttgtttgaaaatgtaaaacctgaggctaatataagactgggcaggatacttactggataggctcaataatagaatggaagtgacaggaaagaggacttggggacggtaccttttggtctagtatttgtggaattggcatcccataaggaaagaaaaagaggatggtgcagaaaaatatctgaagaaataatggctgaaaatgtcctaatgttgatgaaagtcacagatttacagattaaagaagtttagtcaaccccaaacagaataaacgcaaagaattccatgccaagatacattataatcaaacatctgtaaactaaaaataaagaaaaaagatttttttaagcagtgagaaagaaagacattaactagaaaatgggaacaataattcaaatgacagtggatttctaaactgaaatcatagaggccacgaagaagtgactcaacattttcaagtgcaaaagtttccttcaggaataaagaaaaaataaatgctttctcacatgacagaaaaccaagaggatttgttgctagaaaacttactccaaaagaattgttaagggaagtttttcagatcaaagtaaaatgaaaagtaaaaggaagactttgaatatcaggaataaagagaaagcaacagaaatggtagatacttgggtaaatataacttctcgagctcttaaaaatacatttgatagataaaaacaaaattgtcatattatctgatgatttatttaatgtacatcagtgaaatatgtggggaaagtacaacataaattgaggaatattaaaggacctatatggtgctaagctttcttcattctaactgaagtggtaaaatatagattctaaagagatcatgaaaattaaatatgcatacctcttgattgaccactacctaaactgttaaaaaaaaaaaaaagagaaagtcaagcacacaatagataaattaaatggaatactacaaaagtttatataatccagaggaaggacataaaggagaaacagaatagcagaatatggaaaaggaaaaatagaaaaaataaaataaaattgtagacctaaatccaaatataccaatattacattaaaggtacatagtctaaacacatagagattgtcaggaaagatttacagagaaaaactgtaggcaggttaaaggtaaaaggatggacaaagtatatcatgtaaacactaatcaaaggaaagctaaagtgataagaagggatattacattaatatagataaatttaccaagaagccaaaacacttcaaaatgaatatggacataacaacagagcatcaaaatatgtgaagcaaaaactgacagaaaagaaagagaaacaaactcataattatatttgacaacctcagtttctctcagtatttaacagaacaagcagacaaaaatcagaaaggatgcagaactgagtaacagtatccactaagtggattaaattcatatttatgaaaaacttcatcaaataaagcaaagtacaatttttcaagtgcacatggaataatcaccaatatagactatatcctgagttacaaaacaaaacttaaattttaaaaaattgataccatacaaaatatattctctaagcataatagaatttaactagatatcagtaacataaagataaccgaaaaatttctaaacacttggaaattaacatgcaataaacaacccataggtcaaagagaaaattcatggaaagttaaaaaatatattatacccggccaggcgcagtggcccatgccagtaatcccagcactttggaaggctgaggcggatggatcacttgaggtcaggagtttgagactagcctggccatcatagcgaaaccccgtctctactaaaaatacaaaaaaattagccggacttggtggcacgtgcctgtaatcccagctacttgggaggctgagactggagaattgcttgaacctgggaggcagaggttgcagtgagccgagatcacaccattgcactccagcctgggcaacagagcgaaactccatctcaaataaataaataaatagaggggaaaaattagtttttattaacctttgaaaaggttaataaaattaataaagctctagcaaaactgaaaaagaagaacagagagaagacataaactaccaacaacaggagtgaaataggggatatcattacagactctacaaaaattaaaaggaaaataagggaatgctatggacaattaattatatataaattcaataatttatatgaaatggaccaatatctcaaaatccataaaccaacaacacacatccaagatgaaatcaatattcctgagcaaccttataactattaaagaaactgaattttttaatgaaaaaaatcttttaaacaagaaatctcttggcttagattatttcacttgcatatttaaagatgaaatagcatcaattctgtagtctcttccagaatataaaagcttagggaacacttcccaaatctgtttatgaggccagaatttctctgatatcaataccagacaaaaaggtcaacaaagtaaaataaatctacagagcagaatcattcactcctgaacactgacatgaaagttctctacaaaatatcagcaaatagtatacagcaatatataaaagaaataatgaccactggataccatggccaactatatatctaccacattaactgtctaaagaagagagaccatattatcatactaaagatgcagaaaaaccatctgataaaattcaccatcacttaattattaaaaaaaaaaatctatcagccaagtaggaatagaagaaaacttccttaacatgctaaagagcatctaccaaaaaacaacaaaaacaataaaaacctctacctaacatcatatttgttgatgaaagactgaataccttcccccttagatcaggaacaacaaaaacatgtccacttccatcactcccattcaacatcataaagattggataaggagaaataaaatcggtcctgtgtgcaagagatgaaactgtcagtgaagaaacaccaaagtaatccacaaaaaaccatgatgaactaataggtgggtttagcaaagtctcaggatacataatcgacacacaaaaattgatctgtggtagaaatctaacaaaatatttgtaaaacctttatactgaacactatacaatactgaggaaagaagtcagtgcagtcccaaataagtggagacatactgtgtttatgggttagaagattcagcataataaaagtgtcaattccaatgtaattccaatcaatcccaacatgattttgtaaacacatacaagctgattctaaaatttatatggaaagacaatgaaactagactaaccaaaacaattttgaaacagcagaatgaactggaaagtcatttaagaattactacaaagctataataatcaaggcagtgtgctattggtgaagagataaacacaaagatcaatggaaaaaaataaagtacagagacagacccacacaaatacacaaatatggccaactgattttttttacaaagatgtgatggcaatttaatggagaaagaatcctcttacaagggaacaactgaacatctatatgcaaaaaatgaatctcaaacctcaatacctctgaagtggacttggctcaattaagacttgttgaaaagctctctgtagggctatgttacaaagccgttagatgctaagggatcaagagacctgattagccacactggaacgtgactcagtgtgaatcctggatacaaatacaaaacataaaactacaaaactttagaagaaaacatagaaaaccttcatgacatgaggttagacagagattttagatgtaacatcaaaggacaattcataaaataaaaaaattgatacattggactttgtcaaatgttaatacttttgtgaaaggatgttgattgaaaagaccgctggacacagtggctcacacctataattccagcactttgggaggccgaggtggaaggatcgcttgagcccaggagtttgagaccagcttaggcaacatggcgaaacctcatctctacacaaaatacaagaattagccaggtatggcggcacatgcctatagttccagctactcagcaggctgagatgggaggacagcttgagcccaggaggtggaggctacagtgagccatgatcacaccactgcatgccagcctgggtgacagagcaagaaagaccctgtatcaaaaaataaaaataaaaaggttgaaaataccatcaattctatagtctatcaattctagcaattctatactatcaattctatagtcattaactgagagaactcacttgcaaatcatatatctgacaaagatacatatctcatatatatctggaatatataaagaatattaaaaaacaccctaaacattcaccgacaagtaaacaaataacctaattttaaagtgagtgaagtatttgtataggcacttcaccaaaaaaaaaccccacaaagttttcaaataaccacatgaaaatatcctcaccattattattaaatgcatgatgtaccacttcacacctatctgaaaagctaaaattaaaaaaaacaaaaccaaacctgacattaccaagtgttgctgaggatggagagcaactggaactctgatacattcctgaaatgaaaatggtagagctactctggaaaacattttgacagtttctttttaagttacatatatcttgccatgacccaaaatcccactcctcaatatttaccttagagaaatgaaaacagatgttcatacaacatatgttcacacacacacatatgttcacacgtgcccaaactgccaaaaactagaaccaacccctccatcaatgagtgaatagaaaaactgtttactgtggagtactattcagcaataaaaggaacaaactattaacacacatataaacttgggtgaatttcaaaggcattatgctgagtgaagaaaccagtctcaaaaattgatgattccaattacctgacattctagaaagagaaaaattatagctacagaaaataggttagtgtttgttatgggttagggctggggaaagggtatggctacagagagagagcatgagggattttgaggggatgatgaaactgttctgcacttcaattgtaatagtggttacatggatatatacatgtggtaaaactcagaactatataccaaaaataaaaaatgaatttgactgtatgtaaaatctaaataaatttaaatttatttaaaaaataaaatgtcaataatttttaataatttaaactctaagtaaaaaatagttatcattttcagatctctaactacatgccaggacctttcttttttttatttttgtttttatttttatttttttgagacggagtctcgctctgtcgcccaggctggagtgcagtggtgcgatctcagctcactgcaagctccgcctcccgggttcatgccattctcctgccttagcctccctagtagctgggactacaggcgcctgccaccacgcctggctaattttttgtatttttagtagagacggggtttcaccgtgttagccaggatggtctcaatctcccgaccttatgatccgcccgcctcggcctcccaaagtgctgggattacaggctggagccactgcgcccggccatgccaggacctttctagctaaaggctttgtgttcattaacttattaatccttaccatagtcctgtgacttaagtatccttattccacagatgaggaaatctaaacatagagagatcaaataatttgtccatgatcacacaactaataggtggctcagttaggatttaaacttatctttatccatctagagccatagtctttaccaatcattactttgagcattgggacagaaaatcaatcgctggtagaaggatatgctattactttatctcttttccaaactttttgaagaagactaatagtaggatatttgtttttgatgtttaagatgggtacaaactaacacttactcttggcatcaaaagtgaaaggaaaagagttttagaagtctgccaaatctcaagatatatgagaactgtaaaactttcctcatctacaaggcaaatagctaagaaactcaaataactgacttttttaaactgaaatttactttcatgcgaaagatataaatgacaagtaaacaagctgatatcaagaatttctgaagcaatttcaaaaatataccctagggtcagcatattttccacctaatttcatagacagtctacttagaagtgtagaattcaaatcaataagtatttgaccacctactatttatgttcattatgataactgtattacttcgagatcctgaggtgttttctgaatcattaaagcaagtttaacatttttcagtatgaccttataattatttattttgtcattttccctctaaaataattgaaaacccattactatttagccagattactaaattaactattaaatttcattccctcaatcatttcagttaataaaagttcaaggttgctcaactgttttaaaagaaaaattaaaatcaaaagcaaaaactaatccttgtctttgttaactatacttcctggttactgactttgagttgtgtcatcaagacacatcacagcctttcaattccttttctttcatgtaactctagggttagagttgatactaaattattaaaaggcaatttaaactgatgtgagggagcatgcactctcagcctcttttctttgcacccatcacaaaatgttcatgttttgatgatgctgggagactctgctcaatttaattcaactgcttcaattctgtagtattctgccaaacattgtattagaccttgggagtcaaaaattaagtcaagcatgagccttactctcaagttactcaacaacaaataggaaacacaagcatttaaaataatggctctaaaaatagacatctctagagtctagaaagatacaaaggaagaagtaactttgcctgggtgggtaaacaaaggcagcacagagccctataaaatcactgaatagatcttagcccagccgtaactatgtcacatccctcagctcctgcaggacccataaggtgagcaatcatacagaaaacccatgaggtgtttgaggaagttttatgaaatcatgcattaatccagagttcagcacactttttctgtaaaaatccagatagtaattattttaaactgaattccactcggtctttgagtgaaagcagccatatgcaatatgcaaatgaatgagcgtggctatgtcctaacaaacatttacaaaaacaggtgattacactgggtttcaggggcatggtttgccaattcctgcgtcaattaaatcaatacaactaaatgtatgagtttcaaatataaattacttggtcttttactgatgaaaccacaaaagagttatgcctatgaaaaatgacccctcaccaataaaattaataaagacccaaatccttttttttgcacatatctaaaatagaccagccttcttatacaaacaaaatctccactcctaagaactttcttcctgcttaacaaattgttacctttactacctaaagttttggggaatattaggaaaccctggaattaaagaggaagagcttcattaattgtgttcctcttcttactctcagacctctgttttcaagggtccaagaatttgaacagatggaaatgtatgtgaactgtgtgtggatgttctatgttccagtgcagctaatcaggtctcttgatcccttagcaactaactgctttgtaacatagccctgcagagagcttttcaacaagtcttaattgagccaagtccactccaggggtatatgcatagagcttgacccttgattttgagtgagacaggagctacctgttgacgcatgattcaaactcctttcatcacggtgtctgaagaataataaaaagtggagctgagactgacgtaactagatgataatggatgggggtggtgagaaaagtatgaatgctatgaccagattacccagatttgtagctaaatctgggatgttactttcttaaaaagtgcatccagcatcatgtagaagcactaaaatttaggtaagtcagcaggtcagaaaaaaagcagtacatgctttttttcaactgctgttataaaaacatagtaaataaatactgttgaatccaaaacataaacagctttaaaaaattattctaatgctttagcaaaggtaatgcttttattttattatgagctgcccacgtgtacttctcaggttgtgaatcatttgagcaatttttcagttaaggaacattttgttctagaatgaaaataatatcaaatgcccctcagtagtgtggggttagcataaacatggaatgacaggcagtttaatataaaaccagaataatgacatcatcttacagtacattgaagctgctatatgatttcttatgcatagcattttggttttcatgagcataatttcagggaccatattttgatgagtcacagtcttgtttacagtgctaacattttgttctctcttgtaactatgataggagtctgaagagattttcaactcattcactgaagctgctacttactgtctgctgctgatactctttgcaaaaaggattatagatagctctggatttcagaatcttagatatttcctaaccagagtgcaaggacctaaaagcccttaatcgagtttctaatcacaagcaagatggtcctacattaagggccctttgagagtagcattcatgtcattgtatctttgtcccatatcaaataggtttcttattttagcaccaaaggcaattctttccttgtagactgaagagaagccctaaccagtcagttaaggaatagaacacagtagctaccattttattctctctcccacaggactctggaacctattttattttgatgaacagctatatattgaatgccattttactagtgttagttcatttcatcctcataacaaccttgtgacgtagttactattgttatctcaatgtacagaggagaaaatgagacactgagtgggactcagggattgctccaggccacacagtcagcaggaggcaaagcccagattcaaatgcagattactcagctccacaatccacatcctcacaggaggctgcactccttgcccaagcgtcagacaggagcaaagagaaagaaggcaaccagctggctactttcttcccttcttggatgcctccaacagggtgagaaggactaaacaaatgaccaagtgtcatcccattttggacatacttaaaacaccccatggaatttttattctgactttcttctgcctgtgtggcatttatgtttaaataaaagagaattcaactcgtatgtctgatatcttcatgactagtttgccagggatagtccccatgtacactttgttgtatcgttgacctgttcagtttagcatttgctcagggatttccatttttaacctagtgctattagcaacagttgtgttaaacatgctaagatgggtctggtgaactttgacttttcgagcttcagtctggtctcagcaaggagtaactgagattttgtgcagtgagcagagttccgactttaacacatggttaaatctgattgacttccaaccctctctaaacacaaagtaactaacagcaacttcccaagtacattgctacaagctgaatatttatgttccctccaacattcagatgctgaactccttaccccagtgtgagggtatttggaggtgggacctttgggagattcggtcttcataaatgggattagtgcccttataaaagaaatcacagagagcttcctctctccttctaccatgtaaggatgcagcaagaagacaccatgaaccaggaagtacgtcctcaccggacatagattctgccagttccttgatcttgacttcccagcctccagaactacgagaaatacatgtctgctgtttataagttgcccagattttgatatgttgttattgtagcctgaacaaactaagacagacatcatgcaggactcagtaacaaaaggaaatgcacacaaacgctgtcttggtgtttgctgccctgtcagcttactggtggcccattcagtggagcatggccgatgcacaggttcttaccacaggcctcgccacagctaacaagatacctgaaactgtcaacttgccagttggtggagtctttgagaaatagggaaaagtatagggttaattaagatgagatgtgcaggggaaataaagacagagatgtcctaacccataggtaattgtgttgttgttgttgtttttgttttggagacggagtctcgctctgtcacctaggctggagtgtagtggcctgatctcggctgactgcaaccttcacctcccgggttcaagtgattctcctgcctcagcctcccgagtagctgggagtacaggcacatgccaccatgcccagctaatttttgtatttttagtagacacagggtttcaccactgttggccaggctggtctcaaattcctgacctcaagttatctgcccacctcagcctctcaaagtgctgggattacgggcatgagccactgcacctggcccctataggttattgactatagtacccaaataagtaccaagaaaaaaaattcctgcttatataattttaatatacagataattcatataagtactttaaaaatattgctttaaaatacaaaaggagcgagactccatctccaaacaaacaaacaaacaaaatacctatagtttaggacatctctgtctttatttcccctgcacatctcatcttaatttaccctataattttccctatttctcaaagactccaccgactggtgagctgacagtttcaggtatcctgttagctgtggcgaggcccgtagtaagaaccaccacatcggccatgctccactggatgggccaccagtaagctgacagggcagcaaacaccaagacagtgtttgtgcgcatttcctttcattacttctttattttaaagcaatggaatttttaaaattatgattatatcttgctattttatttttaaatagtttttgaatagaatttatatgtttacaaataaaagacaatcaatttagcaatcagttattacttcaagaattatgtaattataattataagcatgccattttattctcaaatttttatatggtcaccctatgtggggaggaaatccattacactgtaagacagcccttctcatccatggttagaagctacaattactagaaagttcttcctcacacttattcaaaatttcctttctaataaactttttaaaatttaattctgccttctgtacctacataaattcaattccagaacctcttccccagtagaaatattttaaaatattatcttctgtttcttgtctacccaagcagatttgtaatatttataatccctgtatatctactttttcctacctttttttggtaaaagcttttggaatgtttagtcatataacaaataaacatttgtgcctgctttgagtaggcagcaagaggtacttcttttttaaaatcacttatttttttctccatggtgatggtagtattctcattttttcaccctagtgattatttcttgcagagacagtgaatacttaaaaaattttaatggaaggaataaaaatattccttcagcgaaaagaaataatagcaagatactgagatgaagatttcaatataccaattacagaaaattggcataggcttcttaaaagggcacaggttttcagtttagctccacctcatatggttttgtgagggttaaataaaacaatatgaagaaaacagaacagattggaaatactatgtatacattaactcttttaaaataattcatctttttagatcttctttctgaccaaaaataaaaagggaaaaatattaaacagttgactcttacaaatatacggggaaattgagagaaatttaaaatttttaagagactacaacgtatatcctatgataataaatttgaaaacccagattaaacacataaacactaagaaaccaaaaattaccaaactaattcaagaggaggtaagaaatctgaactgatccttagatccaaataggcagaaagtaggagcatagtatactgcccaccaaggtaattactcctgcatggactacctcaccgagttattggatagagccgttcagcacatagatgtggagtcgttgaatgaatcaaattggtaagaaaaaaatagaaagatttttcacccagaagggcaagagtactagatgattttagagaaaggctccatcaaacacttctgaaacaaggaattcttatttgctctttaaaccaattccaagctctatttgagctatcctaatgaaacttgaaatagcacctataaatatagatgccaaaatcctaaataaaatgttataaaattattccagaagtgtaataaagaaatatgaaagcaagtttgttttatatcagtaacacaagagcagttcaatattaagacatttattaaagctgaaaatcacatgattatatcaagagatacagaaaagacacttaataaaattcaactacattcctgacaaaaatctcttaggaaatgaaaattggaaaacattcccataatgtgattttttaaagtatttatcataaaccagcagtaaacattattttaaacactgaaagacacattctcttaaatacaggaataaaacaaggatgccctctttttattttaaatggtttttacctagactgaaaatcccttcaaggttggtacaagaccttatttgtgtttatatccccacttttaaagtattttgtaaatggtattcttgtgctctatgatcttttagtgagtgcaagaatcaaattattcagtaggctaattaactgaaatcaactagtaaaaattataatttccatgtaaatttataaggaggaatttctcaggaaccccagttcaatataaactgagaatgatgcactccataatttctttaatcagctgaaatctttagtctgtcattcattccaccttctataaaaatactatttggtcatttatcacaactttgcagcagtcctccagatatgatctttgattggctcttcctgatgtaaaccttgttcttggaaacttgcttctgtttgtatccttttcttcccttgtcactttctgcttgagtctagtaagccaaagtcaatagaaagaggatagaccagtcagccctaagaactgacaagtccagaagttcttgtcagatcaatttcctttggacaaagtttgtcctgtgtcaccttgcaacaccttattaggatcttcctcagtcttgtctttgtatcctgagaactgctttatttggttttgctgctcagaaggggaaggttctctggatcccaactggtgataaataatctttggtcagtttctagagatcagaggtttgcacaagcatcattcttactaacccctgcaatcctaataggatcttctcattctgtttgcctaccaggtagaatacctcctcccttcctgttttatttcatgtgcatttctctctaactggcataattccaccagggacactttgatatttagtgaccatttggggaaaattttgacatgaataagattattcatttgagaggtacattcaaagaaaaaaggaagaaaccctcatgaggagattctctgtcttgtcaatctaaaagagagataacttccataaagaaggagaaaacttatctttgcttttgtacttcagggacttaagaagtatcattttaagttataaatttgatagaattgtcaagggcctgagttactgtttaaactggcttatttcctctcacatgctctctctctcctctcacctaatcctgtgtatgtgcacatatacgtgtgtgaaaaatgagttttcctacatctatgtctttgccctctcttatggcctgaatatttgtgtctccccaaaattcatgtgttgaaatcctaaccctctatgtgatgatattaggaggtgggacctttaggaagtgattaggttatgagggtggagcacccatgaacggagttagtgccctcataaaaaagactccagagagctactttattccttttccactatttgaggatggagcaaaaaggtgccatctatgaaccaggaagcagaccctcacagtgttaggttttgaagggaaggcaaaggttaaagaaagacacagagagagagagtggtgcctctacagcaaatccaggctctatgtccagcataagacctgcagaggtgggggaccagcttaatgccattgcccgccactgcttacaggctggagcaattataggcctgggcaggaggggtctggggaacacggcctgctgcctggaaaaatgtcaataatatgttctcttgatgaggcagtttggcccttattccggcagaatatgatgttcctcgcactttctctcaggagaatatgataagaaagtccagtggctgggcaggctgtttctcatggcctgaatccccatggaatgttttactttgaccaaggtctgggaaatggcgagggacttacaaaattgtgcagtttggactaacacacaggacatcaaatcttttgacaattttattttggactttccagtctccagaacagtgagaaataaacatctgttgtttaagcgatctagtctatggtattctatcatagtagcttgaatggattaaaacaccctgtcatagtctgttttgtaatgctataaagaatatccaagactgtgtaattaatttataaagaaaaagggtttacttgacttatgattctggtggctggaaagttcaagattgcatctgcatctggtgagggtctcaggctgcttccactcatgatggaagacagaaggggagccagggtataccgagatcacatggtgagaggggaagccagagagacatgggggaggtgccaggctctttttaacaaacagctctcaggggaactaacacactgagaactcactcacctctgaagagagggcattaatctgtccatccacccgcgtgacccaaacacctccacccacgtaagctccacttccaacattgaggatcaaatttcaacatgaggtttggaggggacaaacattcaaaccatagcaccccttccttgcagaggggagataatgagcctttacaatgttaataatatatgtatctgatgccagctatttgtatttttttgtttttgttttttcttcctttctttctccttttccctactcttaggaaactttggagattcactgattatttaaaaatggttccatactaatgtacacactctaagagcatctactccagataaatagtcaagaaagtcaaaaagaaagagaaatattaaactgtgtttcttttgtatgttttcccagataaaacactaactcagagaagaaatttaactgcaaatttggttaatgaccatggattcctaatgagaagaaaagctagacactgagagtttagaataaactcaagaatcttaaaaattttcccatggaactgcctttgcacctctataaaaaattaattgaccatatggtaagtaacatgtgagtttacattgaggatagatgagcctttggacaaaattagagtgatttaattttacaataaaaacaactctatgtctttttcttggttctgtcatcatgtaaaaaataatgcttgcaaaattttttattaacacaacacttgggcttaatttccaataatttctatttttaaaatgtcttccattagtgtcttggatcttggaagatataattctgtctggaaaatttttaagacaagataaaaaatatatatatatacacacacacatacatacatatatatgtgtatatataaataatttaaatgaaattgtcttgacacatgtttttcaaagagtataatcttgtgaacttttctaatactacaaatcacaggatttaatcttctgacttaaattgtactttccagatatttagtcactctaagatgttaaactaatgttaaattgttttatttaatgaataatctttggatatataatttttctataagaaaaaacagaaaactttgattattagatataattttaaatttcttttacctttatacataaaatcactacagattaaggagatgtacaaatgtccttaaattatattaaatgcacttactttgccatcttaaaatttatttaagtaaaataacatatatgctcataaaaatagttttattgatcttggttacctatcttctagttttctcttgtgtctggaaaaataaaagttggttaattttgttaaaggtggtaattaataaaatcgactatgcagacatttatacatttacttatacataaaaatatatttatgtactttaatctctatattactcttctaattcaatttttaaagtaaagttccatttttctgtatggttctatgagtgtaacacatgcacagattcttgtaagcttcatcacaaataggttatagaacaattccacaccttccccaaaatgtctcttttcctgctcagtagatagtcaaactctcccctcaggcctaagccttgcaaccactgatcttctttccctctatttttgccgtttttagaatgtcatacatatttagccttttaagatttacttctttaacttagtaaatgcatttgagattcaatcatgttgttgcatgtaccaataatttatttctttttattgctgagaagtatttcatgggttgtttatccatttacccactgaagaacttttagtctgtttccatttttgggcaatatgaataatgtggttctgttataaacattcatgtccaggtttttgtgtgaatataagtttttatttctctacagttaatacctaggaatcagattcctgggttatatgataagtgtatgtttaactgccaaacatttctaaagtagctatttcattttgcatttccaccagcaatttataggagtttcaattgctccacatatttgccagcattgatattgtcattaagaaaagtcattctaataggtgggtggtggtatctcattttggttttcatttggagttccctaatgactaatgatgttgagcatatttgatgcacttatttgacaatcatattttttctttgataaagtgtctctttaaatcttttgacttttttttcaattgggttgttttattattgttgagttttgagaattctttgaatattctgaactcaagttctttgttggatatatgattttcaaattatttcctccctatctgtggcttttcactctcttaaaaaagaacacagggcaaatgttttaaatttttatgaggttcaatatattgatttttcttttatgactcttgcttttggtgtaatatctaagaactctttgcctaacctgaggtcacaatgattttctcctgttttcttttaaaatttttatatatttaccttttatttttatgagttaaattttagtacatgatgtcaggtaagagtggatgatcattttattggcatatgaatgtccaattgttctagtaccatttgtcaaggctatacttttcccattgaattgcctttgcacctctataaaaaattaattgaccatatggtaagtaaaatgtgagtttatgtctagaatccagatactgatccactggtactgttctattgatccttttgccaataccacaagatcttgacaactctgaccttatagtgaatcttaaaactgggtagtgtgagttttccaactttgttttcatacaaaataattttggccattctagtttctttgcactttcatgtaaattttagaaagagtttatctatatccaccaaaaaatcttcctgggattttaaatgggagtacattaaatctataggtaaagttggagagaattggcattttgccaatgttgagtttttcaactataaatacactgtatttctacatttattgggattttcgttgatattgttcatcagtgtttagagacttctagcagatagatcctaaaaatattttgttagattatacctaggtaaattttcagtcttttgaaaaatgatcctgattttaaaactttgatttctagttgttccttgctagtgaattagttcttggatttttaaaattaattctttaggattttctgtgtaaacaatcatgctctctgttaatatgtattattttatttcttcttttctgattttatgcctttttttcccttagcttatttcaccaactagaacttccaataaaacattgaatagaagtgatgagagtggatatatttgccttgttcctgattttagatgataaacattttgtctttcactttagatatgatgttagttctaggggctttttgaagatgagcattattatgttgcaaaggttccatcctccttctagtttgtgaggaaatttttatcttaaatggacattgaattttatcaaatgccttccctgcgtctattgatatgaccacatggtttttcttaagtctattagtatggtgaattacactgaagatttttgaatggtgaaccagacttgcattcccccaaataaactctacttacttatgatgtatggttgttgagggttttttaatattattcttttatattggttctcctctatgtttttatgtgtttaatttatttgatgtctgctctcattttattattttcttccttctgtttgcttttgcggtggtctgcacttattttctagtttattaatgtgaaggtttttcttcttgatttatatttttgttttccagtgtaaggattttagtgctataaatttccctctaaggactgctttaactgcatcccatgaattttagtatgttatatttttactttcaaaatacattctgattttctttgagattttctttttgacccatataatctgtaaaaccatgtcatttaatttcctggatccaattttttattacattattattttattgaggattttttagtatgcttttgtgagagatattggtctacaattttccattcttgtactatctttgtctggttttggcgtcagagcaatgctggctacataaaatacattaagaaatagttctattttgtgaaagaaattgtacaaaattggcattatttcttccagaaatgtttgggatttcatcaataaaatcatctgggcctggagggtttttttgggaccatttttaactatgaattcaattttaaaatagatatgggactcttgagttcttgatttctttttctttaaatctttcaagaaatcagtccattttatctaagttgtcaaatgcatgtgcatggagttgttcatagtaatctcttattatgcttttaatgtctgtggggtctatagtaatatctcttctctcataactaatattagtattttgtgtcttctctctcttttttttttttttttttttttttttgagacagagtcttactctgttgcccaggctggagtgcagtggtgcaatctcggctcactgcaacctccacctcccaggttcaagcaattctcctgcctcagcctctcaggtaactgggattacagacgtacaccaccatgcccagctaatttttgtatttttagtagagatggggtttcaccatgttggccaggctggtttcgaactcctgacctcaggtgattcacctgccttggcctcccaaaatgctgggattacaggcatgagcctggccttgtgtcttctcttttttgttcttcatcagtcttcttaaaaatttatcagtttatttgtctttccaaggtattatttattgtttctcctctattgttgttatgtgttcaatttatttgatgtccactgtcatttttattattttcttccttctgcttgcttttggtgtagtttgcacttattttctagtttattaatatgaaagctaaccttattgatttatctttttttttcagtataaggcttttagtgctataaatttctctctgaggactgttttaactgcattccacaaattttagtatatttttattttcaaaatactttctgattttctttgagacttcctctttgactcatgtaatctttaggactatgccatttaatttacaaagatatagagtttttttcaggtaactttcttatgttgattttttgatcaatttatggtcatagactatggtttgtatgatttcatttattttaatttaataaatttttggtgactcaaaacatggactatcttggtgtatatttcatgtgcacttaaaaatatgtattctgttgttgattaaagtgttccataatgataattagattaaagtcttggtagtgttgttccagtcttttatatccttggtgattttctacatactttttaaataattactgaaagaggaaggttaaagtctataattgtggatttgtctatgtctcttttcagttctgttactgcctgtattaggtaaaacagagcttttaaagttgttattaaatgcatacacaattaagatagtaatgtctcattgatgaattgagccttatatcattgtttaaagtgcttctttcttcctggtagttttccatgttctgaagcctattctgtctgatattaatataagcactccagctttttgtattagtgtttgcatggtatgtcatttttcaggcttttgcttttaacctatctatatcattatatttcaagtggtgtttttgtagacagcatatagttatgtcctggttttatcatcaatgtgacaatccctgtttttaatacaaaaacttttacatttaatgtaattatttatatggctggatttaggtctatatattattattagttgtttaatagcccttcttttttcttttattcttctggttccctttttgcccttttttcttttctcttggattacatgaatttttttatctgttggtgttttactatacctcttcatacacacacacacacacacacacacacacacacacacacacacgaatagttattctaggcattatagtatacatacttaccttcttttgaattattacctaaaatgtaaactgagagtcaatattttaccctttcagacaaactattgaaactttacaatccataactacttttacctcccccatattgtagttgtgacatatattacatctaatgcatagaaaaaattgcatagaaaattccatctcacaatgttataattttcaatttcaatagaaatatatatagagagatggtggttagatatagatgtattttaaatacgtgctatgaactacatatgtgttcatatgtagggaattcgtatgctgaaatcctaatccccaaggcaatggtattaagagatggagcctttggggagttaattaggcatgagggctaatgggattagtgcccttatgaaagaggtcatagggagctgccttgccccttccatcatgtgaggatacagaggtacagtgctgcctatgagggatgggtcctcactggatgccagctatgcgagcactttaatattggacttccaggccttcagaattgagaaataaatttctgttgtttataagctacccagtctatggtattttgttatagcagccaaaatggactaagagtacataaaatcccaaaagtaacctatagacttactatgggtaatggattacatgctgtccccctcaaaatatgtccctgtcctaacccctgatatgggtgaacgtgaccttctttggaaaaggggtccttgaagatataaataagttaaggatctcaagatgaggtcatcctggactgcccaaatgggtcctaaattcaatgataagtgtccttataagagacagaaaagaaaacacagccatgaagagaaggcagcaatgtgaccacagaaactagaatgatgcagtcaaggaagccaaggaacgctgacagtcccagaagctggaggaggcaaggaaggattcttcccccgagctttggagactgcacagtcctgccacaccttctggctttcagaactgtgaagggataaatttctgttgttttaagccaccaattatgtggtaattgattatggcagttctaggaaaataatacagatatcatttcagttgcttttccttaactcataaagttcctatttttactctgttataattccttccacctgaagaacttcttttagcatttcttttaaggcaggatcttatagcaataaactctctgttttccttcatgtgagaatgtattatttgccttcactcctgaagaattttttcactggcaatagaatttggggttgacagttttttttctttaagcacttgaaaaatgttattacactatcttctaatctccatagtttctgatgagaaatcttcaattattcaaatcactgacacttttctttttctttatcttattttttttttcttagagacaggatctcactctgttcaggctggagtgccgtggagcaatcatagctgactgcagcctcaaactcccggactcaagccttcttgcctcagcctcctgaatagccgggacttcagaagggcactgccatgcctggctattaaaaaaaaaatgtaaagatggagtctcactttgttgcccaggctggcctagctttaagtgatcctcctgcctcagcctcccagaatgctgggattatgagctgagccaccatgcccagtcaactgacatttttcaatgattcttttcaacaattttctttttcatagttggttttcagcagttcaattataatgtgtttggaagatttttcttaagtttattctgcttggaacttgctgagcttcttagatctgtccatttattttccatcaccaaatttgtgaaattttcagctgttctttgctcaataataacttttttatcaccaagatatctctctaagtttttgacatattcctcatttgttttgataaaagttttcttattttcttagaaaaaataagttactaaaagtcatatatcattgtatatcttcaaaatattgcttaaaactaggacttgtatttaaatgttttttcttcttaaagacaattttaatttatgattttctgaattcagtccataaattcagatcattcaaactgttaagatgtcttttatgctgacattatttttagatttcctggaatttccaccaggtaacacaaaattctgctcctttacctcataaagtaaaaataatggagataattaggtttatttagcattctccagatgtttttacgtcaaaaatgaagagagaccttttattttttcaacttaacaaaaaatggacatatcacaaaagtttagacttcctatcttaagtaacaaaacattttaatattatacacatttttatgttaaaataagcatgctattgttcatgtacacagactggtataataattgtttaaaatatttgatatctaggttacttgattccaatacttacgttaatcagggctgatcatagtatactttatagcacaaatcaaaggtcccggaggtttgtcaatgtcttcactgttcataatgtgttcttactcccagagttattattgactatatccttatacttgtgttgtgtatcatacctaaaagagaattttgcttcgctatatgtccagaggatttagatttcgaaagagacatcacaggaaaaaaagtgtccttgaggcttgatgaaaatgatattttcagatcctattaatacataatacaaaagaaaaactgtaaggtgtggactctaagatctatatctctcaattaaagaaatataattcatccgtgaatcactgaaaggatggtcttagcaggacttcaagctgaggatccttaggaacttaggaattctccaaaagcatagattttgagggtggagacagcttcaaattaagaccatcagatcatggaaacaactgtgaatagtagacaacttccattcaagatctatgaagaagatccagatgaccagaaccagtgattcccatgctttatctgcaatatgtcattctttatttccctagctattttctctcctctttgttaaagtttctgattgctaacagaaagttattatttcttaaacataatatctgtacggttcccatccttaataatatttcggcatgtttacatacttcttggcctgattccaatacctgccagcagttttattgcaatttggctaaagaatacaatcaaactgacctttggatttgtactcatttttatctgggtgccatccagctttatttgataccttttccttgttataaataagttggtttccaccaatcaacttatttagatgacaaaaaccgtaacagaccagagagtcaagaaacctaaagtctctgctatgtcaaacctataaatgaggtgtttcttcttctgtaggaaaaaaatacacagaaaagctagcctttgcaatcaacccttacagaaatagaatgtagaaaaagccagggaacagttggggtatatttaaaacattgcctaacttttacagaccttgcaagaaaggtgcattagttaagctaaacccccatccctgtccaatttacagattgcagtcaatagtcttttgtgcttcaaatccaatactagttgtgagggattacccaatgatctgctttcagtggaaatgctcatatggggatgtcagatagaattggcctagcactaggtgatagaccttatgccaggccaattctatttgacatccccgtatgagtatttgaagcacaaaagactattgactgcgatctgcgatctgtaaattgaacagggatctataatgtgagtaaactgaggtctgccttcaggagagttcttagtatcaccccgcctccattttgacctgcagacttcccttctacgaaaaaaagacatttagataatttaattcaaaaatgctgaactttggtttacatcttaaatcaacccctgaaagaacatttcagactgctttcttcttcatttcacactttccatgagacttgacaagtaggcaggattctacagacaatggcaacattgctacagctgtagaacttctcacctaagaggttcacaggtgtggtgatggttcaaaacagaagtctttcgaggtaggatgtgtgctgacttagggaaagaatgctgtacctgcattattacagacctcttttggatctttaatgttgctaaaattatctgggtggcaaacataaaaatagtgaaattatgtaatttggctaatactctctatctgcttgtgtggcctcttcacattggggataaaatgttgtcactcttggcttctgccttaaaagtgactacaagttcatatcataatatttctcatagaaattatctatgttgggccgggcacggtggctcacgcctgtattcccagaactttgggaggccgaggcaggaggatcatgaggtcaggagttcaagaccagcctggccaacatagtgaaaccctgtctctactaaaaacacaaaaattagccagacatggtggcacgtacctgtaatcccagctactcgggaggctgaggcaggagaatcgcttgaacctgggaggtggagtttgcagtgagccaagattgtgccactacactccagcttgggcaacagagtgagacttcgtctcaaaaaaaaaaaaaaaagaaagaaattatataaattatattgccactctcaaatgtgtgctctccagagtcttaaaatctgctatgcagtagttgttccataaaatgatccaaacatgatcttccaacaaaatgaacaattaaaaaaatctgttattaataatggatggggtgactatcatcagaaacccttcatataaccacaacatatcaaacagtgatataaatctggattgatcatgtccctagttgataatcttctattctgtagcttaggctggagaaaaatgaaaaagactcctgagaactgaaaccaacatagttccgaggccttacattaaacactactgggactgggcatactttcctattcttatgtgaaaccatactgaggcaagtaaaaataacgacttcatcttactctaggaaatactcatcatcaagacaataaaactgtgaaccaacttaacagcttatttagcaagactaacaatttgtttatcaagactctcttcaagtacctcatcttgctgtgcttatcaagccaaagttaccatatcataaactctgcccaataccaagttacctacttttcatgactcagcttgaaatctgccctataaatacctaaatacctataaatacctataactaccccctataaatacctataaatacccccattttgagaagctataaatactttatcaaattggtgtcctctctcactactgtaagtctaataaattcagtcttggttgatcgatagtcttttctggtggtttactgggggtggggagagtagagagttaacactgctaaacttttcatcaatcttttcttaccctgagttgcaaaatgggcctcttgtcctcagagtatcttacctgattggttttctataaattaaatacctgtttcttttggcttttcaaaagtgtataaaggctttcattcctcaccttcactgagcctgacttgtgtaggtcatccccaaaccatgaagtctacagaggaatacagataaatcttggtgatggtagaagagtgagaagattatttattgccccactcctctgccaaacctattttgtgaaaattgccttcatacacaaatatagaagtgtattccctgactatctaacaaggagaaatctcccaaccacttttttggtcgcatatgtaacaggctttgcttcctgggagtcagttattttatgtttctcaaccgatttaatagtctcaaattctcagtcaaactaccttaccttgtctttctctctattcaccctcgcatttgttcaagaaatttttaggagttttggtttcctgtccccatcacctttcaaacgcagcataggagagcatgaattgtttcaactgtttgttgttctcttcttatatatttacaaactatcctgaagcctaagttgcccacacttatgcaatcaggtcaaaacttttctccagaaagtttgtaagaagggatatttgcacatgataatactcttctcccctccttgtagaattgcttcatagccatggggcctaagtctgttggactgcgagctaattagcgtcaattaactaaataatattatcagctgaacagcacactttcgtgtctctcagaaagattaacttatgaactaacctcattttactttattttctctagagaaaactaatcagtgcccagtttctttcttctagggatgaaggaaggaaggggaaggtaagaggtccctgttctctctgagggttttgtgaagccctgcaaggcaaagtcaactactattgactatctgctaccttcaggcacacatttaatccttaaagagtggctttcttttgttgggagaagcaattttgagaataatttgttaggtccttctatcagggtcgtagttttcactgagaaatgactggcatacaagcaactcaatgcacattgttaaatgtgtgctctttccttataatatgtggcaaaattttaatggtacaataatttggtcaaaattttgattatataatcacttaattatgtaattattcattgtcaatcttcctccactagaatatattttccaggacatcaggaaccatgtttgtacatagaagatagctccttggcatataattggtgctctttctctcatagtaggcatttcttgcaacatagaaagacctcagtgaagacctggagtgaatgaataaaagaagctgcacaagtacaaaggaaaccagtcatttatacacagtcttgctaaattatgcctgccattgaggttcttaccaaaatgcagtgcaatgaggaaaataagtagaatggggtaaactttcataatattatgtggctaatattgcattttattccactcttttggtattaaaaagccctgcacagcctataataaaatggtggtatttgtagaggatagttttccattttgtgatttttaagtggacattacttggaaaattcaaaatggcatccaactttattttattttaataatttttattctttatgaaatctgaaagtctgagaaccactgatctaaatcatgtcaaagtataattttcaaaaaattaaaaacatggctcttatatgggtatatagtatacagatgtcaaagatgttttgaactcactaatgaatcagcagggatggtaagcctgtttcaaaaaaggatatgagaaattaaaaagagagttactaaaggaagaaacctgaaataagattgctaatttaggtacagggtaatgaaatcataaccctcagaggttattttttctataggacaaaaatcatttgaatcaccaccaaaaaaaaaaaaaggtaatttgcaatttatccattttctccaagttgactgtactttatagaatctgggccgtaaccaaaagtaaatagtaaatcaaacaaattacttttgcttagtgtgatagacgtctcagaccagcttgttacctagtcttcggtatgagtttgaaaggtcacacagttatctttctgctttatttccaaattttagacaatgttctttttttttttttgagacagagtctcactctgtcatcaaggctggagtgcagtggcgtgatcttggctcactgcaacctcctcctcctgggttcaagcaattctcctgcctcagcttcccgagtagctgagattacaggtgcctcccaccacaccaggctaatttgtgtatttttagcagagatggggtttcaccatgttggccaggctggtcttgatctcctcacctcaagtgatctgcccacctcggcctcccaaagtgctggggattacaggcgtgagctaccttgcccggccatggacaatgttcttaagaggaacctgcctctaatatttagatggagattacatatatgtatgtatgtgtataagtaaactttggtctctatagatatgaaactgaaaggagagaaaccaaaaaattaacggttgttattacttggaaatggcataaagagtgttacagttttccagagctgccataacaaaatactcagagtggcttaaataacagaaatttacagtctcacagttctggagctagaagctcgagatcgaggtgttggcagggccttgctccctctgatggccccaggggagggacgggagtgtttgtgccaggactcctagcgtgtggtgggtgcttggcttgtgccggcacaactcgtgttcacatgggattcccctgtgtgtctgtgtccaaatgtccacttttcataaagaaacccatcagattagattggggacccatcctagtccagtatgacctcatcttaactaattacattcgcaacaaccctgtatctagataaggtcacattttgaggtattgaaggttagaatttcaatatatgaatggcggggagggcaggactcataatcatgggtaagtttttctgagacttttcttcactttctaagtgttaagaaataataccaacacccatttcccaaaatactcaagaactgttttagatgtctgtattattagtttccttggggctgctgtaacaaattaccacaaaccgaatggcttaaaacaacaaagatggccgggcgcagtggctcacacccataatcccaggactttgggaggctgaggcaggcgtatcgcttgaagtaaggagtttgagactagcctgggcaacctggcgaaatcccgcctccacaaaaaatacaaaaattagccaagtgtggtgacaggtgcctatagttctatctactcagcaggctgaggtgggaggaccacctgagcttgggaggtcgaggctgcagtaagctgtgaatgtgtcaccatactccagcctgggtcatagtgagaccctgactcaataaaataaaataaaataaaataaaataaaataaaataaaataaaataaataatgaaaataaataaaacaaaaatgcattctcatattttgggacgctagaagccccaaatcaaggtgccagcaggcctgtgctcgctctgaaggctctagggaagaatcttccctcctttttttttttttttttgagatggagtctcgctctgttgccaggctggattcagtggtgtgatctcggctcactgcaacctccgcctcccgagttcaagcgattctcctgcctgcctcagcctcccgagtagctaggactacaggcgttcaccaccacgcccagctaattgttgtatttttagtagagacaggtttcgccatgttggccaggatggtctcgatctcttgacctagtgatccgcctgcctcagcctcccaaagtactgggattacaggcgtgagccaccacacccggccagaatcttttctcctctctcaagggagaagctccccttggccctctaaagtttctctgaaaaatcagctcaccaaagtcagattaattggagaaaaggcatacaaatttatttaacgtgtatacataggagcctccagaatgaagacttaaagaacaggggaaattgtccatttttatgcttaagttcaacaaagtacggacagccgtgtagaaatgtgattggaaaagaagggtgcgatccaatgctaatagaccaaaccggggaagccaacaaggcctgtctgtctagattcctctcggcctctctgagcatgcatccttaccttctgggtgtggggcaaggctctctctggcataggggtattatgacccacagtcaaataaggcagataaaaatttctttatggccacttttgacaccaaaaggcagagggaaagtgagagtactctttttaggttttatggttttggggaagagggattctagtttctatggttaacctcaggggagaattggactgagaaacaggagggcagaaggtcagagaaaaacttttgcttctgaggccttcattttagggtattgttttctgagccccaacaccacaattcttggcattcgttggcttgtacctttatcactccaatctctgcctcagtcttcacatttaattttttttctcgcttttttccccacttactttcttagtggttcttctagggcttaccataaacatataagttatcagaatcaagtttagagttatacaaatttattttctttatttattattattattatcttgagacagagtctcattctgtcacccaggctggagtgcagtggcacaatctcagctcactgcaacctacacctcctgggttcaagcgattctcctgtctcagcctcccgagtagctgggataacgtacccaccaccacgcccagctaatttatgtatttttagtagagacagggttttgccatgctggccaggctggtcttgaatccccgacctcaggtgatctgcccgcgttggcctcccaaggtgttgggattacaggcgtgagccactgtgcccagcctaaacaaattaaattccagtgaaatatagaaatattattcctatataggcccactctcacttcctcgttattgagctattgttgttatattacaatatgtttcaaacctgttactattttgttataattattattttatatacttttctgtccatgaaagaggctgagaaaaaaaaagcaagtatatatttatttatacaatttgttatattgatcttatttatcatttctggttctcttcacttgttcctgcgcattcaagttaccatctggtgtctcttctttactccaatacatctttgctctcacccaccttctttatgctgttattggcaaatatattgcatttctatgtgttataggtccaacaatacaatttgtatgtatatttttacataattgcatttaaatcagataaaagaaatgcgtgtatactgtattttataattgcttcgttacctttaccagtgttgttttgtcacatggatccgtattattgtcttgggtcacaggcagtttctctcgtctgctttttcttcctttgtatgggtcacatttccctgtttcttatcatgtctcattctttcttgttgttgaaaactggacatttgggcaatatattgcagaaactggatactggttcccctctccccgctctggagcttgtttttcttgttgcctgcttgtttatttttttaatggcttagatagataattttagtgaagtctatttcccctacagtgtgaaacctctgatgttgcttttcagagggcatagctttgggcatgcacgcagtcaccctgatttgacagtgatttcagtgaaactttctttgactgtcccgatctctctgttaagctgtctgcctcctttggtatcacactgagctgttaggctccactaactgcttgctgattgctgtattgactgctggctgattgatctcttgtttttggcaatgcccttgggcataaattgttccacagtctgatctaattgaatttggaccacttttcagggatagaatattttggaggacagtttttgagatttgttcccctggagagctcctcttaactgtctcttgccagctgtctctgttaaattagctggcctgtggttttggttgttactcccatagatgtaccaacctcctcttaactgctttccgccaacatctccattgtttttgagagtacccttaggcttgaactttaccatactcggtttcaaataaaatcagtccctgtggggagagttttggagctctctgttcctatagattgcctccccacctggggaaaaaaaaaatctctgagcagactggtctgagtactgagcaggagcagtagcctctggtcttcccagattgcttctcctggcatggctcttccactccagtagtgagctgtggcaaaagttaccagggccccagtactcttagcctgccatgtctgggtagaggctccttcctatgaattgcaactgggtaaatgcagggcaccacgaccacaaccacactcaccagggatttagcttctgccactcagagttggagtatgacagaggctaaaagcctgtgcctccctgtgaaatgctgtatccttggctatgagtttaggaaaggcatccattatattggctacccctacctggaatggaatttcaatcaagttgcactgaagagagagtcatggatcaagtaccacaaagtcttgctattcttacctgactttagtagattttcttaaataagtatttcttcatctgctgtgtgcccttataacaagttccagagacttgaaatggttgaggttttttaaaaaataattgttactagttatgcttgttttgttggggagcaggtccacaaaactcttcactaccgccattcctgatatttgttcatcttaagaagtgtggtcattcgttttcaattgtaaacttgaactcacacatggtagttgttaaaattaggaacaatgttttactaatgttgagtttttatgacattttgcaataggaaatacttaaggaaaggacaaaatgacatttcagacttaatttttttctcacaacataagggagagggctaatattcaatagaatgtggttagagaaaaatgtctcagaagattctatgtgtttatagtctcataaaaatgtttgaaaacctatgtttaaaatcaaaagcagacatctgttgggaggcagctgaaagtgggtattagtgcaacgtaggtgcaaaaccaaatttacctgtgtaagtcaatctaactataagggctgatttaattataatacctcgtttaatattctttaataccggtaacggccaagtcagttaattaagattctgcatcagagtagaaggtagtggttaaaatgagtatatagcccatgccgtttgtcagttttcttagtgcgttagaagcggttgcaacttcagaaaactaaaaaatcttattttaacttttattttaggtttgacggtacttgtgcacgtttgttatataagtacattcatgtcatgggggtttgttgttcatattatttcaacacccaggtattaagcctagttcccaataattgtttttcctgattctctccctcctcccaccctccaccctcacgtaggccccagtatctgctgttcatttctttgtgtccatgagctctcatcatttagctcccacttataagtgagatcacatggtatttgttcttctgttcttgcattagtttgctaaggataatggcctccagctccatccatattcccacaaaggacatgatctcgttgcttttaatggctgcttagaaatatatgtgtatatataccacattttctttatccagtctgtcattgatgggcatttaggttgattccatgtctttgctattgtaaacagtgctgcaatgaacattcatgtgcatgtaactttatggtagaaagattcatattcctctgggtatatacccggtaatggaattgctgggtcaaatggtagttctgcttttagctctttgaggaatctccaggctgctttccataatggttgaactaatttacactttcaccaacagtgtataagtgttcccttttcttggcaaccttgccaacatctgttattttttgacttttagtaatagtcattctgactggtgtgagatggtatctcattgtggttttgatttgcatttctctaataatcaccgatattgagctttttttcatatatctattggccacatgtatgtcttctttggaaaaatgtctgtatatgtcctttgcccactttataatggggttgtttgtttgtttcttgtaaatttaagttccttatagatgctggatattagacctttatcagatgcatagtttgcaaacattttctcccattctgtaggttgtctgtttactctgtcgatagtttctttcactgtgcagaagctcttaagtttaattagatcccatttgtcaatttttgcttctgttttgatagcttttggtgtcttcatcatgaaatctttgcccattcccttgtccgggatagtattgcctaggttgtcttccagggtttttatagttttgggttttacatttaagtctttaatccatcttgaattgatttgtgtaaagggtttaagaaaggggttcagtttcgatcttcttcatatggctagccagttatcccagcaccatttattgaatagagagtctttttcccattgcttatttttgtcagcgtcgtcaaagatctgatggttgtagatgttcatccttattcctgggctctctattctgttccattggtctatgtgtctgtttttgtaccagaaccatgctattttggttactgtagccctgtagtatagtttgaagttgggtaatgtgatgcctccagctttgttcttcttgcttaggattgctttggctatttgggctcttttttggttccatataaattttaaaatagtgtttttctagtttcgaaaagaatgtcattggtagtttgataggaatagcattgaatctataaattgctttgggctgtatgatcattttaatgatattgattcttcctatccatgagcatgggatgtgtttacatttgtttgtgacttctctgatttctttgagcagtgttttgtaattctccttgtagagatctttcacctccctggttagctgtattcctaggtattttattgtttttgtggcaattgtgaatgggattgcctttctgatttggctctcagcttggctgttgttggtgtataggaatgctgatgatttttgcacattgattttgcacgctaaaattttgctgaagttgtttatcagctgaaggagctttggggccaagactacggggttttctagatacaggatcatgtaatctgtaaacagggacagtagtttgacttcctctcttcctatttggatgccctttatttctttctcttgactgattctttggccaggacttccaacactttgttgaataggagtggtaagaaagggcatccttgtctgtgctgatttttgaggagaatgcttccagcttttgtccattcagtatgatgttggctgtgaatttttcatagagatggctcttatgattttgagatgtattccttcaatacctactttattgagaattttaacatgaaggatgttgaattatattaaaagccttttctgcatctattgagataatcatgtagtttttgtctttagttctgtttatgtgaatcacatttattgatttgtgtatcttgaaccaaccctgcatcccagagatgaagcttactggattgtggcagattagctttttgatgtgctgctggatttggtttgcaagtattttgttgaggatttttgcaccactgttcatcaaggatattggcctgaagttttcttttttttgttgtgtctctgacaggttttggtatcaggatgatgctggcctcatagaatgaaatggggaggagtccttcctcctcaagtttttgcaatagtttcaacaggaatggtaccagctcttctttgtacatctggtagaatttagctgtgaattcatttggtcctgggcttttttggttggtaggctatttatactgattcaattctgtagctcattgttggtctgttcagggagtcaatttattcctagttcagttttgggagggtgtatgtgtccaggaatttatccatctcttctagacgtgttcatagcagtttctgatggttgtttttatttctgtggggtcaatagacatattccctttatcatttctaattgtgtttatttggatcttttctttttaattagtctagctagtggcctattttattaattaaaaactcatggattcattgatcttttgaatggtttttcatgtctcaatttcctttggttcagctctgaattttgttatttctcatcttctgctagttttggggttgatttgttctgcttctctaattctttctctttttttctttcttttttttttttttagatggagtctcgctctgttgccaggctggtgtgcagtggtgcaatcttggctcactgcaacctccgtgtcccaggttcaagtgattctcctgcctcagcctcctgagtagctgggactacaggtgcatgccaccacacccagctaatttttgtatttttagtagagatgggttttcaccatgttgtccagaatggtctctatctcttgacctcatgatccgcctgcctcagcctcccaaagtgctgggtgcttttctaattctttcagttgtgaagtcaggttgttaatttgagatctttctaactttttgacatagaggtttagtgctgtgaatttctcttttaacactaccttggctgtgttccagagattctggtacgttttatctttgttctcattcgtttccaagaacttcctgatttctgccttaattttattatttattcaaaagtcattcaggaacatgtttgatttccatgtaattgcatggttttgagtgatttttttagttttgacttctatttttattgtgctgtggaccaagaatgtgtttggtatgatttcacttcttttgcatttgctgaggattgttttatatccaattatatggttgattttagattatgtgccatgcggtaatgagaagaatgtatatctgtttctgttgggggtagaggtgaagagttctgtagaggtctatcagatccatttggtccaatgttgagtttaggtcctgaatatctttgttaatttcctgccttgatgacctgtccagcattttcaatggagtgttaaaatctcccattattgtgtgggagtctgtttctttgtaggtctctaaaaactagctttatgaatctgggtgctctcatgttgggtgcatatatatttaaaaccattaggtcttcttgttgaattgaactcttaaccattatgtaatgtccttcttcatcttttttgatttttgttggtttaaagtctgttttgtctgaaattaggattgcaacctctgctttttttctgatttccagttgcttggtagattttcctccgtccctttcttttgagtctacgcttgtcatcacatgtgggatgggtctcttaaagacagcacaccactgggtcttgcttttatatccagctttccactttgtgccttttaagtggggcatttagctcacttatattcaaggttagtatttatacgtgtggattttatcctgtcattgcgttgttagctggttattatgctggcttgtttgtgtggttgctatatagtgtcactggtctgtgtatttaagtgtacttttgtattagctgatagcagtcttttctttctatatttagtgctcctttcaagatctcttataagggaagcctagtgataatgaactccctcaacatttgcttatctgaaaaggatcttatttctctttcacttaggaagctgagtctggctggatatgaaattcatggttgaacgttttttgtctttaagaatattgaatataggcctctcatcttttctggcttgtagggtttcagctgagaggcccacttttagcctgaaggggttcactttgtaggtgacctgccctttctctctagctgcctttaacattctttctttcatttcagcctcggaaaatctgatgactacgtgtcttggggatgatcttcttatgtagaatcttgcagaggttctctgtatttcctgactttcacttctccagcttctctagcaaggttgggaaagttttcacggacaatatcctgaaatatgtttcccaagttggttgctttctccttatccccttcagggaggcgaatgattcatagatttggcctctttacataatcccatacttctcagaggttttgctcatttcttttcattactttttctttatttttgtctgactctcttatttcagagagccagccttcaggttctgagattctttcctcagcttggtttattctgctgttaatacttgtgattgcattgtgaaaatcctgtattgtgttattcagctccatcagaaccattaggttccttttcataccagctatttcatctttcagttcctgtataattttattgtgattcttaatttctttgagttgggttttttcattctcctgaatctcgattatcttcattcctattcatattctgaattctttctgtcacttgagccagctcagcctggttaagaacccttgttggagaactggtgcagttctccaactttggagtttggaggacatatgacactctggccatttgagttactggagttcttgtgttggttctttctcatctctgggtgtgagtgttcctttaactgcagtatagattgagtacagtcaataaacttcttgctggatgttttcacagggccaaggctttatgcagggtctttatttgcagcagacttcttgtgtctggtttcacaagagggtatgttagcaaggtatttttggtgttgaagctttggggtgtgattcagtaggtggtgcttaggcgtattggtcacttggtaggctcttgcttggtcacgtggctcctctatatttcctcacagttgcagccatgctccctctcaatgctctgaaagtgtgggctcctctaccacttgaatgctggctgtagattgaggcttcgcacttttgggctgcccaccatagctctggggcaatctcagggtttattttccttccccaacttggaggcagtacaggaaggaaccttagtagtcactgtggtcaagggtcttttgcttgtctcctggaggctccaccccagagggatgcagttcggcaatcactcagtgtaatcatcccaggatggagggtctgtgctgtgggtccaagctggggttccctgtctggtgacaagtagggtggaggggggtgtgtgggacccatgggagatgcgctggccttctctccttgggttgacagcagtttggtttgttggaggtgtggataaagcacttagggtctttgctcctttgttagtctgagggtggcaagggcagttccactgcagaggcagtggcagagaggcttttggttgcccctgggggctccacctctgagaaactcagagccactattattgggaggtgttcagccagtggggtagggtggctgcactgctgctgtgagcttggaattctgcttgttggggagcagggggttgaagtcttacagggaggagaggttggtgtcctttccatatggtagctgtggggtactgtaagttcacgtgtactcctcaggctctttgtttcttccccaggccaagggcaggagggatagaattgttactgtggcagtggcagaggggctgttgtatgcctctgggaggctctccctggggaaactctgggctactaccagtgggcatgttcagctgtgggcggagcaactgttctgcattcatgagccagggcccctgcctggtgaagagtgagggtggtggttcccagggaagaggggtctggacttccctccatatggcggctgcggtgtgctggaggtgccagtgtaatgactaggccctttgttccttcccagtccaaaggctgtaaaggctgagccactgcacctgtagtggtggaggggttgtgggttgactctgtgatttcctccttgaagaaatgctgggctgtctttgattgtggtgatcaggcaagggttgggtggttgtgctggagtcccacgtcaggcggccctgcctaatgaggagaagtgaggaccaggaactgcgtggagaatagtctggccacttttctgtaaggggattgctctttgttgggggtccagacaagtccccggtccccacagactctcccgagcctggagacagcaagggcaagggctgcaagacagtgaagatggcaacactcccttgtcccccgccactgtgaggtctgtcgaggcagttgcagagctgctactggcttaatagccccagcagggtgtgggtagaggtccaggcctggaggacctgcacagtgaggagacatgggaacaggcccccatgtaacagtctggccacttttccgtaggtctgctactgggggtttgctttagtccctagtcaccttggattttccagtgcctgaaggtatcaacagtggagggtgcaaaacagcaaagatggtggcctgcccctccctccgaaagccctgtgccggggaggtatggacctgttgtccaccccaaggcacctgtagaaggtggctggagaccctagtcgggaggtcccgcccagtcaggaggaatgggatcagggacctgctcaaaacagtagtctggccacgttttcacagagtagctgtgctgtactgaggatctaaaaaatcttatgttagagatttatactttaatatgagaataaagaagtattatgagatgcttcccaatctgtgttttcatttattagtattctctgtgatatgccaagtgatagtttacaaaatgtggcacctataaatatactttaattactcattcagttcaatcacttagtcaacaaatacttattgagtaaatactgagctgttgtaaattctggggatatcaatgtatgagatagacaaggtctctgttctcttggagcttattctaattattgtcttaaaataaacagataaacgtagaaatgggttgtagtggatggcatagtgcactgttcagatacctctgtcaggacaaaggcagtcacttgtgagcttctgggagtgctggctactgttatctcataggtacatctctcttctggaattgctttctgtcaaaggaacctacttcatccaagtttacaagctttctcctagggtagcctgtgcccagtgactgtttaacgtgaagtatgaagatgtgttcctcttgcatcaatttatagacaatttggaaaagctgttttagctccagagagccccaaaggattacctacgacttctgttataattttatcactgtaggatttttgtccctgttcaattgtttcctgtacttaaaggtgttgtttctggggaagctccccaataaacatcatacacacaaatctccaacacagatctgattctgggaaactcagcctaagctggtgggtactaggaagtagattctaaacaaaacttttgagctgaatcacctgttaaaatgtgaaaaaagctaaggtcagtgcaagaatttaattataagtgtagtggagcctcagagaaggttgaactgttaaccccagcagctctgaaacattagtaaaaaggcttcatttaaaaagtgggacccttggattaggatggggacatctgggtcaataacatttgaaaacctgtatacccaaatatagctaaaccctatgggccagcaaacgtgtctcactcctccctgttaaaggctagcctgcccctctagcttgtatctgatgcaatgatctattcttgaagaacaacacatcgcaccctcagggtctaccctcacctacctcctagccactagacccctagttagggtcaaatcttaggataacctggaaatgatctgggtctactagggaagggaaaggaactgtacactgtaagtgtaaagggttacccagcatgaactggcaagagccaggagagtatatatagaacaggaatgtgatagctggtttaagggatgaaacataaaaatgaacaagcgagtttttttaatacaggagtaccttcctacaatacagaatttaacaccctcacaaagaccaaaggagatgctactaatatctgctaggatagctcttggaagctggaggaaatcaacggcccacactacatgcagtataaatgccagatcttttggggaggacagtggagaaagaaatcaaaaggctcagagaagacagcacgcaagagtgaatatacttctcaaggcctaacaactcaacagccaactctgttctatgggaggacccagagaacactccatttaccaaagaaatgagaaatgtgctggtgagaagggcatcagcatcattgaaaagctcagttatggttcttctccttgagtcatggctaagggcaggagatgctattagaaaacccggccctgagtgtcaatggagatgatataatcatgaaataacagggtctagatggtagcatttcaatgacaggagcaaggtgggaatagttgttgaaatgaatagcaaagttggaaggacagccaagagggcctgatttgcagggctctatggagatgccataaaaaacatggtatttaaaggtgcaggataaatgagcaaccaacaagacattgctatatataattattgacatatatatataatcaaagatgatcaagagtgcattagcagaaaaatggggtcagtcactccaaaaaaaactcacaatcctttcccttgtttccagacctgagctaattcttagacctgaagcctattgattgaaagataagttgggtccctattaagtaggatcacagcaaatatctgccataatgacccaaccacgacagtaaagattttaggggccaagtctgaggaggaagaatctaaggagtaaagtttgaagtgcacaagaacatccatttaaaagcaaaggacacattactgcatctcaccacttccagcactaggaaggaagcagagagcttgctaggtgtctctgggttctggagcagcatttgccacagttggaaatacagctctaacccattcaccaggcaaagaggaaggctcccagctttgagtgtgacttacagtgggaaagcatctgcagcaggtcgactgctgtgcaatcagactggcgtcttgggccatatgatccagcagagtctaggttactaaaggtatctgtgccgtgaaaagataacatgtggagtttagggaagccacggtagaagaatcataacatagagctcctagagtttgcagcaagaccatgccatctgcagcaaacaagtatacaccatttgagaaacatgttggtgtttcctggtttactagggctactgaaccctggtagtgaaaaggcttctgaccataggacatcaagtgaccgtgggtgagagctgaccatcatgaggtgcatcctgtcagattcgtcacatcatgagataaggtggcacagctgcagttcattgtggggtgagaataggatcagttataatcagttgtgagcaaggccagagggcattaaaaaatacactgtaccagtgtactgcccagatttccacatcatttaccactattgcattaacaacactttcccagttcacacctgtgccacctcataagtggaggtgatcccttatgaccaacaataaaggggaaaaacagcattgcttcactgatggaggtgtcgtaagtgcatgcaagctgaaaatggactgctgctataccagagtccactcaagggtgagccagggtgttagttccctagggtttccataataaacatcatgagccaaggggcttaaaacaacagaaatttattctctcacatttctggaagctggaagtcctaactttaagatgttgcagggccacgatctctccaagggctctagggaagaatgcttccttgtcacttctagcttccggtagttgttggcaattcttggccttctttggcttgtggctgcataactccaatctctgcctccaccacatggccttatttccctttgtctgtgtctctaaaatttctatttataagaagctttgacactggaattacggctactgttatccagtatgaactcatattaataattatatctgcaaaggccctatttccaaataagatcacattcttaggtaccaagggtaaggatttcaacatgtcattgaggggacatatttcaacccacagtgccttgaaagacagaagtgagagaaaaatcctcccactggggatagctttaaacagtgcacttggtcatctacatagggtgtagaaggagaagtggcttaagccaggaatatacagaaactcatatgcaaggtgaatgatttgactagttggacaggggtctggaagatcagagacaaaaacatacggggaaaagacatgtgaatggagcatggtagtggctcaacaagggttacaaagactcagccccttcgtctcattttagcaacaattttaaatggccatcctcgttgcaaattatagatataaaagaggatttggagagaagaggactgatttgggatgttataggagttctaggagttctaggagttcagcatatagggctcgctagcacccagcacctgaatgagtgctaggcatggtataagtactcaataaatgtaaaggttgaataaatgactgctaagttttggctcctgctactgactacattgtggtgccatttactgaactggggaagattgagggagaaattgctttggtgaagtgacagagcaatcaagacagtttttcccatgctgaagctttctttctgcaggctttctcttgtgcctcaagagctgctggccacaagcatgaacaaactaaaatattggggatacacccctcaacccatggaaggggtatgggatagctggtggatgaatgcctccgcctctccctccctactggtggaataattctgaggcatggttcaattttctcagagaatccccagtgagaatgagctccatttgaacacagtggtggccagcttaacaaagcctttactggctttcttcattaccccacctctctttcactcacttcctcacttgtgttccctgaaatccccttccaaataaatgctcgccttgggcttttagaggatacacagactaaggcaaacaataatgatgagaatgtcaggccttgggtctacagatcatctttgtctaaagttctctcccttgttgctccatccaagttcttaacattctttaaaactcagttcaaatctcactcttcatgtatcacctctaatctcaagtggccccttagtgctaagtagcaattgtaatttctctaagccatttttttgcctgctcctagacaactatttcatatctttacctctttctcaaaacttcagaactctattcagccacaagtttggattgttattactatttgtttgtgactagagtccattttggctggaactggtttgaactgcaacaccatgttcctcatcctcaatttctgttgttgaatttacttcccctgtaaatgagaattaagtggaaatgagaattaatccgaatagaattcctataccctcccaacataacatctgcctccttcctacatctggacccaaaaccctgctctctccccacaaccccattaatataaacgaactgtctgtgcttctatgcaaagccatctacttcccttgggccctgtaccccatcctttctctattattcaggacatcactctagcaattgtcccttttgtttctccatcatcaaattttccttctatactacataattccctctaaataataacatttttatttctcacaattcaaaaacaaaacaaaaaatgatgacatgaccccatttttccctccagtcaccactcattcgtctgtttccctttcttcaaaactctttgagagttgtatgtgttttttatctttcattacctctcccttcattctaaattgtttgcacttcagagaagtttttattttcactgttaaaccaaagcagttcctaccaagaacacatacaacctttatgaagctaaattcaatggttgatcctcagtcctcaactgctgggccacatgacatgattaacactttcttctggacacatttttctcacgtggcctctggatcatccctcctcattcacagttctagttctcttttgtttgttcctcccaatgtctctgatctctaagtagagtgtcttatcctctaactttgttcttctctttatatatctgttccctaccttctcttttcttctttccccatttttctcctatctgccccatcttatctgcttttgtgatcttaaatgctttctttatggagatgagactcccaaatttggatctacaatctggatctctttcctcaattccagaatcatacatccaactgtttaaatgtcatcctcccacttgctttcaaatgacttcacatttattaaagtccaaccatgaacttctgatttacactaaagacctgctcctcctcttttttatctcaataaatttcaaccaatccattagcaaatgccatcagctctaccttcaaaaaatatataaaaacaacaaccacagtgtgtgcctcctcctcaccacttccgctgctatgtctatactttcacccaccactggatatttgcattgactttttataggtctcactgcctctgcccttcactcctggcagcctatactcaatgcatccagggccagcatcatgggcatgtgacccatgcagtcacacagagtccctcactcacaaagacccagtgctcggtttaatgctgtgctgttgccatcttgaatttcttgataatttttgaacaaatagcctcacactttcatttctcaccaggtccttcaaactgtagccagtcctgaatgcacccaactaggccttttaaatcataaaccagatcatatcacgtctctgttcaagacactacaaaggcttcctacttcattcagaatgaaaggcaaaagccctacaatgacctccagggacacatgtgacacccctccccacccctcacctctctgatctcatcttctatcattctgccttttgcacattccttgatgtttctcaaagacactaagaacactttcaaccttagggcccttgcatagctttttcttctgactgctgcactcttacttgaacattgcatgacttgctctcgtgttttcttcaagccaaattataagtgaggccttctcagattattctaaataaaatagaaatcaacatcaaccccttgacactggtgctttctacccactttatcctgctttatttatttatttatttatttatgacagggtctcactgtcacccaggctggagtacagtggtgtgatcatggctcgctgcagtctcaaactcctgggctcaaacaatcctcccacctcagcttcccaagtagctgggactataggcatgtaccaccacacctggctaggtttgttgttgttgttgaggcagggtctcactatgttgcccaggctggtctcaaactcctgagctcaggcaatcctcccacctcagcctccgaaagtgctgggatcacaggcatgaaccactcactcacatgcccagatcacctgttttattttttaccttatacctatcacaagctgacattcattcttacttaattacttatatatagcctgtatgcctctccaaatctaaaatgtaagcttcccaacctcagggatattgcactgttctttgtgatatttctcttacccaaggcactgcataccacatagtatttgttgactgactgactgactgactgaatgaatgaatgaatgaatgcacatatcatattgagagacaggcagcattgcttccatgcccatgttgtgtatacacttcaggtaagctaatggcagtgaagctgatgtcacttctcaagtatcttgaaagtatcagagagaaagtgtttcaaaagagcaaagaagtgactctagtccaaatgaagtcacagccattcatgtgacaattgccttctatttctttgagagccgctgtactgctgcctcatggaaatctttaacttttctactgttacttaatgtttttacacattgaaatatgatttccccaaccctaagttactccctgtagatagaaaattctcccttatgacccagaagagcacactacctcagagagggaagactcactctgtcaatgtgggatgattagttggttgtcaacaccacaagactctcctcatctgatagatgtagacgtaccagagtttcaaactttcagaggaagagccagaaatgttcatcgagaatacacttgtgctgtttagttaaagctctctgcaacggatgcatcgctggtgctctgctcagttcctctttacctgcttctgcactcatgctgtgatgggaactgtgagtactgatggatgcccccttctcctgagaattgctctcggccgatgctagcacaggaagctctacctctttcccttcccaccaaaccctgggacaaggactaatcgacccaggggttaaagggtaaccccatgccttggaatggtattaaccctgtggtgcaatttgtgctccagagcttcctcatgggtgagacagaagcacgtgtcctgttgtgtccacaactacactcagccttttttgctcattcaatcctcattttgggctatgtcttcagaaactaaaccgaaggcactatccaaagattacttgtgtatttcttatagaagcccccactccacccccacacacagacattcctcaaataggttcctatgacctaccagttgaagcccaggcttcttatctggacattaagtctttgcatggtcagtcgggtctctgtctttcaagatttatttttcactatcatacaccatattaacctactcagggctgcctactttacattctctcccagccctgcacattccttggaaaggcctcccctgcctcgcctgaatgatgaacactctattccttattcaagactctaacatcacttgccctgtgaaggctcctcagattcctctaggctcagtaggtgccactcctcagtcccctacagcatatggtgtcaatgacaacagtgatatgcttgtctgattcctccacttaactatgaattttttgttgttgttaataaaaacgtttattttgcattttatacagaaccgcctgaagtctgcatcatgacttgatggttacccaggggtttatgtgtgtccaactgaacaccgtggttctgggattgaggatccgcacaaacacaggcaggagtttggagggaagaagggggcacagcaggagtgtatctcaagcccacctcaaaggcagcagagcattccaagttgctgaaaacctgtgcaaatggggcctctaaaacaaacattgtactgtgagctctcggggaaggggcaggaaaaggatgttgataattaagggggcattttcttgaggcggcagatgaggagggaggcttactatttttaatcccctcagccccaggacatgataatcagaggagatcatgtccaatcttgaatcaattccctgttcaaaaagaggtgctaataccccagggaccagactctgaaaataccatgaaaatactctgaaaataccgtgctggtcattcctgagtccctgttctatgccctacaacatatta

SEQ ID NO: 820 - DNA, 64011 bp, Homo sapiens
agcatccccggagagaagatagagccgccccacggccttcacaggagggggtaagggggcggagaggggagaggattgtttgtttatttgtttcctggaacaccctgttaagaatctcagcaattgcagttagtgccctatcgtttggcaagcagagccgcttctcgtcgttcccagctgcacgggatctaattcgcaaatacaccatcttgcattcaatacttaaatggaaaacaagcagcccggggagggaggcaaaaagtctgagtctgcatgcccgtttcggagggatttaggtttccaggtcggtggactggctgctgctgtccccggagaggatttctttgagcccgaaccctgtctcacctcgactacagaacccactctggcggaggttacgagccgcagttaaagagaaaacgggatttggttgggtcttaggccttgccagtacaaaatagtaacaaaaatctgtttgagagctgagattttaaaaggagatgctgcttattcttcccactggaaacctggttaaaagaaattaaggcctctcttaaaggtaactaagattagagggctcggtttccgttttctgtgtttctgtgggctaaacgcccaggtcggtcagcgagtttgtgtggaatgacgaattcctctcccctgaattctaaaatgataactttgcttggtgctgcagctgcgaacgtctggcgccaagagacccaattctggtcggggctttgctggatggagaagtgggggtgagtgggtaagggggaagagtcgtgcctcggtgaaaagtcgggagagcggcgagaagggaagtaacggcggctcctcctggcctcggcccctttaagtgcttcactgactcagctaagcttccccctcaggtcgcgttttttatgaatgaaaaacgtccttacattcattatataaacaagcctgtgctgattggccaatggcccccggtgcataaattatgtaaaacagacccctgagggggtggagagagatgcaccgctggccaatgggggccggagttgatggggcggcttggttggatttgcccgcagacagggtaaacaagaggtgatggacagccgcgggaacggcctctggccaatgggaacaaggctgggctagggccgcgggccaatggcggcgggcggagcagcgagccgcggggggccgggccagcgctccagcctggttggcagctgcggcgcagagtccagccgctggtgcgcggagcggttcaccgtcttcggagcggttcggcccagcctttcgcccaggcgcccaggcccgctgcgcgcgtgcgtgagcgcgcctgcgccgccggggccgctgcaaggggaggagagaggccgcctcaggtgagggggctttgcgggggcaggggggagatcggaaggggcgtccggccactggtccgacaggcccagccggctagagttcacgggctgattcagaatcttcaaagtcggggtgcagtagctggggtgaccccccccgggttgaccgccccctccccccgcggcccggtccggtttggttcctgggaggcgtcgggcgggtgcggctaacggttccggagcgcggggagagcggctttccacacgtcgtgggggaggcgccccggagcgcgagtgcgggggctcccgagtggatgggggatcgcggagttgcgaggctttcacagtctctggagattcgagagccccgaggggacttggaggctcgcgagaagagacgcttggcggagctccgcagttgggaggagggggcgggaagcagtttgaggggaatgtctgagaggcgctgccccccagagcaccgggagggggtaaatgacacaggcaagtgcagcctgcgggggcgggggtcgaccaggaacttacgcaggccttgcaagtttcaggtggtggaaagtggacatccagtcgccctgctcccacccagcaggctgagggcgtccggctgtgcggcgactcgagaaaatcggggcgcaccggaacagcggcctggggatggtggggataacacgggtgtggaggggacagcaccgaaagatgctgcagcctcgcagcggattagggttccggccgcattttcagagggtggagaaaactcgggggggaaccgaactcctggtcgacgagggggtgccagggagagatgttgggggtggggggattggaagcggttggtagcgccgggcgccgcacctcgtttttatgaatgtgggtgactttatgaatgaagcgggtttctttcgttggctcgctgctccctgcggcttttttttttttcttccctttttgtgaatgaagcattgagctttcttcctaaaacgctggggtgaggggcctgcgtcggaggctgggcgtgcgttggaaatgggggcgggggcgcagctgaaggagttttcatgaatggggaaggctgagaattgggtggaagtgtgtcttgttttgtgaatggggcccagcgctagagatccagttacagcctctacctgatgtggcggccgcggctcgctctcccattcataaaaccgggcccgctgcgcgccacaggggaggggcctggatcgcgccgctgcgctgtgctaaagttttcctgggggcgcccggggcgcgggtggtgggggggcaaaggaagtggtttaaactcctggatgaactcgagcctttccttcaggcttttaaaaaaattatacttggaatacaatttttctaaccctggaatgcctcttttccgttcgtttatggcagtttatttcttttaattttttagaattttttttgctcttccgggtgaagtatttcatcatgagactgaaaaatatctccccctcccgtcttctactggttgtccccttcctcctaacacattcacaaaatgtcttaggccatgatttaatctgacagattttcctaagcgacagagcactctctctttcatgcccctcaactcactgctgaggtttctcagattttgtatacggtttggtggcatttgagagaggcgttattctgaacatttcttgtggtgtttggacggggcacgcaggcaggctggcgcgagtgtttttctaggaagttatgaactgtgtgctattttgctcctctctttcctttgactttgaaaatatctgattccttgggccaaagtgctgcggaggatgctggctgtgaagggtgtccttgtatcctgcccacttatgaaaaatttgatatgctacacacagtgtgaaaaacaaattggatggaattgctcaccgggggaaaagtttcctgtttaaaattgtgtatatgtcaaacaaaagaagttgacctttaagcattttgaattgcttagagctggagtgagtgaaattaatgtttttccaccttttgttgacttaacggtgtttttatttgaagaataaaagtgtttaggaagatggtacctccctgaaattgttactttattccactcacgttaggagaagttttctcccttctaaccccaccctttttccccagactcacacacttacccgtcctgaaatgagtttcatttgggggtgggggggtatgtctagaaaaaaatgattccgctatatgaaacagcctaagttttaaaagacctttggtagagatgcattgtaccacatgcaatggaattagtttttttaatccattacttttcatagacattttactcttttagaagttggagatgtcacaaatatctctgtaagtaaccagggagatatttgtgacattacagatgctatatctgtttagtcctcttttaaataaagagttgtgtgtgaagataagtatacctctgatcaatttattccaggaactatatatagtgttttaacagtgacctacaaaatgcttttggaaacaccatgtatgtcagatctttaattgccaataatttggaatacttaaacccagtttctctgcttcctgacactgtactgtcaaaaattaaattatctcttttttaaaaaccctactacaaatgccctggagtatatgagagaatcttgaaatcacccttttattttattttatttatttatttttgttttggtagagaacagacagtagcaaatctgtaattttaatgatttaaataagaaagaaaaaatgatgactgggtaaatggatttggcacggagtacatcctgtacctctgataccattaatcaagcccggcattggtgtgtaaagcttgcaccttgagtaggttttaagtacttcacagaagggtaataattttgcacaggccctaaaaaaaaggcagtctaaaattgtttcatttctttttttcccccctcttagttaaaatctcccaaattcatattacaggaggatcccttttcccccagaaattactcaatgctgaaacctctcaaagtggtattagagacgctgaaagcaccatggacgggttttatgatcagcaagtcccttttatggtcccaggggtaagtttatgtggcttttggtttgttttgtcctccctctccaatatgagtcttccccctgtggacctctttactacacttgagccttcactttctgttggcctctttcagaaatctcgatctgaggaatgcagagggcggcctgtgattgacagaaagaggaagtttttggacacagatctggctcacgattctgaaggtagtaaagctttccctgattatgttgtggcttccctgctcccagtgacagtagcgtgtagattcttccctgtcttctccctagcgaaagaaatatcctcattctggggtcttctttttcaatttcagagctatttcaggatctcagtcaacttcaagaggcttggttagctgaaggcaagtttcatggatgtcctattttccatataaaacattttactgtgctttttaataaaacttaaaggtctaaaataaaaatctattttccagcacaagttcctgatgatgaacagtttgtcccagattttcagtctgataaccgtaagtacctttctggtgatggcacatttgttctgaaattgtttggtcttagatcatccatgtctagaatatgcttttttcagctatggccagatttagacagtagtatgcatttagtttcttctaataattcagaattaaccctgaaaacttttatttcataataaaattatttctaaagtatttctactgtattgcaggtaagatttactgaacataattttatcctaaatttctttttaccttaagaatattgtaaagctgactgggcacagtggctcacacctataatcccagggctttgggaggctgaggcaggtggatcacttgaggtcaggcattcaagaccagcctggccaatatggtgaaaccccgtctctactaaaaatacaaaaattagccaggtgtggtggtgggcgcctgtaatccaagctactcaggaggctgaggcaggagaatcacttaaatccagaaggcggaggttgcagtgagctgagatcgcatcactgcactccagcctgggcaacagagcaagactccatctcaaaaaaaaaaaaaaaaagaatattgcaaagctttaagctcaaaattataaattaactgacaaaatatatttggtgttaggccaagcatctattaatcacacattgttttatggcttttttggggtttgttttataaattaagtccttgatgtgaatcatgaacctgatatttctctttttcttaaaggtgcagaaaatagttaatggaaaactccagttaactttggcttcatccaacatgttgtcaattttgtctctacccctaagctgacaaggggtggtcacagagtggcctgatttactcttacttttcgtgtagttgctgtggcttttctcttcagagaagagaaactttttcttaaaatggccactaagtgctcattactagagagaaaatgcagtgggaagctcaaaagatggctttcaacactggcaggggcatggttactttgcactgatcttttggggctgtcctcaacaggtttgggagcttttatggtctaggcagagttatgaaggacaaagccggctgatgaaatttgagcagcacagggctgctctagagagcattagtcactggcgaatgagcaggtttaagagaggcctggagaaaatgctgcctctcttgagagttgcatcatagagaaattcatgtctcttagtcatagtttataatagcaagcacctgagccatgcaaggactcaatttctcattttggaccaacagattcttcccagctttgttttatctctgggtaggtgggtgtatgtgtgtaaaaatgccactggagagagagtatcttaggtctctctctaagtaaaaagttgggtattccaaatcttttaaatgtaagagcagaggtaacagctaaacattccttaatgataggcctcatgtccaaggcacaatgccatgaaactgtaaaagggaataaactggaacacacacatgcatggttaccttagctttgtcacagcttgctgtggatgtgttctatgggagagtaaatgcatgttaattattgccctttgattgctttcgagtgattgggaagcttgccactgaaagactaaataaagataatccaagtgtgtgtgtgtgtgtgtgtgtgtgtgtgtgtgtgtgtgtgtgtgtgtgtttgcaagatgaaagacagggtttgtaatccaactttgttctgtgttgacaatttggcccagcctttccagttcttgctcagagcagcataaactgcagtctgtttgggaggtggctttcttggcagaggttctttgaaatgcttttatgacacttttgtttgtttctctgtaacccaaaagagttaaaagggagatgagatggctgcattcaaattgattgcatgtgctgaagcaagggtatgttctttgtcagcaagcaggatttatatttggagagatatttatctgtgggaataggctaaagtgaagaaatcaataaatgtgttttggctctttagaaataatttctgctcagcaaatagaatgtgctaagttctttaattaaaattccatacctcaagtggaggtaatttgggagatgtttctgcttaccaagtatgatgttttttttactttgcttactttttgttttaactgcctaaggttgagcctttctgtcttttaaggataaaagagatggttgactagcctagaaaaggtcttctaatgattctttccctctgactttatttcttgaggtagagcttcaagaagggatagattcaaatagaataacttgcttaagaagcaaggcaagaacacaaatgtgggtggtgcatctttgagccattcattcttgcaaaagcaagtttgtttgcctgcagttcagaccaacagccagaagcatgaggaggagctggcagagcccacagccggctgcatgcacttacttttccatgagcgctttccacagcctcgagttcaggaccagcttcactccagtcattttctggaagagctcgtgatttttttcaggggagggaagaaaactcattcaaatttaatgaaaccttatgagttggtttgactcacttaaccaatgaatataagccaaacttagatttgccaggggaaagcaaacctttttttttttttttttttttggagagagagttttgctcgtcacccaggccagagtgcaatggcgcaatctcggcccacttactgggatgtccacgtcccaggttcgagcaattctcctgcctaagcctcccgagtagctgggattacaggcacctgccaccatgcctggctaatttttgtatttttagtagagacggggcttcaccatgtttgccaggctggtcttgaactcctgacctcaggtgatccgcccaccttagcctcccagagtgctggaattacaggcgtgagccactgtgcccggcctgtaacaaatattcttaccagtggccactggtaatacactttcctattaataatgatttgataattttccattgtatatgtgtaaatttattgtatacatgaaagaaagagaaatactaagaaatgtaggtaatatttttattttggaatgtcagttttaaagattatggcttttttttttctctaaacactaaaagttcaacttctaaagagattatattttgtaagtttcttagaattgggtttcctgcccatagggatacatccttaagtctgatttgagtgaatgaaaccattgcttttatatcttatagaaatgcccagcttacttctagctgtacagatttcacctctacctcacacatatagatatcagtaaagcatggagactctgaaaggtcaaattcaagggaatagaaatctatagatcatagggattctaccagtggacctcattgtcccttggtcctaagaagtaactctgaagatctcagattgcttgagttggatgtcctttgtagagacaagcttgcccagccccctcctttcacagctattcccaaatagctgaagagactgaccagtagtgggggcagatgggaaggtttaggtgaagtaagaggaagatgtataaaataatattcttaaagaagctctcacaaagctgcagagccagggagtagtggcatattcaagtgtattcagggtctccattatttcagatacctggagatggtgttcaggaaagcatctgggaggcctctggctgtccaattcagcactcacttctcttccttctatgatcctgagaaagttactcaataccttcatgctttgagtttttccatctaggatttggaagacagagagtaattataaaagaaaaaaattataaaaaactgacatatttaggctcacacctgtaacctcagtgctttaggaggccaagtcgggaggatctcttgagcctaggagttcgaggttacagttgaagcgagtagtgatcacaccactgtaccccagcctaggtaccagagcaagaccctatctctaaaaaacgaaaacaaaagaaaactgccatgtttcctagaagacacctttcgtgtgtatacagataaaactgtgtacatatttcctatatatgaaaaagtgtttgtgcatgtgtatatatctatgtaactgtgtatgtagctaaatgtgtaccttaacacatagagcggctaaaccagggaatctgggtcagtgcatagatgtatgtacatatttactacacattttcatagaactaactatgccatggataagattggaactcaagagtgtttcaaagtcggggtaaggtgatgtgttccattcatttttctgaactgactgggtacttaaagagtgtgttactagattttagcatatataaatagcagttttttaaatatacattttgggtctgatttttaatctcacttattaatttcagttatgatattataaatatatacctgttagcatcttgaataactaagatattttatgctgagtagagagcatgataaaaatcttatttcaaagtcatggcctccataccaaatacagcctagagaattgttttaagatccaaatgaccccattttccccttgaagtgttctttttagatctgtgtttcaaagagaatggaacaactggaggaagtacaagtaatttcctaaggaccagctaattaactgataaaatcgacttttcataaatacattgcaatagacggctggggaaataggattaactgttatgacagcccttgagcctaaaacacattgatcttaatcctgtttcacgatgagattattcagctggatttctttattaatgtgtgagtttagtacagtagaggcagtgcctttcctttggagagggtacatcattttggtctttggtcctaggtgtggtgtagcaaaacaccacgttttcttgcttgggccacctctattcaaaaggatcatcctaaagtctttttgtttggcaaggtaagaaagaaaacagtgggcactttaaaaataagaggtttgagggaaaacaaggccattggtttatacttttcaggaatcagtagttctgaaggtagaaaagaatgctgatgaaagcgtgaggaaaacatggaggagagattctttgactccaggttttacagtgttactttcaaagtgtttgttagttagcccagtaccttactgctgggagggtgctaaatgatttgaaatccttcctgttttgatagcctcaaagattcttagactcagtattctgaaggacccaagacctacagtacgcatttacttaaaggagccatctgttttacaaaatctgctttcgtctacctttaattcagttaggcttatttaaaactgaatttttctcttacccttctgtgtctctgcgctgttagtcatctaacaaaacccagtaggcttaccagtcctttgtatttggtgagaaagatttgggacggggagttacatctgtgtcaagatcacttgtgtaggtgccagaagtaacaaaatcctggcatccatgaagaaattaccatttatcccctcctctttcagcattcttcagttttacaggagtaaggcatgggtagcataatgaagccgaaaatgtgtactgtctcccatttctaccatctagtagtatcattgttttaatttcagccctagaaaaaaatgtttcttggtggtggggtggggtgtgtgattctctgccgagaaactgttccctccacacatttcttgggttttagtggtggtaaagtacatccagcctcagaggctgacagccccctctcgggcatacggctgcccttgaggcagcttgggccccatctgtgccctggcacacagtgcttctccacttggaatccaaggagctcagaggcttgtcatgttgcagctcccagctcttggacaagtgccaggcatgctgatgccattaccggattaggttgcttttttaaaaattcattttgtgaactcatcaagctcatttaacagaggctttggtcgtcagtttctatcattgtcctatccctctaggcttggcttaaaggagtggcaagataccaggcccctagtatgtgccggcactagttagagtgtgtatgtataaattataaccataatgtaagtacacctttgggcctggcaggcaaatgacagtgggttagcaactcagatgttaaagggaaaagaattccccgtaagaggactctgcatagaaaataaagggggctcccttgtttaaaaagaaagaagcatctaggggaaaattgaagcagagagtgcaagattccagggagcaggataagatctagttattaaaaggccaggagtttgaggctgatctgaacagccgaggcatggaatggggattctgtggtcagaaggacttcagagaaatgcttccagtggcactgagttcgctggaggggacatgagggcaggcagtgagaagaagcatacataagacatttgaaaatagccaaatatgtgatgaaaaaaaggaaacaaccatgagctaaaatttatctcctggatttgcttttcataaagaagtatgcttttccttgaaataaagtctggttgtcagacgggctccatccgctttccctcagggtgattattgaaggtttggaaaaaatatctaagaagcaaagccagttttttttgccttgtactttgcaaagtctcggcgtagatttcaccctccaaccttagatctccacattcttcccttttgatgtctcatgagcattcaggagggtattctgaactcttcaggctggatccaaagccaaaaaaggaactgtgaaattgtcttaataggtagcttgtcccctcctctgcagccagaaaatctggtagtgtctccagagccctcctcccctggggaggaagccaggtggctcccgatgtagctaccagcagtgaatgggaaggaaggtctggagaggcaggcttccagagagagttgtgccctaatgcaaaccagctcaccctggggcaggagaaataccactgaagtctgtttctctccgctggtagctacagccagattctgaaccgaggggcacatgatagtttttcttttgcctttcccgttttgccagagggcactttctgaccttacttctagcggacttttgcacagccttgcagatttccacaagggtcttggccatttgaatcctaggaagggtgcacagcaggcaagatcccctgccgtgtctgaatttcttacgtaaacacagcgtactgagcgagcaagcgtccctgcggcgacagctgggcgctgagcactattaggtctgccccagctagcagagctgcagattccccctcttgcctgaatggagcattccaaattggttgtgaatggagggcggggctcacttgcagactttttcaatgaataaccagaccccattgtgcagcccgtggaaaaacaaccaactcaaacaacactgggactgttagaaatatgcttgtgattggcagcttggagagcctccaaaattagtttcctttggcttccctgctgctccctgttctccaagcctgggcttaatggggtttgagttttcttttaagtgctcactttaacccttaaactgccgggctgatggcctgggattctggggaagagctgccgctgacccacaaagccagtgaagcccattcccctttctttgtctctcattttagactgtagctgtctaaagggcgtgataataagaggagagggtggtttagcttcccctggagagggaggtgttgagacttgatctgaggctgttaaacccttttatctccttcccgtggggttgtggctttagctccccattgaggattcctgcctgctcttctctgacctcccctctactccaggcctgaatagcccaggtgtttacctgccacgacacagacacttcttgcttaggcttacaattttaacacagggggagacaaagttgtagtttttctactcctttgccttcactcctgtttaattttccactgtggtcagataagtattttttaaacgaccgtactcaaacttctggtactgagcaatgggggaacctcactatggctgtaaacccttccactggacactaatcaaatgcattgcctcccaaaatgaacatccttggaagtaccagaaaaacccagcctctgagcaacccccaaaccaaagtagcctcatcatgccaaaactaggccaggttttaagggtgcacgtgcctcaaaatagcatccagccttgattgattgattgattaattggccaagcgggtgtgctgggggtggtcttgctgtgttgcccaggctggtctgaaactcatggcctcaagcagtcctcccacatagctggcattacaggttcgagccaccacacctagctgcttccacacttaaacatcctccaacatcttacctggtagctcaccggcagctcacagacacacgtccagtgttctctgtgggatagcccagggatgtatgatgagcataaaaaggacaatcagttaaaaggcaaaacaaaacttaatagtaatgatccagagcaacttcctcaggattttaaagagctcttcttagttcctactcttcatcctcacaaacttaataaggcagtttgcacttgtgttttgcctcaaggatttttttttcccttgctgtaagttggccttgcaagcatgccttcccttccctattaaaaaaagaacaggcctgggcagattgtccttttgtgagagagtttgaaacctctcaggaggtaaccctagatatcagctgtgtaggaggttgctgatatctgtgtttctccagaggggctgaaaaggacttcgcttacataaacactttcagctgagtgcctggaaatgctttgtaatggcctgcaagagcacttaatgagggtcttttatacttttcccatagaaaaggtagaatagaagagggggggatgtctctttcacatggtcacccacagtaaaggccggatcctggagcctacccctagtttcctcatctgaattttaatagagaataattgaggggggataactttgctgtgctgagggatatctcgactcagaaaatttctgcttctcctcaactccctcttcattttttttcttccccagcagccatggaattttatttcttgcggaagaaggtggaaacagcatagggttttgggaggtatttagtattttgacaactaataatcatagtccctgcttccccatttttatgcctattgaaacaggaaacaaatcacatttcttaggctccaagtgtctgcagaagcagaggagccctgtcacgtgtttatgtcccgcctcggccacagcgcctgctctgcgcactgtggacacctggtgcatacagcccgcacaccaccgcattccctaccacatgcccttcccatcccagctgccccagcctccagctggtggggaagtaacactgtaaagggtctcaaacccagagttctgagtccttgggatgaccttctagataaagagaacaaaagctagttagggctatttctcattttctgtttcctcttttaaacacatacactagccaagtgttgctaggctgcatttagactttgagcagctaatgctatgtttcccagtaagactgcatgtgctagagagcaagtcacagtttaggcacccttgacgtacttgctgagtttctgcttttaggagaagtggggctatagatagaagggaatggttctgggggaagaaactcatttccctagggtttggattttctcctgtcagattttaaggatgaattttcaatctgaaattaaagataagattttccacagtgcttaaatcctatttcaagtactgttaacatttcactttagtgccagtgtggatgagaattatgtaagttgggagtaaattatagaagggttgttaaagcttaaggtttagttttgcaattttttttcctttcaggaaaaatgtcctgtttccccttatcctgattgcgtgatccagtgtgagcagcccttcatgataaaatccactgtggttgatgtaaggtcacagtagaggaagccgccctgtcatctctaatgagttgggagaacaagggtttccttagacctctttctcaatcttgaaaataaaaccaatagttgtctatcatatttctacaggttgagtattaaaattctttgaagagctaagctgcccaaggaaagtagtaaaacactgattcaaataatgctcagaatcctcctttggtgtaatcctgccagtccctcacatttgtatgctgctggtctcttaagcatgaaagtaaccaacatgccagctctgtggctgtaggtctaaaagaagcctatggtagtcgaaagggggcggtgcattagaagtcagaagaacctcttgtttttatcttgactctcctggagtcagttccgtactcacaagcatgttacttgactgttaaatgctttggtttctccacatcccacaagttctgagatgcgacactcttatgcaattagaaatattcatcctgtataaaatatttttaatggaagagccccgtatgtgctaatacttgagccctacttcaatcgaagttggtctaattcttttctcgtctcctgacctttaatttctaacgctgaaattcaaggcatctaggtttccatttttggcgttctaaagtaacaatcctaaattgttaggctaaatgagtcctttgaagaaagggaactgtacaaatccaagctgtttcaagaaaaatgctgaagtgtagaaagaatatgaacttaaaggaagtaaatctgaaactagttcatctgggtcaaaaaaaatcactctactaccattggcattcagttttcttccttatttgataacagaggttttctgtttggaaattactgtctgcaagaggcaattttgtcccgagaataagatgcagctattcagtgatagataatcgttcttacccacaggtcaccatctatgaatcaggacattgctgatttagtactttacacccgtggacggaaggctctcctcccatccgtgaccacttcttttgggaggaggagcagtgacgaagcattaatacaaagaatttctttccttgtattttagccagagttagaatagaaatctttacaaatcacccatatcattcgctgatagaagtgaagaaaggacaagaccagtatcccaaaagccagccctcctagttgatgaccaaaggcatgccttgccaacttctctacccttgcaaacttgctagtgccccataggtcacctttgatgactcttttactccaaaggcccgcaacaggtccattgccttgagctcttccctgggccttctcagcctttggagagtgggagcagctttcagcctcatgcagcagaaaaggtagacagtgttcaggaccacatttgctcttcctagccaaagctattgccccaccccatctttccccctgtctgtccttgaggacctgggtatcatcttagacttgatcacatttcttctctctggaaggagtaaagaggtagggcaagtcttgagctccccccggagtttggagtgccccccacacttgggccggtcaacctgagttgtactgtccaacctgtgggttacaattacatgttagacagtaacctcccaagccgacttccatgggcagaatttagtttttgtcttctaaccaattgtatttcatctgggtatttgattgccagataccctgtgctggttctgctctctggctgctaccattgctgtaagcggccatgtgaaatgggggatgggaaggaggcaattgtttgctgaatgttgcaatccttgagccatgcttagcagaaggaaacctttaaaccacctccccttccccaggttatatgaagccactagataatataaaccttatagttcaaataatgagatttttaacagtgtgagaatgctcccaactaaggcccttttctgtaaagtgtaacctccttgtctagtcattcccccttcccacaaagaaattaaaattcctttgtaagtataaaatcaccattttcatctttccctgcttttacccctagccagacgggctttgttctggggtctgctagaagctacaacctgggggtcccctaagctggaattgctgatatgctggatttctccattgttgaatctatcctgtatctcatatagcccacattccagggagcagtaagggcataaaatatcataacactggtcttatacaaacacttgactctccagaactctgcaaggtcttgtcttcaaagcaccagttctatatacagccagcatttcccccagagaaagcaatgttctacaagcccagtacatgatatgtgtcacaacctagacccatgttgctatcgtcagctcgagtgcatagcagagacttagggttatctgaggtaaacaagcaatggaggagagacttacagagaatggcctcatggtcttaactgcttctcggtaccagttccgtcatctattttaaaacccaggtttgaggctgggtgcagcggctcaagcctgtaatcccaacactttggggggctgagactagaggatcatatgatgccaggagattgagaccagcctgggcaacatagtgagaccccgtctctttaaaaaaaaaaaaaatgtagctgcgtgtggtggcaggcaccggtggtcccacctactctggaggctgaggcaagaagctcgcttgagtccagaagttgagactacagtgagctatgattgcgccattgctctctagcctgggtcacagagcaagaccctatctctaaaaaaacaaacaaaaagaggtaaaatgaaacccaggtggggaaaattttatcaataactcttaattcctgtattctgggagaaattccactgtctttgcaggcaacctcttagagatgtttcagataccattgtctactaatgctatttatacattttcaaagttggttcagttcttttctaagctccttttcttccctttagtttctaacttttatattcaaggcctttggatttccattttcagaattctagagtaatcttccagtgtccttaataattgtgtttctgccaccacacttaggaactgagagtgggctttctggagatagtctctatgctgcctttcaagcaaggtgcctagcattttttaacatggcactcaccaacaaaattcctcagcttgcatttcaaaaatcttccccaaaaggtcttggctcttgaatttccagacacttgatacaacctcatctactctcatgagcaagaaaggtgtctccttccctcacttcctttcccactgtggcaagacttggctctaatttcattggctgctattacatcctggtatttctagccattttcatgcaaggccatcaaaacttcaaaaacttgaatctggatcttaggttggtcttattcctataccaatgtaaccctaaccctattttttggatatgtctttcccatagtccatgtcatgataatacattcaaagccttttattttgagctgattgtattaccccaagtttctaggtctaaatcagcaagaattgagtgttttgtttgtttgttttgtccacacaccagttcctgaagcctctcttctgctgactgtagttttttttcccactgcatgggagaaatctgattcctgaagccaagtgttccaggaactagctttaccactccctaatttggctcttgcgttatttattgtacagaagatgataattggccttataggaagggattctattctgtaactgttcactgatgaattctgctatctcatggttgatctgagaccctggagccctgaaatataccaccaaggtgacagtcagtcctttggttcttgccgagacatatgacaaatagcaaaaataccccagagtcatcaacatcataactcccttccaccaccatgattaattgctaatctaaagtcctgaatactatacagctgtgccagttctgaagcttctttccctgtacctgctaatagcaaaccctatcccaaagcacaagcacaaagcacaagccttactttcttcatgtgggactttgcccaggacaaatgcagctgttcttgcagaatgagcctgccctgaaatctcagcccctgcatgtggtatggccagccagttgttggcttaccaggtgtttgtcatgtcccctatgagtcgtatggagggccttgattccacactaaggtccagctgccattcttggttcctaagacataaaggcacaggggattttccaagccagtgtacttacttcaacacagtttaggtcttcagccccgtgttcctttttattagcctggtaaactaggctgaacagttggagcccccaggctcagagcagcgaaagcataggccacctatttccagcttcctctcgtcctgatcccagccctgctcagcatttaggggtaaaaagggctaacccaagctgcttatgagggaagaaaatgaaggagaaccataagaaagagaacttcaattctgccaaccttcccaggttggtgatagctgccttgcactctctggaggaccctggggatgaaatcgaatgagttgtccagctgttctggacaacctatttgtcctaaacgtgttttacatataaattcacaaggagtggaaattctccattttttctcaagaatcgtttgtggttgacttgggcatatattttagttcctgttatagatgcattaatatgaatatagttactgataggtgttatttttgttgatcattttgcatttgtgtaactgctatctttttacccaggcaggttgatggaagtattagcaggcagtagtcacagtgacagcagtggctgtttttattttgccatctctggagtgttcccttgtcctttctaagtgggccaaagccaacaaaatgtgtttgagaaccactggcgtagacattaggtatgaccagcatatatccttgtgtaaggctagattcccagggctgtattatccttccaattcagtaacaggccaagggtggctttcttcatttgtcgacgtatggttttgaggttctaagcatttctacttttgacatgttagtcaactataagataaaggattttttttcctccaaatatctcagaggaaatgggacataatagctgttttattgatttatttttaaaacgtattgctacatttgcttcatctctgtgtatatatggttttttcttaaccatttgaaagcaagtttcaggcattataacatttcaccccaaataccctggtgtgcgtctccacagattgacattctcctacatagcctgagaaaattaacttttattcagtaatgtttggaattccccagttgtctccagatatctctttagcaatgttgataatggttttgatctaggattcaatttaaaatcacacattgcatttatgtttatgcttcatttgtcttctttaatatgcaacagtctccctagcttttttattttccctgtaacagtgacttttttgaagtcttggccagtcgctgacttttttagggtccatttttaaagaatatatagaaatgcaaacagcatccagaaatgctgcccttaggcttagaaatctctaatattgttgattctctcacttctcacatttatgtatttgtgttgaccttaaaacagtggtgaaagaacagagtgacacagatggagataattgggtcagagatcatttgtgcatgtttgaggagagggcttttggggggctcattaaacggtttttagcacagcttgctcaatagttgattttaccatttgtggatgatttttcacctattaaatttgagaatttatccttacacaggttagctgtgtgagatattaaagaaaaacggcacattcttccatacctacaccaattctgcttttagaacttgtgtcccctaactaaatttgataacattgtcaatttttgtttttggaaactgttgccaggcaggatcaatgttaaacaagtttgagcatgcctcttatttggtttggaaatccagacatctccttttccagatattcttttttaagtgccagaacctgtccacttaaccttatctccttgtgaaccttcttgtttcccagaacagagtattatctactattagagtcattcactagtgctgttagagcagttacaaagaatattgaggtataatagattttatgtgtaaaatgagtttttaatctgctcagtcctaaaataaatatttctgaccctctctggtaatactgtagaacttaaaaaataagtcttaccctatctacatcttttttcctgctaactaggtatttgagctttgtctcaaaattcgtcaaaaaaggcaagagctaagagtaggcagcactatgttggaagcacaaggtacactccctcctgtgacttaaagccctctggtctttgccagtggagtactcagacaagttaagggcaaatcagggaaaaagaggtcatacctgctcttccctggtggatttttcggttctgttttgccagtgtccttgttatttttccatgtccctcttcttgatcatcttttcctctaccttctttccctgtgttctactcactcccacaaccacagaatattaatagtatgggcaggtgtctcggacttctctcccctcccacccccattcttggactatgcagtatgtaattcttcctctagagggaaaggaagtgagatggcagtggtcacagagaggagcagtgacccaaagctggtggccaggagacttaggagaaggccttcatttcaggatgatggctctggaaccctgagcagtgtatggccattactatttgtgtacattccacatcatatttgttcaagtgtaatgggaggctctggagacctaggccagccccctgagctgcagcctcatggacacgccattcagaagcacgtgtcagtgctctggtcagcttctgtcatgagacacaactttccatgtgaactaagaggataatgacagttgagtgtgacctggaggtcaggcctgcacagctgatttgggaaagatgagtctgggccagatgaaggtaaatgaaactgaagaagggacaaggaaaaccccaaaacagaacgtgaaggatggcaactgctggaaggcggtcaaagcctgtgtgtgaagtaggagaaatctggatgggcttagtccttcttcccttcagaccgcagggtaactaattggcaatttctttaacactcagcagctacataaatgttttatgtattcacaacaaagtctgtggcaaattgaaactttgatgattatgaaacaccaaagaaagccttattagacaagatgggtttcgtctttcttaaaaaaaaaaaaaatgcttttgaatggaactgttgctcatcataacattcaacaaaagtgttttcctacgtcttgatccttggggctgtaatagtgaagtttaccattagcacgggcatggggtggccgccttgaacagtccacaggcctgtacttgtgggcagtaaacagcttttgtcagcagagggaattattatttctcttgaatggaccagtttattttttctattttaaaacaactgagttgtttctttggaagactgtttctagaccatcacagaagaaagattttctaaaatttgatatattttagtattaactctgtggtgctatttgatgaggaccaggctgcttttttaaaaagtagaaatttaattgaagtaacatacagaaatcacaagagtacagctgcatgatgaattcttacaaacggtataagcatttagatcagaaaacggaacttatcagactataagaagactcctgtgcccccttaacaggcaccaccccgtcgagagtaacctccctcctgactttcaaacaccatagattagttttgtctttttttgaactttatataaatggacttacatggcatgtacccttttgtgtctggcttcttttagctcagcatatttgtgagattcatccatgttgttaagcataattgcaatttcttcattctcccttctgtgtaatgctaagattttgttgggggttacactgaacctatagataaatttgggaagaatcgatatctttataatgttaagctttccaatccacgagcatgatctatccttccatttattgagagttctttaatttttcttagtgttttgtggttttcagtgtaggcatcttttttctttgttttttcttgagacagggtctcactctgttgcccagtctggagtgcagtggcatgatcacagctcacagtagcctcagcctcccgggctcaagtgacccgcccacctcaccctacctcatagctgggaccccaggtgcacaccacagtcctggctgaatttttttttttttttttcgtatctttttgtagagacaggaatttgttatgttgcccaggctgggctcaaactcctgggctcaagcgatctgccctaccttagcctcccaaagtgctgggattacaggcatgagccaccatgcctggcccagtgtagacatcttatatgtcttttattgacactttcctagctatttgatgattttgttgatattgtgtatgcttttaatttcacattgttttagttactgtatactaaaagtttttttacatgttgacctcatagccaatgaccttgcttactgattcttatactttgtggatatttttatattttctatgtacctaaccaggccatctgttaataatgacagctttctttccttctttctaatttgccttatgtttattcttgccttattgcattggctaggaccaggcttggattttgatccctgtgtcagatagaaaaatctaaggagttccgtagtctaataagaaaagcaactatgaaattggttgacttgtgagcatcacatctaaatttaaaatggtgttatggttgtctgcaaggcaatacatgtacttgattgtgcatacccacagatatggacttaattacatcttatcagctaactgcccttcttttttctacccctgacgagctaagactgtcatatatatttgtgcatagatccttagcagagttcttatagtcaaataggggtccagacagctcacgcaagatcttcctgcctcagtggtggtagtaagacaattgtccagaagcaattgcagggcagggcagggcttctggggagagagatggcatccatggctgcagtgcggagtctgggtggtagtgactggctatagaagatgccaggtcttctgaagtgctggtagctgtctgaatgagcagaatgttttgatcagctcgactatagaagggagagtgagatcttttagatggaatgctagaatgggaggcaaggattacaaaaagtgaaggctgccgggtacggtggctcacgcctgtaatcccagcactttgggaggccgaggcaggcggatcacctgaggtcaggagtttgagaccagcctgaccaacatggtgaaaccccatctctactaaaaatacaaaaaattagccgggagtggtggtgcatgcctgtaatcccagctgcttgggaggctgagataggagaatcacttgaacccgggaggcagaggttgcagtgagccgagattgcaccattgcactccagcctgggcaacaagggcgaaactctatctcaaaaaaaaaaaaaaaaaacgaaggctactggagtcagagatggcattgcttgtgacaatggaggtgaaatagagatcctggttaattttggtatcccagagccagacaaaggtgtaagtccttgagtggatttaggggtatgacgtgtggctcgcactggggagtgtagggtaaacatgaggatacagccctgagagctggaaaaaagtatccttctgttgtcttctcccgtattgtcttccttctctctttccctttatcttttattctctctttgattggtcttttttctctcagattccttctgggagccaatataatgaaaagactaagaactgcataggtaggaatcctggccactgaccagctgtgagacgtggcaagtgactttgagcctttacgtggcaagtgactttgagccttgttttcgtgttcgtaaaatgaagacaatggaagcattaatagctttctcattgaattgggaagattgagtgaaatgatgtatgtaagagcaactgggcataaaggaaatggtaaggggtctggctggctgcctctttcttggtctgccttctttgttcttttccagaggtattagttcttctcatccatttttcctttgttctagagcatattctgttaaacaggtgtaagtggtatttttgtttagttgaaaaaaaggtttatgccttctatttttaatgtacaaagtgagcgagtagagtatctcccatttctgtcagtgtggtagaagatgactaaaatgacagtgcggaggcccttgcctcttctcccctcgaatagcagcacccctaagccctttagttccattgggcctcaggatccttatctataaatgtgagggcttgaattcagcatactgaggccctaatctatctctgattgcatcgttgagaagatgctaaaagtcagatgcctcactaagttatgcgggccagccatgtctgttttgcttagcatcataggcccccgacatccagaatacctggcccatcgaagatactctgtgaatgaatgaatgaatgaatgaatgaatgaatgaagacagaaagaaagatcttcatgacaaagaaggtagtccacattcagcaggaattattttcagggcaccactgactttgtgggcccctcttctacaattctgagtttaaactcaaagtttctaattgcagaagatgtttattagctcaaatgtcaactttttttttttttttttttttttagcatttcttttcaaacttcctcaagagttcatgatcccttttcaattccaatttgttgccatcctttatagtcctgggtctctgtcatcatttagcaagtcagctgtgcaaaggtaaatactatttttgaaagcacagggtataattacacaacatcatagcaccatctgcaaggtgctgtgcccttttctttatttctcaaggctgcatcacatacctcattttacaaatgaagaaacagactgaaagcaaggagcattccttggcttctgagttcctgctttaaatacaccactatctctgactaacacatgccagaattaggctccttcacacatcctctagtcccacagacctttgaggagctgagccttgttcctcaccactcacagggcccctcatggctttcctgtcagtgtagatctgtgaaactttccattcttgttcctgccatgttttgtcctgcggggaaagtatatgtaactaacattgtacccagccttgtagggtagatgtggtccctgccttcacggttaagaacaaattggaaatataatccatttgttcacaaaaatactttttgaactccccctttgtataaagaatatactattccacatataagacgttttggggtagaaggtactatataatttagagccaaaatgatgtggtacacactaagtactgtctggatttgaagaaatcaagacatcagaattcgctggcagcttagatccttttagatacgtgcagttcctgaaacaaatacaaagtgtttctgggcaactttggcataccctctggtgttagacttgtcagcaaaattggtaactgttataataatattgtgacaatgtcaagacacttctaaaacctgaaatcagaccattcaataataccctaattgttttctttccaaacttaggtaaagtggtgattgcaaatgattatctttagataaagcaagaaaagtagacgtttcaaggacatgtagcttttgtttaaattgggtcatcattacctttcctcattattttgccaaaacttttatagcagaagactggtgagaggaagggcagtgaccacggggcagtgctgagaactgccagactatctactgtgttggaggaagggatttctgtgtcaaattctcatttactagcaacattcaaacaagcttcgctattttctgtgtctgaatatctgaaacagttgataacaattgagtgttggctgccatgatgtcaccatcaaaaaatcacgagagaaactctaatgacttctaaatataatctgctagttctcaacttattttatgtattcaggaaaagcagttggcattatataagaaaagaattatgaaaacctgtcctttccagtcagtcactggcaagactttgcagcaacattgctttataaccttgtcatctgtgatagagtcatctgtctcgtattcaatcctgaattcagaatttgggattatagaggcacctgagaggccagttggctggaagatagttcagccttatcagatattaatagaaaagagatgattgtttaggccgagtgcggtggctcacgcctgtaatcccagcactttgggaggccaaggtgggtggatcacaaagtcattagttcgagaccagcctggccaacatggtgaaaccctgtctttactaaaaatacaaaaattagctgggcatggtggcgggcacctgtaatcccagctactcggcaggctgaggcaggagaatcgtttgaacccaggaggcagaggttgcagtgatcacgccattgcacgccagcctgggcgacagagtaagactccgtctcaaaaaaaaaaaaaaaaagagaaaagtgatgatttgtttagctagttctacctcgtataattactaagaagtaactcctaaagatgttttaggagtaaacattgagtcaaaatgaaaatgttactgggtcaccagaccactgactgtagttagctatttaatgagacctttgatacagtggccagtggccagcatagaagcttaacttgctctccttccccaccttccaaggtagctagacaaggagtaaccattctaactcaactagaaggcagcccttatagcgcaaaatgcatctttccactttggataaaatgctgtctctgcaacaatttagctcctagagaagacagaaaaggcaaactcggttttttgttctttgggtttattttggccactacatgtaaatcaccttgatttgaaaaattcttgttactctgccctctcagaatcctatgtggtatatgtagttggcttccaagccaaaagcagtagctccatgtatttattccatgaattcagcaaaattcactgcaccatctatgaaaggactggttacgcaaacctacccttgctggtcggtcactgagacaggcctggagcagatgttgtaagcacaaaggtagccaggctttctgctttctgtattcattagcctttcctaggtggtggattggtctgttgttttattcctttgcttttaaaatttttggaatgcctctaaagttgagtatttcttgctgagagctgatatttaaagttacttgagaaaggactttttaaaaattctatatttaatttgtaaatatgcatctgaataagaaatatatttgccacagcaattttaagcctttgataagcttaaatgtgttggtaatgtctaccaacacatttttggtcgttttgtcctttttggaaacaaaattcttcatgtctgcagccacttgcatttttggtggagacccattacctgcaaggtttttaaggattttgcagcttctggaaagcaagacccatgaccaaagaaatttgggaaaaaagacttggctaattaaaagtatcagatgatgatactttttctgactttgaagaatttaattggctttggatgggaggttgtgtgtttaagcgttttgctttttctgacatgtgacttgacatgagttccaagaacaatcagctagttagaaggtttgcagaaggaagcattgtgctccctgttaatcagctgttctctctctattcccctctcatccctcttctgatttcagtggtgcttcatgccccacctccaaccaagatcaaacgggagctgcacagcccctcctctgagctgtcgtcttgtagccatgagcaggctcttggtgctaactatggagaaaagtgcctctacaactattggtgagtgggcaagaggagtcgaagaaaggctgcccagaaaggctctggaagtagccatcaagctgaatgttccttcccagtgttacttacccagcagaccctgtggtaaaacatatccttctttcatggcagtgtcatcctccgggtgtagtccagtccccttgggatcattgtactgcacacaaaagaaaaccattaaaaaccttgtggctctacagagcactaagttcatagggtacccagtccttctagggaaagagtctcaatcctgggatacttgatctgtggctttgaggcaggtaatatatacttcttcatgtctatcatatgttaatgtgaactttaagcaccagagaagtaatctccaaatcagaatatatgaaaaagtcttgaagcttgtgccctttacttaagaatatccaggccccaggaatgaagctttaattttaaatcattctttgctctagaagataaacatagatttgcctgaaagggggaggagaagagttgttaattcaaatgatgtcacagcacaaacagaccttcaacacatattctgactaattcctgggaaccctggaaatagttgggagaggggaccagagaacacctggcaaacatacattctcccctcacccacccaccctacacaggcatacacggagaattcttttagaaggagggaaaaaggaaaccggaagcagaggctaaaattatccttgagaaaaatcactagaagtgttaaacaagtccctgtgacgcagtgtgtttgtcacttttcagaggtacaaatatcccctcggggctacgagcgatttaactatgttaatgctgttatttcctggcaacaatgggctgcaaactagctttctgctggacctggtaaccatgctaatggcttcatttcagcttaatggttccttctctttttctgtttacagtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagaggtgggtgttgatctgggcttcttccttaattgtctccctcactcctatcctttctcactgggagaggggaagcagtttgtcttatttaccaggttcctaaaaagttatcattacattgaggcagcttgtgaggcaagactaatgataatacgaatatgactgtttatataccaccctgttcccaaggtactccagatggttgatggactacgacatccttataaagtaggtaagggagaggtaactggtattctcccgtctcacagaactagaggaagaatgacttgccaggatagtcttgtccctcactgagggcaggttcctgactcctcattggatgctgcctactattaatagaattgaacttcagttattaccatttcacttacatataagggacaattgctgatttatacaaggtaatattacttatctgattttaacatgttttaacagtaggagattagctaaggaccttatttgtacatctgcttttgaaatagaaatctcctggttacactgcaggtggtttttacatttctacaggcattgaggcatcaggagtaacttgtccagagtcattcatttgtcaaaaaagtgtgtgaagggaaccttctctgcacactccaaacctgacctctttatctgtggtattctagaatctcggatgcttgtggccttcttttatagaagatgtgctgggggcctgtctttatttcaagtttctctgggataggggggtagttgtcaacaatattaccaaaggatgcaagatggtggccatggtatttcatatctatctatcttgtgttaggtggatcggtgtgggggccacaatggggcgggagtgggaagaatatatgagtatacctttcccaggcctggtccattccagatgcctaccagtatttacttggaggtcattttatttctagatgaaatgcaggggaaaaaataaggtccctttgtctggttctgatccccttcccgttttgctctgaaagtcaccattaagaacggcaaaatatggctggttgctgtttattccttggttaggccaaggaacacgaacgcctgtgttacacagggctcaaggggtgagcactgacggggttgtggggggctggctctggagtgggcctctattgccaccggggactcatctggaggacacagctgccgctgagcttttggcaattgttaccttgtactaacaacctgtacttgtgcagaagaatttggttacttggttttttatgtaaaaattgtagacttttttttttaagttggcaactaattcaaattaaaaacaacacctctgcagactaaacaaaacttctctgggcaaaatcaccctgcaggcctgccaatttgtgaactctggcctagatatcatttttatttcaatggttttttggtgtttttaaacagcatcttgctgattttctgcaagggttatggggaaattggggaggaagtgtggggtcgagtatatattcagtatttgaaactcttagcaaacttctatttgttataccatgaactgtaaaagaaaattcctttatctaatatttccccctcaatccttgttttttatccaaggggcttatgtaacatactgtattaacagttaactgagttgggagacaaatatcctagttctcctggagaattgggagatgggtagccccagtctcagctgtgaaataagcctgtctccagtccacccagccccctgagaaggaaggagttttggattcctgggattgatgagttatttgcccgtgggtgttgaaaggaagagaggagggaaccagaatgcaggtatttcttttcttgggtgattcctccttgaagtctgcctgtgcattttggacttacttcttgttatactctgcctttgagactgatgggtctaaaattcaaagctctcacacacacactggggtgatacagagatccttgaggtaattgaggtgaagggggaggaattctgtaggtgaccaaatcgattacaaacaacactgggcacttggatttccactcaagagtgctgtcctctcaaagttgaaagtgcacaggagtccccatgggagtgtggagcggggattttcaatgcagagtccttgttaacattcagagatagagtgtgtgggcctggggcggggcctggatatagtcttgtcacactttgagaaattgtgatccagctctctctaccctcatccttattccaccctacctttatttaaagcatgtattaccaaattctattcctactgcctttgtctattaatatggtcatccacgtgatatctatgtgacataaaacgcatcaaaaacgtgacagtgatttttcttctagatactggatagtacacagaaaatgagacagaccaaaatccctggtttgatatttgtaaaagtaatagaaattacagtcatggataatatcaagcttcataatcacatatttaataacttttatgcctgcccaaaagtggggcagattacttttattggtgactataggttgtctcttggcttagaactttttattaagattagagggactattacttcaaaacgaaatccctaatacaaatatatggtattttgcatgatagaagtaaagagagtctcatttgaaacttttaaccgccctgtgacataggcagagtgaaaaaacccattttataggttagaaatcaagcctcagcacagttaaaggactttctaaagctcacatagccaaatacagggtcctacattcagcaaccaaaaacttccatgacgtgtaattacgccatttgtttcagttatgattttatttgggctgctaacatccactaatgtctactataaaaactgagtaattgaccttgataaatttgttttgaccttgaacattatctgtttttttattatacttttaagttctatctatctcttcaactacaaaatcttaataaattcctacatcatttaatccaaacccatgtgcttaacatgtgtcttttttgttttgctgggtgtgccgtatctgttcagttgaatagagtaagctctttgaggataaaaacctgtgatttagactcctttctttaggccacatttagccttgtaccttatttgtcctcagtatatgtttattgatagtgataaaagtttgctaaaattataccgtaaatagctaaaatgtaatctagtcaaaagtacacccttgccacacatggcggcacacacctgtagtcccagttacttgagaggctgaggtgggaggatcacttgccctcgggagtcctgggctctgtagtacactatgccgatctatcaggtgtccacactaagtttagcatcaatatggtgacctcctgggagtggggaccaccaaattgtctaagcagaggtgagctggcccaggggtcagaaacagagcaggtcaaaactcccatgatctcattgtgccactgctctccagcctggacaacacagtgagacccccatctctaagaaaataatgaagaaagaaaaaagtacattcttaatgttttatatagtcttagcatgtaattcttcacaactcaatttatttttagaagataaatactgtgtttgaaagccatgatttataccagtgatttcctccccacaaggagaggggaaaagacatgtaatttgacatgttcagacatgtgccacttatcctgaaagaccagctgaaaaaatgttttttccttcagccttcccaatcttgtgagttttctcattgtgttatttatgatgtttacatgtgctgggtggaggaacttagaaaaatattcctatagtactggccgtatatatttttggcttttattaaaccgtatctcattatatcttgagttgaggaaagccctgcaattcaactgaagaagctccactaagaaaaatgtatctctaagaattttggaatacactgctttctcacttacttgacatcaaccaaagaggttaaaacccaagaagcagcaacatttaagaaaatgctcctgtacctgaagaatcctctgcttctggatagcccctaagggcatcagtattgtggtaggctagcatgctgtaattgacagaacaaaatgtgtagtgctggagtcatcaggaaaaggtcaactgggtagtgtcttctgaaggaggaaacagcctaagctgtttgagaatgtcaagaacgtctgcttcggtggttattattgaggattcagagcttaaagggatgggctaagttttctggaattttgatttaacaaaaactaccaattccttaaggatgctagataaattaagagattttatatactcgtttttcctcttgttttttcttcctctcttaaagttcattacccttaaagtaaattgctattcattttttgtccttcagattttgtagtacaataatttttagagaggaatgaacttgactgtaagtcacatttgtagcctggcctggaataaagtgaatgtgcctgatgcatctcttctccaagtgcctgttaataacatgttgtgtatggcagcacagattcactttgggatctgaaactgagtttcatggatgcttaatggatccttctttgacagactgaatgatgttcttgtaatggttagagtgcgtaggtttttttagttctgagtcttaagagggtttgtttttagcatttcatcatgtttactgtaggcttcttgttaccttttaacaagctaaaggacatttccttttatccccagtttactgaaagttttttaacatgaacagaggttgaaattcattaaacatttatactgcctcttttggggtgatcaaataattttctcctttaatttcttaatatggtgagttacactgatttatatgaaaccaaccttgcattcttgtgacaaacctaacttgtttattctttttttttttttttttttttttggagacagagtctaactgtcgcccaggctggagtgcagtggcgccatctgggtgcatagctggaattataggcgggcaccaccacgcccagctaatttttatatttttagtagagacaaggtttcaccatgttggccaggctgctgtcaaactcctgacctcaggtgatccacccatctcgtcctcccaaagtgctgggattacaggcatgagccaccatgcccagccctaacttgtttattctgtattatattttgtacattggtgagtttgggttttctaatataaatatataagacttccacatctgtcttcatgattgagaaagtacataatttttctttcttatattgtccttgctaggttttagcattaaggttatactcatcaaatgagtagagggtgtcttccgttttctatattttagaacatctcatgtgaaattggaagtctttattccttgaactttttgaagaatttactgctaacaaccatttgggcctggcattttctttgtaggaagatttttaattactggctcagtgtcttcacattttacagttttgccctggatttctatttagttgaataaatttaataaataaatttttctaagaagttgtccattttgtgtgagttttaaaattaattgacataaagttattcatggtgccctttctaaaatctctatagcatctgtagttgtctttttcatttttgatattatttatatagacctttttttttccttagtcttggcagacaatattgtcttcaacaaatctacttttggccttacttattctctctcgggtgttttctgtttcattgatttctgctctcactaaaatactttattctttgttttctttgggtttattctgtttttccaacttatttgttgtatgattagctcactaatttttagccctttttctttataatatgtaagcacaaaaccatataaaatttctcttaaggctggggtgactgtacatggaagtttgccaggtcacttatggtctgtctatgccttgtttagaagtgattgctaatagcttcttgcactctccaaaggatcctggtttggacaatcagttatttgatctccctacccaagttctgctttagatacattgcacaggttctgatttgcagtactttaaaaattcagctccaagtattttctattatttctttcaaccttggagttctttatagatatgtttcttaatttctaaacgtatgagatttttctggttgcctggactatatgatttttattatctctcatccagagagtatttttaaatgattgtagaaacagtataggccagtggctctggagttggacagactgacagatctggggttgaatcgccgctctgctgctgtgtgacctcaggcaggcactcaacttctccaaactttcgtttcttcgtctgaaaataggataatagataccacacagaagcgttgggtagattaaataaaatcacgcttggacagaggtgttcagtaaatgttagcttctatgacaattttactttttgaaaatcacttttattttacataaactatactaaaggacacttccttaaatgatgtaggtatcgcaaactgagaaacttcattgtttaatgttaagtttttaaaatgtaatgctgcctttctccctgatcttttcatcatcacactaatattttttgttttgttttgttttgttttgagacggagtctcactccatcgcacaggctggagtgcagtggtgcagtctcggcttactaaaacctccccctcccgagttcaaacgattctcctgccttagcctccctagtagctaagattacaggagtacaccaccacacccggctaatttttgtattttcagtagaggtgggatattaccatgttggccaggctggtcttgaactcctgacaggttatctgcctgccttggcctcccaaagtgctgggattacaggtgtgcaccaccacgcccagccaaagttattaatgttatatctacaactaatactttcaccatctgatatcctggggacatgtcttagtttcatcaccatccctctcccatatttgatcttgagaagtcagacaaacaggtaggcctacaaaggacatgctttttgttccttatctctcaatgtcttctcacagtttaaatgggcccatttgagtctcagcaatgttggcaggccttatggagttgtttcagagttctttggtgtacgtttagggacagtgtctggctcttcgttatatcgcaggaaaataaacatcattgtgaagttggcacattgccacctccaataaaaatcagcattctctttctgaaaaaggagaatggatattgaaaaggcaaccagtgggctcctttgatttgtgcatggtttgtgtgtgtcatagtcttccagttccttaagatcttctcttttatttgcatatcttttttttctttttttttttgagatagagtctcactctgtcacccaggctggagtgcagtggtgtgatcttggcctccacctctcgggttcaagcagttctcctgcctcagcctcccgagtacctgggtttacaggcattcgacactgcacctggctaatttttttgtgtttttaatagagacaggtttcaccgtgttggccaggctggtctcaaactcctgacctcatttagggaactcacatggtgatctgcccaccttggcctcccaaagtgctgggattacaggcctgagccactgctacaggctgacgcctgtaatcctagcactttgggaggctgaggtgtgtggatcacttgaggtcaggagtttgaaaccagcctggccaacgtggtgaaaccctgtctctactaacaatacaaaaaaattagccatgtgtggtggcaggcacctgtaatcccagctacttgggaggctgagtcagtagaattgcttgaacccgagaggcggaggttgcggtgagccgagatcgcgccactgaactccagcctggacgacagagcgacactccatgtcaacggtgaaacggttacaggtttcaccgtgttggtcaggctggtctcaaactcccgacctcatgtaaggaactcacaaggtgatctgcccgcctcgagctcccaaagtgtggggattacaggcctgagccaccatgcctggccatatttgcatatcttctgattttagcttgggagttgtggggagaaggtggggcagttgaagataatgtttattgagaacttaccagtgttataacagggccgggccttataacatacattatcttacatcatctttacaaggtatcctggctgtccttatttttttggagaggaaactgaggcttcagagcggttagataactcatccaaggtcacacagctactgagtggtaaaggttggacttcagcctaggatgttctgacttcacagccacagcctcttacccagctgtgctgcttctcgattttccgtcttcttccctgagccttaacggaagtactaagtgcatgatgttgatttcttggcagattttatgtatcatctctcagctggcctttaaacggccactgcttcacctggcacccataatcactatataacctctgtcagatccttttctcctttttttttttcctgtgagcattgtgtttactctgtgtgctggcagcagaaaccagaaaggaaatgcagaaaaagcatctaacggttttcataacgtaaaccaaatgttgggagtgtgggtgagctcgtgggaggaaaggcgctatataaatctgacaaataaataaataactagttctttaaataaactggcaccgaaaaagccttaaactgtgacctattgaatttaggcttattcggagtcagaagtccctttgctcaccaaatgtgagttccttacacgtgcactctgttgggctaatggtgggagtggatggaagggaggaggttaaggggaggaagaggaggtttggtaggaaccaggctgtgccttcactgaaagtgattgcctgccttggtaaattagaggcatctttgttgtagctgtattatgtatacaacacattcttagatacttcaaaaggactggagaagggagggtggttcaagtgaaggtcagtgagtaaagttcacaggatgtattttgaggacaaggactgaatgacttcactaatctctgcacataaaagacattatcagcagcaagctctgagaatctttcttccaaatatgttggctttgtgacctacccctgagatcccccttggccactcctgctgtctcaagacaaaccagtacggaacaatcccaattatagaatctgttctgcagatcacaggcctctaagctttgcgcatccttaaagttatgccgcggggaggggatgaggttgctggctagtgcccatgtggaagtaccttttcctgaggaggccataccaggccaactctagagtttcattctggaaggtgagaaaagatgagcactaagcggaagtgaggccaccagcctgccagctgcagaggctctggttacagaactgagcggcacatgccatctcggagctatcaaaggaactgatttctggaggtcaccttcgaaggtgctgggatggtggcagaggggaaagggagagaaaatggaaggcgttactaccattcctttcaagtagcacaagatgtgggcactttacaaaaataaggccttaagaatatcttcggccgggcgccgtggctcacacctgtaatcctagcactttgggaggccgaggcgagcagatcacttgaggtcaggagttcgaaaccagcctggccaatgtggtgaaaccctatctctactaaaaatacaaaaaaaaaattagccaggcatgatggcaggcacctgtaatcctagctacttgagaggctgaaacaggagaattgcttgaacccaagagatggaggttgcagtgagccgagattgtgccactgcactccaatctggacaagagcgagacgccgtctcaacaaaaaataaaaagaataccttcatcagctgggtaccgtggcttttgcctgtaatcccagcaaacttttgagaggctgaaacaggcagatcactgagtcctggagttcaagaccagcctggccaacatggtgaaaccccgtttctactaaaaatcgcagctacttgggaggctgcggcaggagaaccacttgatcccgggaggcggaggttgcggtgagctgagatcgagtcactcgagtcactgcactccagcctgggtgacagagcaagacttttttttaagtctttttttagactttttttaaaaaaaaaaaaaaaaaaacaacttcgtctctcttttctgaaagaattccctttaggtttgcggcatgctgccggtgcccatgttctaaacgtcaagtgtaaacctgagacgggaatttacacttcttcaaagaccattgaaaggtttcttgaagaagttgtgccgtaaggcattcagcgccccatgaaaggctatcagcccactgaaccttcagtagttggtaaaacttgtttaagacattggccaggtggattctgaggcttttgatgtctgggataaaaggataagtacatgtaaattgcccagtagttttcatattataaaatgatcttaccgtgctgctttaggtagagtagtaaaggcagtatattgtgctgtgctataccctgatgtaaacagtgttctatctgtacacagatctcttcagtttaagattgtaaatcttgatgttctagaaatctgctgaccacctgttcccacacattgattcaaatcaaattcaaactattttattaaagctattcaagaattctttgaattaatagaattcaagctaaaagtagagaataagaccttaatattacaggattgtattatttttccttgaagcttggctcctactttctaactgagggtatatattcacaaatgcttttctttatacacatagattagtgcttcctgtctgtttcatggactgagagttcacacatctccagccttccacaaccaccttcctaaactctatagtctgtcaattatggctgtggcagaaaccatactttacagacatgattgtatttcaccatttcaggagcatttggaggataatacatccccatgtcacagataagcaaacaaagccaagaaactttgcctttggtcacttccctactaaggcacggcaggctttcccttctacactgcacacccaacagggaaagggcagctggcacacatctggatttatctgacagctgaagagtgttaaggaaactcgactagtagcaacaggtttttattctatcttgttaaaaaacagtgcatatttattatcaaactatagatgagcaaaaaaagaaaatcacctaaaattataaccaccccacagataggcagtgttaatatctaaatgtcagtctttctgtggttttatatgacaccatactactacttttatttttgctaagctttgatactctacgtactgtttagcaaccttccttaatatgtcaaaaatacctttccaagaccttatatatttacatattatgtaatttctaatggttgctttcaaccaaatgactgtatcataatatatatagccagtttccttgttagacagctgcattggtgaccatctttgtagttatacctgatcatctgtgactgaattgctgttcaggtacctggcacagaattagtaactgcctgctcatcttccaagctaaaaggaaaaacacttctcttctgactttgttacttttttaattactaatgagttaaactttttgtttatgaccattcctattctgtaaggatattcctgtttatgtcctttgcccatttttttcctcttgagatattcatcttttgttaatttctaaaagctctttttgccaacagtgagattcctgtatctgtggagatttttcctcagttttacttttggttttgtttctggtgttttctgactactgcagattctttccccctggtttgatgtgtttcttttggttttgtttccgatgtctttttaagttatagaaatttatacagtgaggtatatccaggtttatcttgatgatttctgctgttggtatgatacttaggttttccctcactcccaagttttgtaagttttcatatatatttactttcatatgatggtttcacttttttttttttttgagacagtcttgctctgttgcccaggctagagtacagtggcgcaatctcggctcactgcaaccttcacctcctgggttcaagtgattctgatgccgcagcctcctgagtagctgggattacaggtgcacaaaaccacgcctggctaatttttttaggtttttttgttgttgtttattttgagacggagtctcgctctgtcacaaggctggtgtgcagtggcgctatctcagcttacagcaaactccgcctcccaggttcaagcgattcttctgcctcagcctccagagtagctgggactacaggcgcgcacaaccacatccagctaatttttgtatttttagtagagacgggtttcaccatgttggccaggatggtctcaatctcttgacctcgtgatccccccgcattggcctcccaaagtgctgggattacaggcatgagccaccaccgtgctgggccaatttttttgtatttttagtagagatggggttttggcacgttggccaggttggtcttgaactcctgacctcaagcgatctgcccgcctcagcctcccaaagtgctgggattactggcatgagccacaatgcctggcctggtttcactttttatattggaacctttaatccatatgaaatttattttggtatctgtataaaatggggtctaacttttttccccaactaatttgaaatgctaaccttaacaagtagtaaattttggaatatacttgacagtttttggcttgccattaaattcctttgacctgccaatctctcaatttgttgtattattgttttaattattgaagttttatgacatatgtcagtagctagtgggtccttatgccttttcaaaataaagtttagaatcattttgtcaagttagttgggaaggcatttgcttttatagattaattttcagtgaatcaatagcttcaaagtcctaaatatattctcttaaatcttttttctttcttttcctctgaaaacaattttgagattttattcttatatggcctataggtttcctgattattcctaggaatgttatgttttttattgctactatgaatgggattctctctcttttttctttttaactacattttctaactggttaatttgtattcagtctttaaaaattccttctatctataggtgagagaatggatgaactagtgaacaaacatttatgtatatgttagtgctatttgcagataattggtctcatatattcagatacataatctggcccatctatacagatagactgtgcataaaatatacatacatggaagataagaggctaccacatcattgctttgattttttttttttttttttgccacttcctgactcaagagcttcgaaatacacaatgtaattttgggaagagggtaaaatgcccagaaataagcattattaagtactttgcaaataatttcattaattggaacttctagtccccagtgctcaatcatagtaggaattcatcaagtctttgttcaacatgaaaacctctttcttcttacagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcaggtcagcatcaaattgtgctattctttgcttcattcttgcattcttctgtctcgttattcagtgtcttatacatgcagggccttggggacaggaatttttataagaattttttataatttttataagaattgccctcaaataacttaggagctagtagagctgacatgtttatgcgcaatggaatacaaaacaaaacagaaaagctatgtaagtggtaggaagtgcggtaggcattcagaagtggtatgaagtacatctctgagtccaagcctggagagtgttggggttcagttttggatggaatttgctcgaccttctctgagataatacatagattgatctattcaggcaccagttggttatgggaaatgctgaggaaataggcagaagggagagacctgttgctttatgacagaaaaattaccaagtgtgaggtagtgatcgtgtgtaaacatttccatcagcattcctctggaaagctttgatgtatttttctcaggagtagcatgaacagcaacattttttcctttaagactgacattttgatctgtcctgatgggttttgcaccccactccactcccttaaagcaagacactcaacagaggttaccatatctgtaattctttgatctgagttgtattgccagggtgatggctcatcccacatggacacaactcaaattactgtctttcgtctcgatggacactgataacatgatggctgaagaagagatcacttgagtgtggtttggtttcagtatgacagccccagcatggcaaaaatggaccaaactgcaatcctctaccccttccaatgctggtcctggcttcctaacttcaggtcccctaatccctttggcctaaaaatactcccacctgttggagcaaaattagatgtgaccaccagcagtaaaggggagcaaattagaaaagatctaaagcagtcctcttcccgttcccaccctaacacccaggagtcagcatgggcaagaggccaggcttggccttttgaaagccagtattttttcccctgccattggctctttcaccagatttagtgttaacacatttctaaaataagtgaacaatgagagtgaaacatcttttttttcctcccgtgactcttgattaggagagcctgcctttcagctggtgggttatggtgtttgccatcttgcttattggtgtggcacctctttcccaggacaaagccagaaagacatgaccccagagcaggaagtttaggggctttaccacagagctgcagttgaccgatgtgctgtttctgctgcagaaactattgacaggattgtgtccacctttgctttcctttcagaagtgcctaactgccagtcatcctacatgagagggggttatttctccagcagccatgaaggtaaggaacctgcttttctttcctcttctctcctctctcctctcctttcttcctttctttctctcggcttttctttctcctaccttccttccttcctctttctttgcttgactaatacccaagcttaaaattgctcagtttccaggctaagatttgagatcatagtttaaaccttgcttagctcatgaatatgagagctgattgattgtaatcttcaattattttgcacgcagggtttcaagcatgcccctaagccctgtgagggctgccattttcattagcaatgaccccaactttttaacagtataggacaatttggagaaaaaacaaacccaccttatttccacatttccagaaatggaggttatgtttatataacactatcagctgaaactggaatttaggagttatgtcagtgagggtggtttttatatgttttacagttatgtcagtgagggtccaaggatgtcttagagttttaaaaatgtgtctctaggttttttacttagtttgagtgcttgggtgggtaactcttcattgtaattattattatatgataaatggttgccatttttaacatgggagggaaattgaaggtattcttcaccaaccttgagggggctggtggggaagtgagctagcagggggtagggagtactggggatgggagtggagaggtatgttatgtacaaaatgcattattgaaggacacaaatgttttctcattggatttttaaaaaatacctcaaaggagaaacatgagaacagatataaagcagtttacccacaagcctggattatcacatatcctaacatttatttttatgtgaagatgatcgttttatatcaagggtgtatgctgtctgctcaagttcttgtgccctatccctttgggaccaacttaattcagtaagtctctgagatcatctcactctaattaggagcaggagcagtaggcaaggttgagcctgtgactttgccttcattagtgctgacctactaattagggtgaaagtaattgggaacaaataagatgcataagtgttccatagcatatggcttcaaggaagtggtcagaatggagctagaatgtcagtttcttggaggagcttgctttttttcatctttttttgttgttgttgttgttgagacggagtctcgctctgttgcccaggctggagtgcagtggcatgatctccgctcactgcaagctctgcctcccaggttcacgccattctcctgcctcagcctcccaagtagctgggactacaggcgcccgccaccacgcccggctaattttttgtatttttagtagagacgggtttcactgtgttagccaggatggtctcaatctcctgacctcgtgatccacctgcctcggcctcccaaagtgctgggattacaggcgtgaactaccgcgcccagcctagttttctttcaaatataaacttttgtagcttatttttagcacaagcaataaatactgattacataaaattcagaaaatacaaacagacaaaaagatgaaaattaaatctcactgcccagagataaccattaacttgctacatagtctttcaatctttgctgtgcatatgtaaatataggattatacagatcgtataggactcattgttttatagtctttttttaaacaatagtcattaactcaaattgaacatttactatgtttcagacactgttatgtgttctttagatgcataaattcagttgtttaattctcatagcagccctataggatagatatttctgggtttggttttgttttgtctttttgagacggagtcttgctctgtcgccaggctggagtgcagtggcggatctcagctcattgcaacgtctgcctcccgggttcaagtgattctcctgcctcagcctcccaagtagatggaattacaggcgcgcgccaccacgcccagctaattttttgtatttttagtagagacggggtttcaccatgttggccaggttggtctcagtctcttgacctcgtgatctgcccgcctcggcctcccaagggatagatgtttctatttgccccatagggtaatgaaaccgagactcagaaaggagaaaagatgtgcccaagggcacgtggctgtaagagtagagccagaactctaagccaagccctgtggctccagagcccatactcttcatctccttccatatttcacagccaatgtcatctctatagcacccaacattacactatgatttcctcattaatggctgcacagtactcattgcatggggatgcttttagctaatcacctattgctgaaaagtgggtacttccaggttattctcaaattccatgaacattcatctagctaagtgttttcttgttctcttgattcttgaagctaagtttctgaaatttctgggtaaaggagggtatgacattttttaaggcatctgctgccggtttttgtgagggtctgttttgttgttgtttttagtacattgtcacagatttttaaattttacgatttatctaaagaagtaattagatgtgaatcaaaaggaagaagggatccttttgttgggggaggataatcgggcttttaagctcctgcataaatgaatgacagtagcaaatcagtgggctcatttgatggaaaggagccctggtagggactgagatcatgcttgagggatatgaaaggcctggagaggtgggctcagagcttaaagttacccttctgggcaaaggctaacttggtatggtggattgaggagttcccttctaaacattgaaatagggaagtttttttagaacaccttccccagatgtatgtcttctttttctcaagtgtatttctccctgaagatttaaagcagtgtgattcccaaaatctgtggcaacagcttcacctgggactttttagaaatgcacattctcaggacccatcccaggcctactgaatcagaacccccagcggtggggcccagcagtctgtgttttaacaagtcctgcaggagattctgatgcaccttcaagtttgaaatctactgagtagtaacggttctcaagtttggtcaaacattggaattacctgaggagcttctaaaaatgtagatttccaggtttcctccagagcaattaaatcagaaattctggggtgggacccaggctttagtagtttctaaagctccccaggtgattccagtgtgcatccaaggttgagaaccactggtctctgtcattttaaatgaaagtcaaaagagctgatactcatgaagcattgggtggcttttataagtgattagttcataagagccgtgtttatgggtagctgcttcgcactcacttggttagatgggagaccgagtgttgtttcactgggtaccctgtgatgttctgagtaagtgtccagccctggaaaggcagggctgtctcccggacactggctgtgatgggcacagctgcatggggctctttgaggttcctgaatgtttctacagaagcagttgatgtctgcagcaggcaaactaggagggagtgggggaagagagggaggaaaacattttgcataattacaacatttaggaaagagcatgctcttaagggaaatatttttagcaaggcattgggttgcttactacacacagactatctggtgcatttgtgtgtgttttccctccaccctttcccattcctttccctgacttcacacacatcaaagaagttagtttcaaagaatccagcatttttaattgttctaaattaccctgacatgcttttcctatccttatacaggcttgaccacagatgcctgtgaaacagttaaggaaacaagtgtttctgattggcatctgtgattgctaagatagccatcctgccttaagtgttcacctggagtccttgcataatgttttgagtctttcgtttctagtttgcccctcaaacaggtcttccttcctgccaccttcatttgagtgattagatgattgtggccacaactgatataactgctggctcaaattcaactgacttaaatttcacttaaaccaatagtatcttccagatggtgtagaggaccacatgtggcgatgactagaaaccacaagatacaccgcagtgatacttcttataggcagaccttcatctgattagctttgaaaaccaaactgagaatttcttctagatgtaggtggttgtgtttttttctacatactgtgaatgtatttttcttaccttagaggagaagaactctgaaaataacatggcaagtttgacagatacgtaaacttgaagtagttcgcttgtaatgactttataataagaccattaaaacatcaccggaatatcaaaatacatatggaagatcgggaaatatgtagcttcctggcaggcaaggcaaaatgtttgaagcatagtggattatgaaagtcttgttggtaatacagagtataccagttggtcataaaagtcagtttagtgccaaattggaaaataaatttatcaggagtcattgaatccctgacttaaaagttagcattatattcttaaatattttttaatgaagactataaaacttctcatttattcaaatatttatttagtacttatgtgtaaggtgccatgaggacactaagataccaagatacgatccttatcctcaaggaatttagaatctttggtggaggatataagatcaagctctgacattattcagttaatttcttaatagcacttaccacaatgttgtacaatgactatgtttatttttttaactaccatttattacacacttatgtaccaggagctactcttggcactctggtatgaagatagagaaatagatcagttgaatgatactaaattaaactcttataacaacaccataaggtaggaatttttatctgctgcaatgaggacactggagcacagagattaatttattcaagatcgcacagctgactggagtccatcagtactatgccacctctcgtttctttttctcctttattgtctgtcgcccccagttgagatgcaggctccatgagaacaaggaccaagtctacattcgcctggctacctactcccttctagcacaacgcctggcataaatacttagtggattaaataatatataaatgacaataaaatagactttgatgtcgttaagcaacagagaactaatgcttagggctgagaaaacaaaaatgaataatataaacctcaaagcagtctcagttgtgcagagtttcttcagtcccaggcctcttaaaaatggtgctgctcctgccaagaagctacttgatctgggttgactgaagaaacaaagaatggtgaaattataccttggcacctttactcacggatttttcctttctttttttttattttttatttttattttatttttttttttttgagacagagcctctctctgttgcacaggcaggagtacaatagcgtgatctccacccactgtaacctccgcctcctggattcaagcaattctcctgcctcagcctcccaggtagctgggattacaggcgcccaccactatgcccggctaattttttgtatttttagtagagatggtttcaccatgttggccaggctggtctcgaactcctgacctcagatgatccacccatcttggcctcccaaagcgctgagattacaggctatttgtcttcaacaaaccaatctaaaatcacttatttcctactcctccataagccacatagcacttgttattatggctatcctcattcagaacccttaaaccttataattgctcatggaattataattgctcaccaccgtgcccagcctcgtggattttttaagtcgcagtgaatccttctcagatctaatggaagtccttcattgcagagccttttcacctgcctgcccccactgcattatccaacacacacagacctgtagtatgagccaggtgaactaacaggaaaacggagcacagggaagcactgcttatcagacaggagccctggggcattctcctaagacgtgtgctggtaaaggagtatgcactggagaccttacaccttgagacaggctgaactacaaggagggatgtgaccccatccaagttatctgttacctggctttgatttgaaccaccaatcttgacaaggtgcctagcgacatggtggttagcactgagtgtatattaggggtttgtggatgaagactgtcaggccatccttccttcttgagccctttaactttttgccttgccttcttttatttcgtttgcatgtgttgttgggccagttcctccttgacctctgttttgtcatctatacagtgaatttgtttcattgctagaaagtcttttcagatcctctccactgtttggtaataatacccccaatactgctttcgaaatcctctacaggcccaagtctttattcattttggcaacattctttacccttcaagctctttcgtaattgaacgaggtatgtgagtagcttggatgagttagtaggaaaggttgaaattaattttagctaaaaggaaaatggcaggtctgtgtacagatcaaccaaatccatccagctaggccaactgaaatagagatgtgtttccagctgtaaaggcttagtcagagcaacattgatccatgcagacctcagaagcaaaatgcaaaggaacgtactggtgactcagcacttccctgcagtcttagctgtaaaagcaggaattgatgctgctctgactgaggcgcaggtgattacatcagaattggaatgcctaagccctcttgaagtccctgaaaattcagtctgccatagatacagcagtaggacttaggatctgaaatgataggattgcactctagtccttaaatccatagttttagtacaacacagaatttgttaagcaacgtagtctttcttttaaattctctttcaggtttttcatatgaaaaagatccccgattatactttgacgacacttgtgttgtgcctgagagactggaaggtaagtagccccatccaaggtttgttgccaggtagaggtttggaggtgtcagaacacctcagccatgactctcttcccaagtccagtgattaaatcagcatgaacaactcctttttgtcccaaccacctgagaaacttaggactaagctattgtgtgatgtgtccttgtcccaaacaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggtatgcactggatgctggactcagacgggttttgatttgttgttgttgatgatgttttttgtttagatttccattgaggctttttgtgtcaagtctgctcttgcttctcattcatattctggcctggccagtgggcttggctgtatccctcctattaatgggacagtttctaatacatggacaggcagagttctccagtgtagaatacatgaaaagtatttgtaacacttctgcaaaatttagggggcaagatcatgaagacttatattcaaataggatatgctctccctcttggaaagtctttttcaggtgctgtttcaatgatacagacttgttttggtcttagcccctgtgggccatagtctatctctgagtctacgtgaacatactgtatgacattttgacaatatattacaggatacaactacccactgtgtatttcaaatggctgtagcctggagaaataaaattatcagaggtggctcaatcttaatgagcttagattttttttttcaaaggtgtgttatggccgggtgcagtggctcacacctgtaatcccaacattttgggaggctgaagcaggtgtattgcttgaccccaggattttgagaccagcctgggtaacatggcaaaaccttatctctacaaaaaataaaagaaaataaaaataataaaaaattagctaggcatggtggtgtgtgtctatagtcccaaatacttgggagactgaggcagggaggatcgattgagcctgggtgacagagcgagaccctgtgtccaaaaaaataaaatgaaagtgtgttatgtgacatcacaatagagtagttgagagatgatacaaacctcagttattttaataggaaaaaaacactgttactgtttttgtgcccagaacagaaatacactgttgacagaaccagtgccgtttcttcagtggagaagacacaccctagaatccctttcctgaatatcacataacaaagtaaattaaatcaggctctcagtatagcatattctaaaggggttgatttttaatttctgtttgatttagaatctagagagattataaatggaacagaaataactgcccaaaaaaactgacatacgcttcttttagtagcatgttcttaggcatataaattaaaccagcagatcaaaaggcatctttgggttgggtataattaaattgggaacaacactcttagacactcttagaaagcatttgaacgagaattgctgttttcagtgttcagttaactctagggctcgctttagcacaccagagaaatacgctggcatggggttaacaggaggaggtagcaaccggggacttggtttggaacaagaaagtggtctaaagattcaaatgggaaaaggaggagaatgtgtggattagaaatttatgaagaatcctgattgataggagaagaaggcagacttcattcaaggcaattagaaaacaagatgtgcctatgtgttccctgttttatattcactcacgagaatggaaatgtgtcagcatctctagatggactaattaaacagcttctattcggttcagtctaccttcagagctggagttgagtgccactgtgttagtttagtgcctacgtgtttttttctggccatgtagaaatagagccatgttttaggcttctagcatccctgcagagccatccaccccacgccgacccatgcctctcctcactgctttctgaataacgtggcctggtttatgtgaagtttgagaaaagcatgtcacctaggttcactgaggctttctgaaagtagttctgtcatgtgggcagcccttattgatttatcttgtttcacaaacaggagcttttattattttattgccactgcctcgggcctaagcacaggccgtccagctgcaggtaaacctggttatgatccttcgtaaagctgttattgaatcttctgcactcctaccagtggcatagagaatgatgaacagatggcaaagggcccctgctttcttacttaataaagaaactaatattaatacagaatgctcgtaaatgccaggcagccaagtcatatgagaagcctgtggtgtccttgagcctccctcggttgaccgggcagctttgtttcttcaggaaatggtgctttccaccccaccttgaagtccccaagctttccctaagctccaaatgttcctttctcttcacccaggatcagttgggtgccacatgtgcacgttagcctcaggacaggtgacatttgctgagctccccccacccctccttgtatacctgtgagggccctgttcttgttaatgtcaggaagataccagcttctggaaaaagctgtaagaagtcgtcatgggggagcttgaagggtgaagcggaggaggaagctgttgggacgtaattgtaggcagctgtgtggctgagtagtgcactctgggtaattatccataatatccattacactgtgcatggaaattgtggttttagaactgcgttttggcaggccccctaatcaaatgtcttttgatagtcatccagcttagcaccctctcaattatgactgactcggctttaatctggagccattttaactgtgaatctgcattaatgaatattttggggggtagggttgtttgttgaacatgtggcagataactgctgctgggaggtttgaagggatgggctgctagaaagagccactccctgggctgtggctgctctctctttaaaggggagaaggaataggtagatccgttaactccttcagcctcagtcctcaagatacgtgctaccaaagtaactaatgagagagaagaaagatctgatgacaagctattgcctgcctccccagtcccagaagaggggcagccctaattcccagctgctctggagctgagccgcctcatgcattactgtagaaggaacagccgtggtgagggctacagaatcacagggctctggcccgggaggatgagtcagtaactatggctaccagagctgctttgaaatctgtgcgtataccaaacctttctccagtaagcaattgcatatgcaagtgacagctgagaggtggccgctgaagttgaagaatattcaaggattgttttccaccccttaacatagtaaaatgatgaggctgggcttctctgaaatttccctgtgtcacttgtggcagacagcaattaaagattagttttataaggcatcattgctttgaacagggtacaatgatgtatattattaggttagcagatgtctcttcttaccattatttctattggttttaaatgtttatcttctctaaccaggatgtaatttttggttaattttgccttttgggctgtttcaaaggtagagtagagtgggtaccatatggagaaaagaggagacccaggacatcgtgtctgctgtggggacatgaagcaactgaacggaaattggactttcacagggtttcttgcaaggcagagcagaatcattgctattattgtaattaagagagatgcattcttatcagatcatttttggcttttatgaaaggtcattttagaatcctgaatttagaagatgttgctttcattctgcctagatattttaaggaaaaggtttatgtgaaatgctgttttctctctgattcctactccatgtttaacatttggcttttaaaatatcgaaggggccgggtgcagtggctcatgcctataatcccagcacttcgggaggctgaggcaggtgggtcacttgaggtcaggagtttgtgaccagcctggccaacatggtgaaaccctatctctactaaaaatacaaaaattagttgggcatgacaatggacacctgtaatcccagctgctcaggagactgaggcaggagaatcgcttgagcctgggaggcagaggttgcagtgagccatgatcgtgccactgcactccagcctgggcaacagagtgagactccatctcagaaaataaaaataaaataatcgaaggaatatagtttgttttttttttttaagtttccaaaactgacctaaaatgctccaaacgtgacccctgacccctggtttgcatacatttgaaaacctctgagtaaaactcacatttccagggttattctactaccttgacagtcattctcataagtaggattttggaagctgatatacttgagaacagaaattgcttggctgccgtgataattgggtaaactctactaggaagttttcctgctagaaggctgctttgcccagagctccaattatattgccctatcagtgtgcctcaggtggactgggttggatataatgcatttcagaactgtttggaaagccctgttaatttttcattaagtggataatggtgctacatgctttcatgtccattctgcaagtctgctgggagcatgggattggatggcagcaggctgaaatgatctgattcccccttagtccatgagctgcaataagtaaacatctcccagcccccctccaatcttattagaattgaacttttgctctgctggcccattagcaactcactagtgtgtttctaatgtttcaggaatgaccattctaattattccttattgactgctacagaaaccatagcacttaatggcaacacgttaatggtctatgggtattggtcaataattcatacgtggagaaatagtagagggcctgcatcctctgggatgttagccaagccctctgcaatcttaaagtgctaggattcttccatctctaggtctcacctcctagtagttgtcactgaatcatcgcctttgttgaatgtttggtcttgagggagttaaatgccttcccttccaggtcagagtagcagatcattgaccaaagcagtcaggttacagaactggctctgctgggattgggagagaacatggggcccagggaatgcgtttccattgctcttcactttcctgtctcttcaggttgctcggcgctggggcatccagaagaaccggccagccatgaactatgacaagctgagccgctctctccgctattactatgaaaagggcatcatgcagaaggtgagccattatacaagacccttagcccactctggtctcttttaaggaaaaagtccagggcttctgtagtgagactggtgatcgtcgctacgaggaaattttagccccctaagtgattctgtggtaggaaacaatcttgagaagacaaacttgagacaagaatcaaatgagatatagagtacatttgatgctgttggttatgtggaaactagaagttgcatgcagaacacacaatagaaaattaggcttctctgctttcccaaaactgcttctatatatagaaatttccagaaacttaggccaactgttgtatccaaaaaggactacagggaatcaacttgaaggtctctacttcaacagcttgattgaagtctttagttattaaaacacctagacctccaaatctgttagtttgatatgctcagaagtgttagaggaataagagcatctgatttttctttcagacttacagaaactggaactcaagttaaaaacccaacgtttgtagaatggcagcagagtcacctggtagcaggttgctctttgtggaatagaggatgaagcatattttgaagaaatcagtacaaaattcttcgtgggataggtagcaaggggccacagtcttaacatcccatggataagtagaagatgggaatggcaagtctttcttagctaccaaattcgtaatgtactgttgcccagatactagcatttacacattgagccagtctacctggcagtagccaataagatgaacgtggcagaagcatatgggcaaaactgctgagaacttgtctacaagaagccagattcatctttctcataggcgggtggtaatgtgaccccatattctcctcgccaccttaaaaaatactcaacagctcattgtgattttctggataaactctagacttgctagtgcgtcatacaggctctgaggctgttcccagtctggtcaccacctaactctcgtttcttcactcaaacttgacggctttcactagcatagccaccttttaatgtaatgtagtatttgtttgccaaagaatacatgttacatgcatgtacattatcaagcataccataaaatggaagacacctattaaactgtcatcctacttaagacctagaacattcctaatgctctcagtacctggccagcccctccttgttttctgtcacctttccatttcagattgggttaggtggtcccctttgctgcttctgatggcaccagtacttgttcctaccactgctcttctcgctgtgtcttaactcctttcttgttactaccccccactggagtgtaagctcctttgggttaggaattgaggtttaacttcagtgcttgatacagagttaaatgctgtaggataggtggtcccctaccttacctctcctttttttaaagtatacggtccagtggtttcacagagctgtacaaccattaccacaattaatttcagaacattttatcaccccaaaaagaaacgccatacccatcagcagccactccccattgtcctctatcctccttagagttgatatcatcaggccaaatcctaagttcaggtgggagagccattattcctttgctgttcccaactccacatccagcatggggagatgcaacccaggacacagtaacttgaaccaatggaaatgagctgtccttatgactagcttctgtgttttctaagggagtagaagagaactttatttctgagaataagtaggcaaagagtacaggaaggcccaggaatgaggcttcgtgggctcagatcctaacacttcaatttgttagctgtatgatttgaggaaagtcacctaatctcccaaagcctctatttctaataaaaatatagataataattcttgctttaatcccacagggtaatatatttgaaaatatttcagaaataataatgtgccatccagtgtaaggaaggggttattattttatttgttacatgactcacgagtacatgagagctcattaaaaggtgaatgatagcccgtcggtgtgtagagagacttagaaaagctgtagtcccatgccctccatttttgaagggaaaattgaggttcacagaggttaagactcattagtgactaaaccaggactggaagccgtgcaactcccagcttctgatctaggattatttccactgtgctctcctgcctcactctcccacacaaactaatttttggggttgggctttaaggtaaaaccagcgtacaacactaactagaggtggttgattggtagagatgtggaagcagagccatacttgttcaattaaaaaaagattttagaatcacagcagaatgactgaagggcaggattaaactcaacagtttgcatttttaaatctaaaatgtttatcttatcagtaaatttggctgccttcccttccccctctgcgtctccagacagaagccgattattgggtttgattttcggtattaggtgcctcttgtactattgctgaacaaccagcagagagaaggtgatcccattgacgcagatgtctcatcagccacataccatgaggtccttgaacaaccaagaccttctggttctaatattataatgcagaaaacccatagaaaggtagttagcggttccctcagtgtagcagagccatgcggtgagtcatttaaagctgcaggtaagccaaaagcaattcttttcagctttggaacatacttaaggcttctgcgcaggctcgctctcatcagatttctaacctttctaaataacaaggccatactgtgaagactgtaaactctggaagtgactaaaaatgtggtcaggcttctgccttgcacctgtcagtccttaaacctttttggaacaccagactccaggctcagcataaccatgctttcaaagctgtcactggaagacagaaagtgaagattttcttttaagagtccatctagtgtgaattcgaaattcagatatcttcttttttaactgctgtagtgtcagtaaaacacttggcagataataggttcccaggagttctcaaaataagtctgagtgattggggtaatcggctgctcctttggtccctggctttgtgacttaggaatacctcgttctcttcccctgatcccatgccctgttccaactgggccctgtaaggtgtgtgttctcccgcaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttcttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaccaagcacccgaa

SEQ ID NO: 821 - DNA, 42682 bp, Homo sapiens
tccctcaccagggccggaaagaccgacggcacgtgccggcgccggacgcccatctccatcgcagcagcccgcgcctccttgagcgagagcgttaaagcgctcagaggatgttaggacggggtgggtagaaaacctgactcttcgtgtcttctgcgttgcactgaggtggatttttacttttgtcttatttcaagcagaagttgccgccctaacttccaaatttggggactgaacatcgttcaccgaatacactttgtgatggtgaggatactttggagtccacacacattttaaaagcagtatagttttacctatccgtaaactcatcaagttcaaatgctactctgtggagtttaatttttatggttttgttaatttactttattactgcttataattatttgaactcccatcccccactgtcttttcctctaagctcccccaggcctagtattccatctacagcacagtagagttgatcattaaatagtgactaaagttgaactgattatatgaaggtgatgacttcaaaataaacatgctcaaatgaatatagtcaccagaagttaaataatatgatcataaggaaacaagtttgtttccaaaggcttacatgctttttacgtaatttttaaaagtaatgttgtttaagaattgttacaagttccattagtgacctgctaaattaggaatcttacctggaatttttttcaaataataacagcaagaacatgtggtgtttaacatgtgccaaacattgttttaaagcactttacagtattaatttattctttttattgaaaagattttgcctctaagggaactgtcaagaggcatgtgaaccggagcaactccatcttaaataggagctgagtaaaatgaggctgaaacctactgggctgcattcccaggccgttaaagcattctaagtcgcagaatgagataggaagtcggcacaagatacaggtcataaagaccttgttgataaaacaggttgcagtaaataagccggctaaatcccaccaaaaccaagatggccatgaaagagacctctggtagtccttactactatactcctatcagcgccatgacagtttacgaatgccatggcaatgtcaggaagttaccctatatggtcttaaaaggggaggcatgaataatccacctgtttagcatatcatcaagaaataaccataaaaatgggcaaccagcagcactcagggctgctttgtctatggagtagccattcttttcttcctttactttctttttttttttcctttactttcttaacaaacttgcttacactttgccctgaattctttcttgctcgagatccaagaaccctctcttggggtctggattgggacccctttcctataacagaattactgctctattattttatactttgcatacttcaccatcccacactaatgacagtaattttttaaaatgcttcctcaagccaggcactgtggctcatgccagtagtcccagctactcaggatgatcgcttgagcccagtgaggttgaggctgcagtgagccatgattgagacactgcactctagcctgggccacagtgagaccctgtctcataaaaaaaaaaaaaaaaagcttcctcagcctacttgctaccatcctatttttgtcacatacaaaaaggttaaaatcagtatgacatgtgcatggtactattttattttattttttttgtagaaacaggttcttgctatgttcccagcacttgtttccaactccgggcctcaagtgatcttccagcctcggcctcctaaagtgctgggtttacagttgtgagccaccacgcctggctatgtggtgctattttaaacacctacatattgaatggtcattcagacttacaggaaaccagatatgataaacctgaacatgagattgagtctctcttactgtaacagccattctcaaatagaatttctctccaaaataccaatgttagaatttaaattttctttgagctgacataaaactcaagtgtctaccaatagaaggctggttgaataaactatggtttatccatacaatgtaaaactatgcatgcataaaaaggaattgagaaatatctctgtacactacagaatattgagtgggaaaaggatatgtaatatgtaaatatcatttttctaagaggaatatgtgtgtatacatgtgtatacacatatatatttactaattattattttacaagtagattaacatttaaaatgactatatgggcaaggagggaagaggaggggtataaggaacaaagaagacatgactttgttttttggtgtgtgtgtgtgtgtgtgtgtgtatgtgtgtgtgtgtgtgtgtgacagagtcttactcttttgcccaggctggagtacaatggtgcaatcttggctcactgcaacctccatctcctgggttcaagcaattcttctccctcagactcctgagtaactgcgattacaggcatgcgccaccatgcctgacaaatatttatatttttagtagagacggggtttcactgtattggccaggctggtctcgaactcctgacctcaagtgatccgcccacctcagcctcccaaactgcttggattacaggcgtgagccaccacgcctggcgtgaagacatgactttgaagtcatgtaaatatgttacattataaagcaaaattctgtttttaaaaagcaatccttgaaagtaaaatgaaactaaatgaacctaaatgttttccaattgtggcatatcacccagaggagctatcccaagtgactttaaaacttaatttgtatatacttagtgggatgtattctcaggactaaagtacaaaaaaactcttttgtagactgcattccgtaaccaaattgttggtggcaatattggtattatgggatacaccaagttgaagtaattatgatggtacctttgaagctgaaatttttgacatgagatagaaatatgaaagcttaatcaggctatataaacatcctgtagttctgaatttcagttggaggcctcagtatgattaacagtatggttaatctttaaaaacacatctctcctacgtgctccattgaaaaggcctagagacaagctacccaggaggaagaagcacccccttgcgctcacactgtgatctctaccaaccatttcccattaaaagaaacactgactccatagaacaatggatgatcttgggtctggagcaggaaatgtacaagataagcctgcaacatcttacatcaggaagcagcaaagcaatcaaaaggctattagggtcatatcaaaaggactcaggatccaccttgaaaaccttcctactggccaaagataggatgatttaaaacataaataaaggtaactgtaattggatgaaggacagatacatttaagtaatcatatcagacacgaccaatcaaccaaacatgcaagccaaaaaggtatcgctgttcatttttaatgacagaaggaaaccaactcttattctgaaaactggtaaacaaagggaaagaatcaggaatatttatactgtctttcctgtatgaattatgatgcaaataacaaaataactgaagtaaattttttatggaaacattccaactactaaatgaaaaagaaatgacaatatcactccacaagctctgtgaactaatagatttaagaagtgatcatcaattatttctttatcacaactgagaaaccatcaggaattatctgtctcctgctggaagaatacacttccacctaatgaagtatttttgttgaaaaataattgcctttagatttaaacacaggaggcggaacacactaacaaaaggtaagaaatcaacatccagatggagggaaactataggacaaatgacctagttttttctacaaataagaaacttcatcgaaattgcaagaattaagaaaaagagagacagagatggaagaatgcatggcttaaaaaatttgagacaaatccaacaaattacaatgagtaaattgctaacaatatcagcagaatgtagtatactggttctctcatccaactgttagaccataattaaaaggtgttgacatttttaatgaataaattttggctgtaactgatctatatgcttatgattttacagaaaagcagtaggaaaagtagcaccatataattaattattgaaatcatagactctggagccaaactgcacaaattagaatcccagctttgccacttacttgccatatgaccttgagcaatttacttaatctttatttttaaaaatgggggtgataatggcatccattttaaaaggttgacttgatgataaagtgtgggtacacacttccttttccaaaatccttgggtccctgtgtgtgtctgaactttaaaaaatagaatagatatgcccatcgtttaacttaatacccccccccccccactgagtcctgggtgagtaccccataatctcacacagtatttctgcagcaaaatgtatgagtattcacaccaaatgagttaaagactatacatagccctatgtcagtgcagtgcaggctttaccaccgaagtagatttaacagcaaatgtattaaaatatgtatggtttttagagctttgtggatttcagaacaatgattatgggattataatcctacataagtgaattccttacacagtgtttggaacaaaataagactatgtttcccaaaaaaagaaaaaagaagaaaagactatatttcctattaccaacctgaccacagatttttgaacaacgtatatttttaaaaattaagattgtaattttaaaacagacaaatcagcatggcattttataaaaatggaaggaatacctctatctaccatgctgtgcctatacctgtaaaagcaagaagaatgtttaatattaaacaaacagaaaaacctgccattacgttcttgtttaatgttatttgcgattctaaatattaaatttaggctacttgggagtagggcagtgtggggaattccagacagttctaagagtaaattctctttaccgtatttgtgaattattgaagcattttgagtttttttgttttgttttgagaaaaggtatttaagtactaaggagaaatacatttcatttccagtctgtcttacaaaaagatcttaatttgctaaaaggtaaaatgcgtatgtataaaggcaacagattaaaagtactttaaaggttacagagcttaatccaagcaatatgaactcagaaatagaggataacttattttaactgttgttattacttgaatacagaaacataagacttttagaagaatgtcttgatattgcttaagattaaaaactgacacaaactatccttacagtagttaccagctagttataagtaaattcttagcactgtgttttccgaaaacatatcttcattagaagataatgaacttagggccgggcgcagtggcttatgcctataatcccagcactttgggaggccaaggtgggcaggtcacttgagttcgaaaccagcctggccaacatggtgaaacccatctctactaaaaatacaaaaattagccggatgtgctggtgcgcacctgtaatcccagctacttgggaggctaaggcaggaggatcacttgaacctgggaggcagaggctgcagtaagctgagatcacaccactgcactccagcccaggcaacagagtgagactctgtcaaaaaaaaaaaaaaaaactacacttaatactaataatgtaacttatagaaaattagggcttcattttcttaaaatattaatctcaaatgtaaacaagttatattttcataaaacaatattcattcttcactcattactattgaccactataaattttgttaaaaatgaaatacactattactattttaaaatctttattcaatcagatccatgcttatttacattacctttcatttagaattaaaatatatcaatctgtagtttaaatcatactttcagccctttacaaaatatgtgattaaagttttcatggtttaaaatggacctagaatatggaaaattggattcactttaatgaaaatgaaaaattttgatacactagaacataaatgtatacgtactaaacatacagtattaaaacaagataaaacatctacagttttcttttttcttctattttctaaatattataaatcatatacttttaataagcattcaaataaaactctcaataaatgccaactgaagagatggagaaaaaaaatttcctgaacattcttttcacttacttcactacaaacttcatgtttcctaggtcagaagttatccacatttagaatatcttaagtcacaacatagatatatttggtacattccacatgctaaacactgtacaactggcaattctcaaaaaataggtaaaagaaatgtaagaaatggtagactcagtttagcctcccaagaattggaaggacatctacagtctgtgcttaattgtctataaatgaccaaacaaccttccctttgtttactcatttttttatattcttgaaaatgttatttgcagcttttttctttcaagaatggaaacatctaattgcaaatcattttcctatccattaaaatataaatattattttgcaagaatatgggtagagatgttttaatgacaaacagcaaagtatagcaacgaatattcaataggtattctgccacctactggagtttttcaagaaactgtttaagttcactttaacttacagaagtattgagagatccaagtgtttaacaatcaaaatatgatcagtttgagtatcagctatttatttgtagataaagagtaatatatggtaatatgtaactagaaactatgtaactagaaattgttaatacggataaaaaaagaatgtttaattttataaaattgaaaagtttaggaatgagttttattgcaatcttttctctgcaaatgaagtttttttctactagtggatattttaaagggactattttataattccaaaacgtctagtttcaaatgcttcagagaattttgtaacttaagtttcatatagagtagtctccccttatccacgattttgctttctgtggtttcggttactcacggtcaaccacagtctgattacaggtgagtacagtacaataagatattttgagagaaagagacagacatatcacatttacatcacttttattacagtgcactgttataattgttctatttgcagttattgtttatctcttgctgtccctgatttataaatagaactttatcataggtatatatgtataggaaaaaacagtgtatagaggtgtctatactatccatggtttcagacgttcactgggggtcttggaacgtatgtcccatgggtaagagggaactactatattttctaattctatacatttcttattgcttatctgtcctgtcattctgcccttgaatattacacacacaaaaaaatcaagctgacaaaaagctattagactactttttactactaaaatgaagaaaattaattttatgaatctggctcacactgaaagaatatttattaacactaccaatcagagatccaatgacagaaacactgtctggaatacaaaaagaacaaaaaatgaggtcatttgaattgccctgaaaaactccaaattcttcaagatggtgtacttgtatctatattctgaagtactagtgttttaattttaactaaaaattaaataagagtttgtttttttttttttgagacggagtctttctctgtcacccatgctggagtgcagtggcacaatcttggctcattgtaacctccacctcccaggttcaagcaatgctcctgcctcagcctcccgagtagctaggattacaggcgcacaccaccacgccaggctaatttttgtatttttagtagagatggggtttcaccaaactgctggccatgctggtcttgaactcctgacatcaggtgatatgcccgccttggcctcccaaagtgctgggattacaggcatgagccacagcacctggccgtaaatgagagtttttatgtgcaagtaaaggcagttaaataactttcagtaataaaatgcatcacaatatttcacaggtttaaaacacaacctggttacctttttgaataaaataacatttggaagaaggcatagctacttttaaaagctattctatgctttccttgtgtttgaaatttcaagaaaaaataaaatgataaatcacaaaattaaaaatgccaaattcaagttaattcctataattcttccattttgttatgaatattctgtaatatcaaacattcatttttaatgtgctaaaaatatgggtttacaaaatatgaacaggtaatttttaaagagtaaattatgttaagaactttattattttcgattcattttatagggtagtaaaataatacttcttcaaaatcatttaaatgttattgatgccattgcaaaatcattataaataaattttctccattatccaatcacatctagataacattgaatatgtacaggtttctctggataggtaccaaaaggtaccacattttatacagacttaattgtgaaagctgggtgaaataaattttcagatcaaaattttttttaagtttaaatcattcactctttaaatttcagacagtgtcagtgtgactcttacttttaaaggaaaaaaattagtttaaaatttaatagccacagatttaataattttttactttaacacttaatgtacattttcatgagcagtaattaagatatgttgaaattttaaatgtgaaagatttcaaagtttcagtatgttaacattactcttcaaatgttcttaatatatatataaacacttacaaattatagatacaactagttgtatatctacaatacatatatgaacaccattcttcttctctagccatatttatatgaggataaagtaataaatctctgtgctattcaaggaaaaaaaatgaatgctttaaaaaataaatctttaaagaatagtttcaaaaataaagttcaaatattgcacaaaataatttaactgtaaatattactacatagtgtaaaacaattttaaaaaaatttttacactctacagtaaatcccactttctaattctataaaagaatttattggaagtccacattaaatgtttagatattaaatgcttacattcagtttgatgggaattcaattttcacaagttaactgagactttgtcttaaaagttcatctatttgagttttgtacatattttttacatcttcgagatctaatcgaagttcttctgcctcttctgctttttctccatacatctgcagaatagtgttgtacctttgatccaaatcctgaaaaatgtatttgtttacaatttttaaaataactacacagaacatctttaatatttatattgccataggagtcaacaatgaaaacactacaatttaaataaaagtatatactcatctcttttaaaaattaaactcacacttcagtctatgttgaactaaatagcaaaaaaaggaattaaagaaaaaaaccaagctagatggctatcaattttaccctatctctccactaaatctacaattctccccatatatgacttctctcccattaatgtaagcacacttgatataaaatttagtctctttgttccatggtggtataagtattacccggcatttagcccacaccacaggaaagatcaaaagaaaacatattctcacttatggcttaacagtgtcttctaacatccagatgagacaattgtgatgatacatataacaacaatcaacaaaatattactaagatcatacaaagttcaatgttataaatgaagtgtagccaaatgaaatctagttcttttcctatactgggactaaacatgattgtgaaaattactttgaatatgtaaagatacaagcaagataaaagattcatttttaaacttctttgctcaaatattagtactctttaattttcaaataaatcactaacacatactataaattaaaaacatgagatttaaagtaaatgaactaaaatatcttagactcatccttaggtgaagaatacttactcttagctgagttctaagtttgggtatctccttcaccttctcttcaagttcatcattttgatttgttaatttaactagttcttcagccattattgatcgagttttttctagattgccaatttctagctgagaagcattaccacaaaatagtttaaatcaaaacatatcttttttaatactcccagtaatataaaaatatttaatgtgtgtgtggttttttttttttttttgaaatagacatgtcaacatataaccttgagctagctctttcttaagtaaaggaaacagtggcagaaaaacggtcccaactttcctgagaggtataccgtttataaggtttactgtgcaacagagataaatccaattatttgtttgaaaacattcaaccatatatttttctaatctaaggaaatgacatatatttcagttattctaaattactacaagaacccagagaaataaaaatatactttaacgtagccccacctgtgtaggttgtatcgacagaggctttcatcactaccaaagaaattaattaggtccctgtatagcataccagctatacaaacatctgggattcagattagtctgatctactttttgccaattcaagttctttaatattttcatataactaaaagtatataatgggagttgaatttttacctacttctgagtgtattgtgtttaacactgaaaagaggtatcctgattcaaaatgcttgagaccaggaatgtttcaaatttctttttttttttttttttttttcagattatggaataattgcattatgtacttactggttgagcatcccaaatctggaaatccaaaatgctcaattgagcttttcctttgagcagcatgtcagcactcaaagttttggatttgggggcatttcagatttcagagctgggatgctcaaacctgtaaaacatttcaatatttctgactgcataaagttttttaaaagccaaaaaggtaagatggaaggatgctccatcaacaactcatgttgtttcctcccatgtacagggtgttacagttcaaacatctcatcccctttacccctccttcccggggtagctggaacaacttatctaagaggtaaatctgaatagaacaggcattcacagctcagtgacttccctttattctgttgggaaagagctgcttgaaaggaggagggattctctgctcctagatgcttatgtcttatgtaggcaggttgtaaaacatgggaggcctgctccagcccagcatttcctgtgacagatcagccgaatatgcctaattctggcaattagcaggttcagttggctgttatccttagctaatttctctttttagcctttatcattgatatatgtgatacattttgggcttcacatgccactatgtcatcttgtttctcaatttgctcagaattcagatggaaatgaagggtgctatttattaggcctcaaaacttcatttacttctatagcaaatttaatttttccaatacctgtaaatgagtgatttccccttcccttagctttagctgagactgtaggttttcaattatgcttgatcctgctcccatccttacagcatcataaagattgcttccatttgctgatataggcattggtccaaatgagtgatcatgagactcatcctatgttaattaagaaagttcacacagttactcagttatcatagcttgtcttccattaccaggttcgaacaaaaatggttctgtcaatttttgctttaaatgtcttctcaaaggcagaaaatcattcacgtgtttcctctcactaaaattagcactcctccacaagtattcagatgaattacccatagaatggcaaggtcatgatgacagacaatattgccatttgcatatttcctttattattattctaagaactaagcacatataaaaaataaaacatcacctgagacagaaaagatgtctgtagtcctgccatatcaacaccacttattgaacttgagcgtgacatggtgggagtgctagaaacagaaaatggcttgcgttccttagggagtaaaaaaaattctgttcatattaaagagcaaagagataagcagagaaagcaagaacatttcctagggttaatgagaacaaagattcagtcttttaaaaaagccacactacaaaggaattcaatacaatcaaaagaagaaaaaaaacttttttaagattcattctaatttccccataaaatggcttcttaagtcaaaaatacaatatttggccaggcatggtggcttatgcctgtaatcccagcactttgggaggccaaggagggtggatcacctgaggttgggagatcaagaccaacttgactaacatggaaaaacctcgtctctactaaaaatacaaaattagctgggcgtggtggcgcatgcctgtaatcccagctactcgggaggctgaggcagaatcgcttgaacctgggaggtgaggttgcggtgagccgagatagcggtggaggtggcggtgagctgagatagcaccactacactccagcctgggcaataagagtaaaactcagtctccaaaacaaacaaacaaaaaaaaagtacaatatttactaattaaaactgtagctagacttggttagatcatcacagaacccatttattacaacaatgtaatttgttgggtttttataatagaataagaatgtttctgttaagcttcatattatacaatatactatcaattaaacctatttctgtaacataaaattactaatgagtgttacaaatcataaaatttctggcttatccattttatttttaatgtattcttaaaattccaaataaattcaataggtaatttaaatttacctatcggtagtttaaatatattatgctaactccaagtacacggtaattctttcaatacagaaaactcatttttatttatttatttatttttatttttttgagaaagagtctcgatctgttgcccaggctggaatgcagtgatgcgatctcggctcactgcagcctccgcctcccgggttcaagcaattctcccacctctgcctcccgagtagctgggattacaggcacatgccaccatgcccggctaatttttgtatttttagtagagatggggttttgccatgttggccaggctggtcttgaactcttagcctcaagtgatccacctacctcagcctctcaaagtgctgggattacagatgtgagtccccatgctcagcctcagaaaactcatttcagaaaaattaccctcattaaccagaaagaaaacaagccagacttactccttaagtgcctatagaccaaatgatgtgcactggtttcagtgacagacaattaaattcatttttaaaaagggcaagaggttttatatttcaagtcctagaaatcatagatctctttggataaactcaaaattactttgggtccactctgagcaggacactgattataatactagaattcatcactatgttgattttagacattaaaaaaatgatacttataaagcagggatgtccaatcttttggttccctgggcctcatttgaagaacaagaattgtcttgggccacacataaaatatactaacaatagctgatgaactaaaaaaaaaaaaaaaaatcatgaaaaaaatctcatgatgatttaagaaagtttgcaaatttgtgttgggcttcattcaaaatcatcctgggccacatgccaaccagggccacaggttggacaagcttgttataaagcatagctaaaattaaaaagcaatgattaatcacagcatctactaaatggttacaccacaaacaaacaaaaacaaaattcaataccttttcttttattgtttcttgagtaaaaatggctttcttcctttcttgttcaactttcattctttccatttctaactgactattcaacaatgtctaatagagagaaataaagttagacaatttctgtgatagtaattcatgccatgataagtcaatctcaaagttagaagcataaagtataaactcatatttgttttcctactaaagaccaagttccaaaagcagtggcatcacccatttcatcttgttatctcattaatttgctgccatccccaaccattctctaatgtatgccctaagagctgagtggtcacgaagagaaataccttttctttcctcgtctcttcaagtgttcttacatattcatcttttaggttttccaattcaacctggtacctattaaacaaggcagaatttaaaaaaacagaaaatgaaaaagatgctagtatagactattaaaaactcagtactttattaactccagctacatattgagaaatcatttttattaccagcttgacatcagtgattttccaacagtgtgttccagatcccatctgagtttcactcagaaaccaaaccaaaagtgaaaaagctccacttctgtgcattttatttattggtgctctgggttaagatttcatttaaaaagagactttataaaaataattttgagtaccatcatcctataatatgctcagattccacaaagcttattagggagttctatgaaaatgtttctaaaagttcagatattttactttagaaatcatttttacttgacatttttttaaaaagtaaaatttccaaggaagaacagagggttaaaaaatactaaccattgccttaatataatctcagatagatggattttacaccccatggtttccaagaacccagaaatttatttagaaaagacttaaattatactactaaaatccttgtaatataaaagtaactccaaagagtagtctcaaaactattttgtggtgttataggcccctttaaaaaatctgattaaaggtacaaatcctttccctggaaaaaaaaataaatacaaaacatgccacacaatctcaacaatctacatgacaatgaatcccagtactatcttcttgttataatatcctattactttatttatttttttttttttggagacggagtctcgctctgctgcccgggctggggtgcaatggtgcaatctcactgcaacctctgcctcccaggttcaagcaattctcctgcctcagcctcccgagtagctggaattacaggcgtctgccaccatgcctggctaatttttgtatttttagtagacacagggtttcaccatgttggccaggctggtcttgaactcctaacctcaggtgatccacctgcctcagcctcccaaagtgctggataacaggcatgagccacagcacccggccataatatcctattactaataaccctaactttaaatgctaaaagtgattacatttagttcttggtaccctgaagctaaaagccaacgacatactttgtttatttacttatttaatttatttttttttttttgagaccgagtctcactctgtcacccaggctggagtgcagtggtgggatcttggctcactgcaacttccgcctcccgggtgtaagcgattctcatgcctcagcctccgagctgctgggattacaggcgcacaccatcacacctggctaattttatttttaggagagagtaggtttcgccatgttggccaggctggtctccacctcctgacctcaagtgatccgcccgccttggcctcccaatgtgctgggattacaggcgtgagccacggcgcccggcccaacaacatacttttaaaaagtgctttaggatgtcacggaactaccaaaaatatcactcagaaaccatgctcacctattgttctcatcctccagtttacacagcctatttttctctgattctagctgggcttgaaatctactgttttcctgtcttaaaagagaattctgtgactccatggaagacatctgaattttgttagcaaggagttcttctgtagctgcacgttctctctcaactgctgctgccagcaaggtctgggattcacctgattacaggacagaaaaaaaaatcacatacacatacagcccagagaccaaaataccaagtcaattctgatttcaaacatttaatgatgcaagtagccacacttaaaactgataactatttattgcctaaggcaggactgtctactgagacaaatgaaccaatcttaacttatacctgctttatcactcttttccaaaagtattttaatttcaaaatggagtcatgcattaaaagagtagtggatcaccaacaccaaatggtcctggagcaactggacagctatatgcaaaaaaaccaaaaagcctacacatcacatcattcacgaaaattaactcaaaatggatcatagacttatatgtaaaacatgaaactataaaacttttaggaaaaaacagaggagaaagtcttcaggatctagaacaaggcagatttgacacaaaaagcaagagccatagaaagaaaaactgacaaactgcttcaaaattttcaacttttaaatctatgtgaagaggatgaaaaggcaaactacagagtgagagcaaataaatgcaaaccatatatctaggattagtatcaggaatatataacaatctagttagaaaatgggtaaacgacatagacagaaatttcaccatagagaatgtacaaatggaaaataaggacataaaatgatgttcaataacattagccattagggaaaaaatacaaattaaaatcataatgagatatcactacatgctgtctgagtaactaaaagaaaaaacagggacgacataaaatgttggcaagggtgtgaagaaaccacattactcttacacagccactttgtaaacagtttggcattttcttaaaaacactaaacatgacctggcaattgcacacttgggcatttatctagagaaatgaaaacttaggttcacactaaaacctgtacatgaatattcacagtagctttatctgtaatagccagagcttggaatcagcctggacgtcccttgtgcagtgaatggttaaatatacgtggtacatactatggaataacactcagcaataaaaagactaaactaccgatacaaaaacaactgtgtgaacctcttcctgggaattacactgagtgaaaaaagccaaacccaaaatgtcatacactgtataattttatttatgtaacatttttgaaatgacagaattttagaaacagaggacagattagtgattgccagagatttgggacaagggaggaagggttgagagagtggtaggtgtgtttccaaaagggtaacattaagagtgattattttcagctaagaaaaaaagaaaaaaagctaacaggaaggactcaatagtgttggaactgttcaatatcttgactatggtaatggatatgtggtatagttgtttagaacttaatacacacacacacacacacatacacaaatgagtaccaataaaactttggaaatctgaataaaatcagtagattgtatcaatgtcaataccatggttgtgatattatacattaattttgtaagattttaatacttggagatattaggcaatgtgtacaaaggacctttctatattatttcttataactgcacatgaatctacattatatcaacaaaaattttcaattgaaaaaaagagcaatgggtaagattctgagatttaacctaggtaagaattcttgtattttttctccaccaaagtagagctagtaatacctctatttcacattttacactctgctccacagcatagctatggtctttttaatagcattccttggtatgtttgtcctgtggctttgcctatatgctagcacaataccacatattgctgagggtatgtagacttcagtctaaaaaccacaaaagtaccagtttctagcattcatttattgctaaatatttatttcaaaagatatcattttcagatgtctcatatttcacagcacattgctctcaaaagctgtcagagataaacgacagacctaacatttatacctataaatttaaatatatatgaaggtttatctaattcagttcatttttttaagtaaatgaatctttttctagaccaaatctttcatggaactccaattaaaaaaagatagacaaaggaggccctattttcattaaagcagctagagaagcccagcctcttatttatcaagcttccctctcaccatgacagcagccccaaaggtatctaagagtccactgaatactatttgaaagtcactaatctagttcacccccccgattcacaaggaatagcacagagatagttggaacaatataagtgacttgttccacactgttttgctggatgattcaaaacagaataccctgagtccatgtctcctgactcatatttaggtctgattttatcactacactgtgatttctcaaattacatttagtgtcaggcgtagaaggcatacatgaatttttcatgaatttgctagcttctgggatacctataatatacatacactagctgtctgtgcttgaagggaaacattttagaataatacttttctttttattaacatcacagaagggcaacctggggcatgactgtaaagaagcagaatatggaatctttttttttttttttgagatgcagtctcgctctgtcacccaggctggagtgctgtagcgcaatctcagctcactgcagcctctgcttcccaggttcaagggattctttgcctcagcctcccaaatagctgggattacaggcatgcgccatgacacccagctgatttttgtatttttggtagagacgggggtctcatcatgttggccaggctggtcttgaactcctggcgtcaagtgatccacccgcctaggcctcccaaagtgctaggattacaggtgtgagccaccgcgccctgccagaatatggaatcttaagactccctagtatgtctcttctaaggtcgatcttgactctccttagacctattttcgctcttggaattctaccagtgatgagaatcatatatgatctctacctcctacactactgcagacaagctacaaaggggtcagatttagcaatggacaagaaaaaaaaatcgagtgcagcagtctactaaaaatacaaaaaattagccaggcatggtggcagacgcctgtaatcccagctactcaggaggctgaggcaggagaattgtgtgaacctgggaggcggagcttgcagtgagccgagatcgcgccactgcactccagcctcagtgaaagagtgagactccatctcaaaaaaaaaaaaaaaaaaagaactgaatgaaagaatgacatggaagtactttagccagtatctgataccattgtgtaatgggaaaaaatggtttgaaagagacataataaaggtattaaaaatacatgtagaaaaagagaaaatgtaaaaatctacatattagacacaaaatgtaactatcagatcaaatgaatttcaatttcataccattattctaattctataaacaagatggaagagcttctgcatcgagcataaaaactaaagcagttaccaagcctatcagaaagattcttctctaatttctcccacgacgatgtctgggatcccagggttgcttgcaaattttctatttgtcgaagcaatggtcttgttgttgatgaaacactttgactcagttcctggtttcgattctctgcttcctggagtctctgaatcatgaaattctgaagtcattaccaatgacagcaataaaaacattaaaaacactagcaaacctgaactttgagaggttcctggaaaattatttttccaagagaaaataatttgctttttaattattattattaattttagaaacggggtcccgctctgtcacccaggctggagtgcagtggcacaatcgtggctcactgtagcctcaacctcctaggctcaagcgatcctcccagctgggactacaggtacacgccaccacacctggctaatttttgtatttttttgtagagacgaggtttcatcatgttgctcaggctggcctcgaactcctgagcaggcaatctgactgcctcagcctcccaaagcattgggattataggcatgaaccaccatgcccagcccttaattatttttctaactgttcaatccttccaagagagttagattgtgtaatacagtatctaaataagtacttctttggccaggcacggtggctcatgtgtgtaatcccagcactttgggaggctgaggtgggtggatcacctgaagtcaggagttcaagaccagcctggccaacatggtgaaacctcatctctactaaaaatacaaaaattagctgggcatggtggtgcacgcctgtaatcccagctacttgggaggctgaggcaggagaatcgcttgaacccaggaggcagagggtgcagtgagccaagattgtgccactgcactcctgcctgggcaacagagcaagactctgtctcaaaataaagaaattaaataaataaataaataagtgcttctttaaaaagcgtttctaagatagtcttcaattacctgaaggttaaaaaagagttcatccaaacctcttagtagttacctcctcatccaaatatttctaagtatttataaaaactgaaaaatcaacctaaattgtattttctctcccttttcctctgcatgttataaatgactgaaaattaacagaggcatagaaaccgggaactattacctgtcccacagtaatcaaagactgacaatcattaataagcgattacaaatggaaaagcaatactgaatacatataacaaatctatcataacattattttctataaaacaaaataaggaatttccttgtataatttttaaggtgcccactctgatttattcacacaagccacaaaaattcagcaaatgctaggtgtgacagtaatcctctcaattccatgaacactatcccactgaggaattcttttatttctagaaaaacacatacttcttggatttgtgttttggaaacctgtgacagtacctgctgaagttcaccgatctcatggcgtaaataatcctcctttctggcagccgcttgttctgtacgctgcaatgcaagcctaaggtcccccacctgtaggaggagaaacaatacattcacaaacaatggtacagtattatctataacttcccactaactacatattttgtgttgtgtcaacattgttcatgtatactatttcatactctccaatgaacttttacatatgattatcacatctctcattcatcaagcaattctaaaactgtatgtatattcaatgtttacttagaaaagcattctgttaaggcaaagaaacgcaaacaaatatgtataaggcatagccattaccatacaatattggagaaaagacagtgcgtctataaatatttgccacatcacacagaaagtgataggtgctatacggattataaaagctgggggctccactcatatgcaggagcatacattataaactaccatagcctttttggaaaacgttataatatgtttaaagaatcatcaaacttctcacatcctttcaccgggccatcctagtcttgggaattcactctaagaaagcagatacgtaaatacacagggatattccctacagtattaaataggctagcaaaaacaaaactggaaatattctaaatctccatcactagtaatctatagttgcaaatgtcgatacaacatgaatataaccattaaaaattacaataaatgtataaaacatgtaaaaaaaatttctaatatactattaaatggaaaaactataaaataacacgtaagacatcaattatgaaaaacacatatatgggaatagaatgaaacactaacacacaaaactgacagtacttggaaaaagtgatggatttatgcatggtaactcatatatgctctatctcccattcccccaatttttctgtattattattattctaacgtattttaaatttaaattactgatattttatctatcccagcagaaacacaaaggatatatggaccatggcatgacttataatagcaaaatactgaaaataacccaaatatccatcaataagaaatagctgaaaatacttcacctaataaagtattataaaactgtaaagagatattttttaaaaacctctatgttttactagagtgatcatcaggatattttactaagtaaataaaacaagttataaaacagtataaacaataaactatcatttacgtaaaaaggatgtaggagatagaaataggtgtataatctatcaataagaaagagctgaaaatccttcacctaatgaagtattataaaactgtaaaaagatattttttaaaaacctctatgttttactagagtgatcatcaggatattttactaagaaaataaaacaagttataaaacagtgtgaataataaactgtcatttatgtaaaaaggatgtaggagacagaaataggtgtataagcgaatgtgtatgtacgcagaacatgtaagtatatagatacatatattttcttgcattttgccaatagaaacactgaaaagataagccaaactctaataaaatggttacctacaggcaaagagaggaaatggggagcagctaaattggaagtaaatgtctgaatagattttgctctcactttggaatcatgtaaatgttttacacatacaaaacttaaaattaaatcaaaagggcataggagtcaataaaaatagttttctcaacaactggtcctgcaacaactggatatccacatgcaaaagacctaaatgtgagagctaagactacaaaactcttagaagaaaactgatgaagatctgcataaacttggattaagcaatggtttcttaaatatgatgccaaaagcacaaataacaaaagaaaacatagataagctagactttgttaaaattaaaaccttttggcatcaaaggacactatcaagaaaaagaaagacaacccacagagaggcacaaaatattgacaaatcctatatctgataaaggtctagtatgcagattatacaaagaactcataataacaataaaaagacaaaccgcccaatttaaaaatgtgcaaaggatttgaatattttaattaatttctcccaagaagatacataaatggccaataagcaaatgaaaagacatccaacatcattagtcattaagagaatgcaaatcagccgggcgtagtggctcacgcctgtaatccccgcactttgggaggccaaggcaggcggatcacgaggtcaggagattgagaccatcctggctaacacgctgaaaccccatgtctactaaaaatacaaaaaaaaattagcagggtggccgggcatggtggctcatgcctgtaatccaagcactttgggaggcggaggcgggtggatcaccagaggtcaggagttcaacaccagcctggccaacatggtgaagcctcgtctctactaaaaaaaaacaaaaattagccgggcatggtggtgggcacctgtaatcccagctactcgggaggctgaagcaggagaatcacttgcacctgggaggtggaggttgcaatgagccgagattgcgctattgcactccagcctgggcaacaagagcgaaactctgtctcacaaaaaaagaaaattagccaggcatggtagcacctgcctgtagtcccagctactcaggaggctgaggcagaagaattgcttgaatccgggaggcagaggttgcagtgagctgagatcgtgccactgtgctccagtctggcaagagtgagactctgtctcaaaaaatatatataaattgaaaaaaaaaaatgcaaatcaacaccatactcagttaccacttcacacacactaaaaaggctatacttttaaaaacagacaataataaatcttggcaaggatgtggagaaactgaaaccctcacctattgctggtgggaatgtaaagtaatgcagccactgtggaaaagtttgccagttcctcaaaaagttaaatatatagagttaccatatgacctaaggatatatatctaggagaatttaaaatatatgttcacacaaaaatttgtgcatggatatttaaagcagcattattgataataaccacaaagtataaataacccatatgcccatcaactgatgatttgataagacaaagcctcacaaattttgtttttcctacttcatctgaggtccttggactcccacagatgttatgaatgagctcaggagttaaatggattctctcaaaattatatgcaatatgtatgtgcatttttgctcttctcttctaagagggttcctagcttttataatactctcaaatgggtctaaaactcaaaaaaattaaacaatactggtatcacgtaagcattactttaacagttttaaaaaacacaactggttaaatttagcagaatccagtactctgaaatctaacacatgtatcactacattgtttgattcaaaccagctaattgtttaatttgtagaagcataaacaaatatttttaaaactactctaattcatcatccattgcttacttgaatggctaatgtttcttgctgctgacgggcttcttcttgggccttctctaatgctgcagaaagttcttctttagctttcatttcacggctcagagcagcttcctgtgcctcactatcctttgcagcattggctttgtgaagatcagtaagttctcttaaaaaattagattgagtttataaatgttgccagtgatcagataatagaaaaagtatttcttcaacatcctactctgataattcattctaaatgggttgcatatttgttcattttcttacttgtatgcactatccagggcagcctgaatacttcggttcttttcttcaagttcatccatgtctacctgaagacggccaagatctttctcttggcgttctaccatggaatttagttttttaatattttctctatgttgtttctcaacctcttctttgccatcaaggacctatatgttataaaaacagacaaaagtatttttcaagaaataataccatggtaaataactgtattccaggaatctataataatggagaaaaatatatatttttttgagacaaagtctcgctctattgcccagggtggaatgttctggctcactgcaacctctgcctcccagcttcaggcaattttcgtgccttagcctcccaagtagctgggactacagatgtgcaccaccacgcccggctaatttttgtattaggttggtgcagtatttttagcagagacagggtttcgccttgttgaccgggctgatctcaaactcctggcctcaagtgatctgcctgtcgcagcctccgaaagtgttgggattacaggcgtgagccaccccactcggctaaaaaatcttatcatttatctattgtttgaaaaatccttcttacatgatataccccattaaatcttttcaaatgctccataaccatggccaactgttcatacaggaagtaataacaatatatatgtagagaattatgattgctattcacctgtttcaaatgctgcaactcctcttctagctctttaacttttttgttcagctttgcaaccatattttcattctccttgtctttagctcttaatttcttgatgatgttagaattgtgcagctgctgttttgaaagtttttctcctggtgatggtaaagaagtataaactcaaatgataactattccctaaaaatctcaatagaatgttttatctaatagtaacataaaagaacagaatttttttaaattacaattttgtaacccacaatgttacaactaatttggacagcaatcatcaatgaatgttaaaattattgggtaaaaggttgttgggaactggatattgacacggtcttaaagaatcactctcatatatcacctactaattttaaagagaaaaatctggcagtcaactccttaactaagcattcagttttggcatcaccaattgtagtacagcctgacaatatgtgtctgctgatgtgatatagttgttcaatatcacccagatatttcctactagaaatatgaactaaatctaatttaaatctcatcatgaagaaagtaacaaattcccgaacatgggtgggacatcctgtgggacaactgccctagactctacagagtcctcaaagacataaagaagagagaactgtcctagactgatggaagactaaaaggacataacaatcaaatgcaatgggcaaactttggatcctggggcagaacaaatgatcaattataacagacacttttagagacaactaggattaatattaaaatatatgctggattacacttctgaattaatgctgatttcttaggtttgactatgatgtacctgtcaaggaaaacgtacttgcccttgggagatgtagactgaagaatttaggagcagaatgttacggtatttgtaacctcctttcaaatgagttgacaaaagggtagtgtatgtatgtgcagaaagatatggaagagttgtggcaagatgttaacacctgatgaatctaggtgatgaagtaatcaggtattcattgtagtgtgctttcagctttgagttttacagctctttagctttaagttttaaaaatactggccgggtgcagtggctcacgcctgtaatcccagcacttttgggaagcaggcggatcaccagaggtcaggagttcaagaccagcctggccaacatggtgaaaccccatctctactaaaaatacaaaaactagctaggcgtggtggcaggtagctatagtctcagctattcgggaggctgaggcaggagaattgcttgaacctgggaggcggaggttgcagtgagccgggatcatgccactgtactccagcctggacaacacagtgagactctgtttcaaaaaaaaaaaaaaaatttttctggggcacgcggaaacaatatataatacccttttgtgaaatgtaaatactctgtgaatataaaatactcccatgtgaaattgctctattttctctgtaaaaaggttcattaagcaaaagaagacatcagttcattctctgacaaaattattaaattacaaaataataacattcgatattaatatttcaaataactcttttaaaataagaaaaccatgcagttagccttcccctcagtctctgatattgtaaggcaaggcagttaatgacttcaagacatcttgagaaaataattataacaacagttccttcatttttctattttagtgcttagaattgtgttttatcattatctgtgttcctatatttccctctcactgaactaagcccctaaaggacagagtgtcatacttattattgtatcaaacatagtatctgacatactaaccgttcaataaatattagttgaataaatgaaaaagttggataaagctaactttcaaatgaaatgactgcttccaactgttctcaaacgctaccctttctctggaaatttacttaagttcagtgatttaagcacaaaaacattcatcctaccactaactatattattaacattataaaaataaatgtacaacactagaaatagtaaaacatattatggtatacccatataatggactttaatacagccactaataatgataaaaagcatttaatggcatagagagatgtaagagaaggaagattggaaattaaatatatgatcttaaatatgtttaaaaatgcattaaaaaatacattaaaactagaaaaaattaatagttccttataatattggattataatctacttttcctctttattcatatactttcctataacttcaaaactttctacaagtagcaagtattactcttataactacaaaaactttaattaacaagagaaataaaaagagagattcacttgaccacgttttccaaaggctcctctctcccaggatattacatgaagaaattaattcagtatccatttgtaatgatttatttcatgaatagatctttaatttctgtaatgctattaattttattttatttatttatttttttgagacaaagtctcactctgtcgcccaggctgcagtacagtggcgtgatcttggctcactgcaacctccacctcccaggctcaagcaatcctcctgcctcagcctcctgagtagctgggattagaggcacgcaccaccaccacccggctaatttttgtatttttagtagagacggggtttcaccatgttggccaggcttgtctcgaactcctgaccttaaatgatccacccacctctgcctccccaagtgctgagattacagtcataagccaccacactcagccaaccctgtttattttaaatcttttcagagacaaaagtgcttaataatttaaaaattaatacaatgaaaaattcactatcaaatgtcagaaaaagacaatatcatacagtacttaagctaggtattcagatattacataaatcccagagttacacactttgaatgtcttggtttaaatgacaggctcttaagacctgtttaaagttttcttagggcagcacaaatttctgtctattttacagggacttacttttctttttacttccaaaaaacaaaagctagaaacacgtatctctgtctcaatatatcttattcctcattcttccataaactgtcacctatttctatggtttacgtccaaaccctccttgctttcagtatttttaattaggaagcatcagctagttatgtggcaagtacttttcctgttcttacagtatttttcatagtcaaccaaatactatacgcaccttcttccattaaccctcggatctgctcatctttctctttcaaaaggtctgcagtttcactactatttaatctagtggcaagttcttcttttatgtttttgatttcctaataaaaaagaaatctgtgaataccgtaaagaatgactttcactctaagtacagttctcatttctcccccatccaaagaagctgtccataatcacatttgcaataagaatctgtaagttttgttcagttaatctactaccttggttaactaagactaagaaaacaactttgaaaatgatattcaaaacctaaattcagatatacaagcaagtgttaatatgaaaatataaatgagaataaattaactttccttttcatttttatttttattttttgagacagggtcttactctgtcacccaggctggagtagtggtacaatgacgactcaccacagcctcaacctcccaggctcaggtgatcctcccacctcagcttcccgagtagttgggaccacacgcatgtaccaccatggccagctaatctttgtattttttgtagagatgaggtctcgccatgttgcccaggctggtcttgaactcctgggctcaagcgatccaccctcttcggcctcctgagtagctgtgaccacaggcgcacaccagcatgaccagctaactttatgtattttttagtagaggcagggtctcaccatgttacccaggctgctctctaactcctgggctcaagtgatccgcccacttcagcctcccagtgtgctgggattatagacatgagccaccacacgtggccaaaaatctacaatttaaatgttaatagatgatatccttttcaccttacttctcttttttccaatatcaaaatacgatgaatgcactcctcaaaaatctatatctctatagagtttaattaatattactttaaatttcaattacctttttagcagcatctctctctttgcaggctagttgaactttcttttctgcttctgcaattctttgagtaaactcatctttcaaggaagaaatgctactgctttcttctttcactctgaacatttcactaaatttaaaataatatttgagaatgaggatggtgtctatatatcccaaaggtatacatgagttcaattctcaaaaggaagataacttttctctgacatataccttattaaaatagaacagttttaggcctattaacttttaagaaaaaaaaaggaaatttcccttgttaaatttattttaaaacacctcaaagaaaatctgttagaaagagaaaatgtcaccaatatctgacatgtaaaaataagagaagagtaaatacaatgtttcaattctgaatcttcttgtatcacattttcccaatcagctccttatagcacaactgtgttattgattaacacagttttcttcaaatacgttttaaatctctaatactaaaagactaaaaacgaaaggaaagagttttccagttttgcaaaatgactctcttcaatggcaaagggtaaagacaatcaaaagagaaaagtaatctttagggttataattgaaagctatacaactttcaataatgataaaattacaaaacattttaatttcaaaaacattcttaaatatgtacaaagtatacaggtttccagaaaatgtgtaacattattcacatttgcagaatacttactctttcaggttatcaaaagcttcttctagaagtgctttttccttactaagagataataactgagcctcccttttttccagcttttcattcagaaattcaactgtctggataaggcgaatacataaaagtcagaacgcttagctttaaaaaagaccatttttacatgcaggtgtatcactgtaacaaagaaaacagctttatctcataaaaacaatcaagaacagtattaggaacacagaagatccagaacaagaagaactcttaggcagctgagaggagagtaaaagtaaatacaaccaaatagctagtgggagtgtaagttgagaaaccccttgagaaaacaattaggcaatatctagttggggatctacatactctttgatatagaaaatttcacttttaggtataccttagaggagaaaattcttgcataaatgcactaggcgacatgtataagaatactttatgtagcttcctggtaatagcaaaaatctggaataatctgcatacacaccaaaagaagaagggagatggatgcaatcaaaagaggtcaaagaggaaatttaaagcctctatattttagctaggtggtggatacacaagtgtctattttctgtattattctttacccgaaacacataccctttttaaaatatgacatattgcatttaaaaaataaaagtaggccaggcgcagtggctcatgcctgtaatcccagcactttgggaggctgaggtggggggatcacctgaggtcaggaatttgagagcagcctggccaacacggtgaaaaccagtctctactgaaaatacaaaaattagctgggcatggtggcaggcacctgtaatcccagctactcaggaggctgaggctggagaatcgcttgaacccaggaggtggaggttgcagtgagccaagattctgcaatgatcttgcactccagcctgggtgacaagagtgaaactccatctcaaaaagtaaaaataaataaataaataaaagtagaggccgggcatggtggctcatgcctgtaatcccagcactttggtaggctgaggagggcagatcacttgaggtcaggagttcaagaccagcctgaccaacacggtgaaaccccatctctacaaaaaatacaaaaattagccaggcatggtagcatacgtctgtagtcccagctacttgggaggctgaggcagaagaatcacttgaacctgggaggcagactagcctgggcaacagggcaagactccgcctcaaaaaataaataaataaaataaaataaaagtagggctggacacgggttcatgcttataatcccagcactgtgggaggccaagatgggaagaccgcttgagcccaggagttcaagaccagcctggcagcatagtgagacctcatctctactaaaaatcaaaaaaatagccaggcgtggtgcgagcctatggtcccagctactagagcggattaggtgggaggactgcttgagcccaggaggtcaaggctgccgtgagccatgatcgcaccactgcacaccagcctgagcaacaaagagagaccctgtgagccgcgatcgcaccactgcacgctagcctggacaatagagagagaccctgtctcattcatacatacatccatccacactaaaagtaattttagaaaacccataagaatttttaaatctccataatgtatcagtataaagctaaacaaaaagtaatgcttggaatgtctaattccttaggtcctactcaaatggtgataaacttgagtataaaaggagtaggaagggttcctttttggactcaaaaaaatagtcttacctgagtttggtttagatgaacttagaaatcacttaccttcttaaatacactgaaattcaaaaatatctgatagtaattagtgctggtttctaagaattcaaactcctattatatatcttacagtatatagctattactaattgaaatattattgcacagcattttgtttgtgaatatttaacctgattaacagaatctggcacttttttaaaaaattaagtaattcaatacatggcacttacaggacatttcttcaagacatcctacatctcagaagtctattaaagataccagatccaactaaatttgtatatctaaaagtcacagtaaaaaccaaaactaggacttaatgtcaaagaatttatatcactttcctttcacatgtattaggtagaagcaatctgtccctcctaagcaatgcttttgttccttagacatttctctttctcgttcatgtgaaatatagctatcaataggagatctcaaaaataacataagcagaaaacaaactgaagcaatataaggatatatactccttatatatgaatgaaaatactaataacagaaaagcaccaataattaaaatcttaaattatcatttaatatttgctacaaataatgtaaacatgtaaaaacaaattctgatacaagaaaaaccataacatttagtttttttggcacatctatctgcaaaggaggtgaagatacatgttaatgtaagaaaatattcctttcaaattgacatactaataagcataacagaattttgaagtgataaggactcaaaaataaagatgtaagatgaaaactttcatgcttaactgtattgaagtatcaacttattctaccataattgccttggagaaattccaaattatattaataattgttcaacttcaaggtacttaatgctacacagaaatggcaaaatgcgtatgtttttaaatctgtataaattattatgcatcaatgaaagtattttttaaaacaaatgatttaatctccaaaaagcacatctaaaaatcccttccacttactagagttaccttgcaaacatcttccttctcagaaagtgcttctggctgactttcagcaggttcacactgctcagccaccttgtctaacacagtctgtccttcatttattggtgtggaagaaaccaagatatcaggctgttcacagttaacaggagttgcacttcgtccactttcttccatttctgcttcctcagtgggtataactaatgtttcatttacttcttcagattttccttcagcagattcaactgttttagactttggagttgaagaattaactataataggcactaaagcatatcccttgcctgacaattcatcatctgaattgatttcacttacactccggctatctaatgactgtacactaaatgagtctattctttcaaaagcatcagatgaacagcaactctcagtgagtttttggaaatcatctaaacgattatattcaggacaagcagatgcagagagaagctgaaaagatgtctgcatcaagtgaagacttgattttgaatctgtagtctcttgtctcgagctcgctgagctctcacttattacactttcatgatctaaaacttcaatatcactggtggtagaagtacctgatgaaaaggtactaacaggaggagaaggtgtattgctctgcctgtcttcatgtttttgttccttaggttccaaagctatgtcctttgtttctgctgtgagagactgcgtagacgtattagatatactttccatagttgttttcacatcaattacactttcagatactttcaaacttacagttggcaccttcatatccgattctttattaacagtttcttcgtgcttgccttcagttttaggtgatgaagtacctgctgccagagtttcccctgaaacacacaaagaagagtcttttacttgtgattcagttgtttcaggagttcttgactggccaatgtgcaaggattcatgtaagctgcttttcacttcttcttctggtcgttgtgattttgctggaggttttgataccactggactcttctgaatggtctggacatcagttggcgagagaaaggcactgaagaaattttcagattcatcgaccacagtcctccgaactggctttgtgattgctttaggagaggctattggtggactctgaggttcagtgtttgatttcaacccccaggttgaagtatcccatcctccactgacaggggaacttattcctttaacaaaaaagtaaatattaaaaaagaacacatatatgttacattaatatttcaatcatcattataaatcagtataaatataaatttagaaaaaataccctatgaaatacctgtaatttgcacctgctaaactccttgcttactacatcattaagtagtttccaagttaatacagggacttacggaagaaaactggtgtgggtccacctgagaggaaggaggagcacagacaaaagactgggcctggcctggactaccagatgcgagtatgttattcctccccacaacaaattaaggaagtaacagtatatgttttataacccacagtaagtccaagatacctatgattcatctcataataacacgctttacttatcaatatgaaataaactaatatggaactaactgaataggttgggccatgtgcagtcacagaaaaatgaccctacctattcagtcagtttcatattaatttttacttgtaatatcagtaatatagttatgagctagacaaagggcaacactcaaaaactgaactcagtgggtatggaggttcacacctataatcccaacactagaagagtcatttgagtccaggagttcaagacaagcctgggcaacatagtgagacccctgtccctacaaaaaaatttttttaattagctgggcctggtggcccacatatgtggtcccagctactcaggaggctgaggtgggaagatcatctgagcccaggaggtggaagctgcagtgagccatgatcaaaccactgcacttcagcctgggtgacagatcgagaacctgtctcgaaaacaaacaaaacaacaaaagcctcaaaccaagataatggtgacaaatgttctttcccgaagatcatattaaactgatgggaatggtaagttctagagaacaaattcattttcatccacttaatcacaggctgattctctaaatcccactctccaagcccactctaagaggaagttttgttctcaaattctaaattatgtcagaaattacaaggtcattataaatttcagaaatgtgtgtttttttaagaactattgctctttgacatagaggtggttgacactagggtttttaaaaaagcgctacaaagaaaatgactgttttcttggggaaaaagttaattatcatatcagtcatacaaatagctactactaaaatcctgatttttaaaaatggcataatcaggatcttaaaaatggtatattcgttaaagtatttaaagcatttctttaaaaatgttttctttttcaaattaaaatgtggctgaacaaaatattcacaaaatattcacaattagaagttggtggagagagcacaagtaactaaaagcttctaaaaactatcaagccttatagtagaatctatcctttaatatgacttcaggccaggcgcagtggctcacgcttgtaatctcagcactttgggaggccgaggcgggcggaccacctgaggtcaggagttcaagaccagcctggccaacatggtaaaaccctgtctctactaaaattacaaaaattaggcaggtgtggtgacgcaaacctgcaatcccagctactcgggaggttgaggcacgagaatcacttgagctcaggagacagaatctgcagtgaacagagatggcaccactgcactccagcctggatgacagagtgagactgtgtctcaaaaaaaaaaaaaacaaaaaaacaaatatatatatatgtaaatatatgtatgacttcaaaggcagttaggatgaaaagtatgtagaaaacttcagtttggaggcatagttctacacattcatttgcacaatatccaaaccagagaaaatcaaaattaaatatgcaaatgaacaaccaagattatgtctgattaatttaaatacattcaaaagatgacaggaattaattttgcctcttggagaatactttatataatcccagggttatttggtatccatctaaattataccattctgaagactatgggcattttccgaaaacaaatatccttatatgtaaaacctatattctatcttatctaaagtttagtaattctaattaactggggcacatatgaaaaaacagagttactccagcaaggttatatgacatcttgtaaaaagtaaagaggatcatcacatacacacatggaccaaaatatcttaaactgaggtacctcaaatttaggtcctgacttttcaatgatgtaaaattaagaacagaaaccagaaaggagtagtcaagtacatctcttatcctttttcacacaaaggttcacatcccccaacaccagcaaatctttaccccacacatcaaatgctgaactgttccttagacttaagagtcaaaagcaactgaatgaagatccctgaaagattaagctcaatgaaactgcaaagagagacttggctattcagaaataaaatgtgataccatccagaaatcttgggtcacacattttccggctaatacctccggcacattctaatcctcctccgccgtgtgacctagagcaagttacttggccattctgggcctcattttcctcttatgtaaaacacggatataaaccaagctctctctgggagttgttctgaagatgagaaggccataaaaaagcacattacaggctcgtgcctgtaatcccagcactttaggaggccgaggtgggtggatcgccttaagtcaggagttccaccagcctggccaacatagtgaaaccccgtccctactaaaaatacaaaaagttgccgggcgtggtggtgggcgcctgtaatcccagctactagggaggctggggaaggagaatcgctagaacctgggaggcggaggttgcagtgagccgagatcgcgccactgcactccagcctgggcgacggagtgagactccgtctcaacaacaacataaaaccacattacgcgctaccaagcgcgaaatgttcactgactgttagcgattgttcttcccttccctgatgatttacgtacttcagaccttggatcccaacagtgcccgagacgcgaagcaattcgaggttcaggttcgggaaggttgtgcttggaagctgcgtcgagggagagcttgagggcaagaccaaccaaccaagtcccctgtcatccaagtccacaagcctcgcacccaggaccaaagaaagacaagggggaacctggatctgggttttccctcaggaaaacagcaaagaccgacttggaggctgaagcagcattagggaacgggccggggagaaattacttcctgaaaactctctcagcaaggaaggacccctctctacaccacttaacctgcctgcatcaagagaacagcagcctccgggagccaggaaccccgctcctctctctcttacccggctctccatacggaatggtctcggcccagatgctcggctcctcttcctggatgtccagaaccctgtcaatagacttctgggcctgggacagggcctgcttagcgaagctggagagctgggaggcgttgaaccaactcatcgcccctcctcagccggcagtggcggcggcagcaccaagcgggaaggcctcaggcctggggaagggtgcagaggaacggcttcgctccccttttccactcggctggttctgtcagcgtgtggccattaccccgacagcctcccgcgagcccgggatgttaccctcggccgttcccgcacagctgagacgaagggggcccatgtgcgcatgcgcttgcttcttccacgtacacagcaaccaaatctacgagcccagagttcggtcgacagacggaagaacagaagaacgttgacgtcacatccgggagcgcagggttgccgttagttaccgaggaacgcggaagggtttctattgatgtcgatttcgtgcttacagcagttcttagcgaaggggaagctatggctaccgatagaggtcgatttccccggaaggaatattcaagttttcgtgtgtgtgctttccaggaaaatagttcacgtgctaaaagcttgcaccttgccagcaataattgcaaagggaaattgggcctcacacttctcttagccctttgtctcaaatatttaataagctctgtattaacttggtattgtaaggagaaacacttgtttgggcttgcctaaaagacaggatcacgtatgaacactgtgtccaactcgtggaacacatggtgcataaagcacaacctctctctcaaaatagtagtaaactcattgctgcagtcaaaatacccctaatactgtggtctgtcggtgtcccctgcacaaattcctatgttgaaacctaatctccaatgggacagtattaaggggagcctttaggagatgattagatgatgatggagccctcataaatggggttagtgcccttataagagaggcccaagggagctcacggcaagaaggcaccaactctaagccagaatagcagccctcaccagacaccaaatctgccggctccttatcttggacttctcagcctctagaactgttaagaaacaaattgctactgcttataagccacccagtttatggcaatttgttacagcagtccaaatggactaagacacctaggaagcactaaagctgttatcctaacaatgtgcactgtgcatattacttaaaacataaccttttctgtgtgcattctcttcgaacatttggacatgggaaaataccttaaattggtggccttcctaatccagtctgcagctatatttggtttgggcccaagttaaagacaaaatcctaactaaaagccagatttcattcaaaaatctagatttccagctgcttttgaaaaatatgaataccaagcatgggaatagtcagccagagtggtcaccaaataattttcactcactccagtttgccacagacccctatcactcatcctattacaccctccctgctgtgattatttaccttatatgcctgcctcccatatttgaatattttaccccactgcaaggaactctgcaaaaaagaattatttttcttttaaaaaatcagattgaaccccttaagaagttataatcatcttccaataattttatctaactacagtaaaaacttgcatgttaaaactaacaatttagtcatgtacacaagtagtaccaagtaactcaagtactttcaaacagctaagtagtctgcagaggagatttggggcagattcgggttgaaattagctgtacagttacagttccaagacttctaattgtacagctttggtgaaatgacctacctaaaccatctaaaactatttattcagctctcagatagagtcaccttcttacaatgctactttgagaattattatagcacctatatggtgctaaattttagttccttcactttcaaaattgtaagctacacctgtaacttttcaggtagagcttataaatttattccgtatggttttataataaaacttatttgtcaatatgtagctagaaagattactgaaaacttaactcagtgacacataagtaaccaaaaaacatttgaacagaaaactgccatatctaagtcaaaaacaaagaatgagaacacatacatgttctcatattaaaatactagcacctacttttttagtatttgtacttaattttgtttgaagttttattcacttaaaagaaacaaaaacatggtcaggcatggtggctcatgcctgtaatcccagcactttgggaagccgaggggggcgggggggggtggatcacctgaggtcaggagtttgagaccagcctggccaacgtggtgaaaccccgtccctactaaaaatacaaaaaattagccgtgcatggtggcaggcgcctgtaatcccagttactccggaggctgaggcaggagaattgcctgaaccggggaggcagaggttgcagtgagctgaggttgcatcatcgcactccagcctgggcaacaagagcgaaactctgtcgcaaaaaaaaaaaaaaaaaaaattatattgatacagaaagttaaattaaaccagtaaatttttactatagaaattgctgtagcaaaagtattaagtgcaataaaaatttgatataactctgctacacatttaaaaattattcctatattaccatggaactactgattacccttaatgtacttttaaaaacttcagtgaaagaagtacacaatatatgattttattaataaatagtgcaaaagcatcagtgataactgtttgaacattaaattttttaaacagccatgtcttggcattagttaatattgtgcatattggcctctatggcactacaagtaaacagatgaaaatattgcccattttcatgcacaggtattcagctataacaccatttacaaatcattatgaacaagataaattctgcaataatattcatttggatggccacaattaaatgagtgttatatcaagaaatagcctatgttcaatatactccagatgtcagattgtaaaatgtaatgttatttaaaacttaattctttattttccttaaagggacaccttttgtgtatttgggtactcaaatgaaaacttaggaatgcattctttgaccataataacaaaattcacacaaaagaggttgtatgcttcctcctctaaaagaagcaatacatttgctcataatctctctctccaggtatcatttctcatattattaatgaaaatgcttacaagcaccaacaccaaaattctgtcttcaagggaaggttacaaagttaaaaaagagtggttcattatataaaaaaagacaaatcgtggcaacactattgctaaaaatgacatcgattcaacttcttagcatccacaaagtatattatttccatgagttttctattatgtggagattttccttaagaagtaaaatgaagtttgaatagtacagtctgtggggtggtgacatcagcaaccgccagttcttgtccatcaacaagccccaattctaaaacagaaaaaatattattaatacaagcaaaaaaaactcaacagaaaggataatacacatgtaaacaaactacagagtattacggtctagaaaaacatcaaaatccaatcctctttaatcaaagtaatatttgatttcttagagattttaaaatattctactaaaagagcaattaattctattaatatgtctaaagttgtaagtaattattacctgaccatatacaaggcattaagaggaaatctagaacaagcactgattactttcaccaaaaagagagaaaagaaagaaaatgattagtaaatacccttatgtaaaatacctttcaatgttttggagagatttggccttgttcgttcttcaatagaggttaccgactagaaaacaaaattactttaatgtaagacacattaaagtaaaataaaacttgatataattttctgaaaaaaatttaaaatacacattgataacctgtaagtaaagtgttctattttttccctctagggtggctgtgatggctggagatttcatttgcctaaagattatgatgagagagaagtatcaaacataatttttatcaaaagataatttttttaaggtttcaaaaatcacaaaaatgatttttacaacataacaaaaatctacaatacttacagagaagcactattggttagataatccaaaacctcctgtagtttagctgatggagaaaactgaatattttgaggaagctggctacaagctgggcagttttcctacacacataatacacaacaaattacagcagcacatgcaccaatattagtctcttttatgaacaataaaataaaaatcaggttgttttataatcatgcatatttcctataaaaaaatttttatgctttaaagcctgcttttcataatagaccatttcttgtaaattacttcgctatagagttatttcaggctataaagcaaaagatatataataagtagagttctggaagttagaaaatgtatgggtgactttgttcaaatttctaaccaataatatttaaaaatcaaaatatgcatgatcaaaaatgtgttcttaatactactaacctttctttctg

SEQ ID NO: 822 - DNA, 24324 bp, Homo sapiens
agactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctgggtgagtcagggcccccaggagggagagaggaacgggaacctcagttggggataaccctgggcaaggatgaggggtggcatgggaagaccgtcaggacacccaggggagggaaggcaggctggtgaagatgaaaccctgatgactctgctggctttggaaagtcatccaatgtggcagagttcagggttttttcagtgtctttcacccaatcttactgaacacccagactcttgatgttctgttgctttccacatcagaacccgctctgagaaaagtctagtaacctatacttgaatgataaatgaatggccagagtgtttgccttctttgaaatttatgcttcacaaaagaccaaatcttaggcaggagggccagtgctgccttgggtaaggggtagggaggaagttgtaagatgcatttttgggaggaggtggcggtggccattctctgtgcccctgaaaccactttgtgtagcagaagcctattgtcttcatgtgtaagaatattcccctaggcagaagcacagggagatctgggttatccagggaaaagggactctgagaatacaaaaacctgggtaagtctggagtcatctgttgtgggaccagagaaatcatgcatgctgcttttgaccacacagaccatgatggggaagtactgcatctgatcagcaagagagacagggtctttggccaaaatggagggctcttttctaaccatgttctcagctgttggataggggacgacgactgattttgctgagtggtttgaaaagcctaggggaggccaagtaggggagacttactgccaggactatctctccaagctcagttcctggggcttccaccctcacattctagaggaaagcatattgccactcagccaagttgtgtgatgtgattactagtgaaacgtgatcagctctgggggccctcggctcttggctgtcaatgcaggatgatactgggctacaggagaaagaggtaaggaagacagagtattcccccatgaataggatggaatggattaaagtagaagagaaagtgaagtgaactacctcatttgtcatgtggggaagttcaggcctagagaggtgatgtgcttctctaccacctgggcaagactcctgggaaagatctttggtattttttcccatttgccttttactaagtcatcaaagatttaccccattttttccattcttattggggctgccacatttacgtcttcatcacttgataactcaatttttatagcaccctctgatggggtcttgattgatcctgtctcccctcccctgcatccatgctgcccaccaaggccacggcatcttcaggtccagctatggctgtgtcagtgcatttaataaatgccttccgtgctgctccattgcccactgcaaaaactctaattctgccctgcacactgtgttctccattgcaccccacatgaatcttcttctacagccaggcagtatgtacactgcactttctgtttttaccacctttgctcctgctgactctccaaattctatgtgcaggcactgttctaggacttggagacttatcagtgaacatgactgacagccttcctgaccggaaatacgaggtcaatgaacttattgtgaagcaataagtacaccgggtgggaggatatttggtatttactactatttattaactgtggaatggatacataattggtgacttctctctcctttcctcatcttttccttttttttctctcgctcttcctcttcttttttactctctctcccactacaccgtcccccttgccaatcctacatactcaggtttttagctaccacttctatgtcaataactcctaaacctatttctcttgcttgcttctgtcaagtataattttatatttccactgctggttggacacctctaaaatgattctccagctcaaaaacaaagcatattcaaaatgcaacttatcatctcctccttacaaatgttctcttcctcctaacatttgtatttgcgtaagcgcagccacccttttcctagttatccaacttaaatcacccccacagtctattaaatgccaacttctctctgccacttaaatttcttctgcatctgtttcctcttcttcacctcctattgtcagtacaactttgggctctcttatctcccacctagattcaaccagtgaatgatttccagagcaatggcacatcaaattaatatggctactgctctctttgaatttatattctactgagggatataaacggtaagtaaacaaacaagaaggcataagtacaaatggaaaagggctatgaagatgtaaacggggtactgtgataagattagttgtggggaagagaagagagcagcccactttaaacaggatgttatgtaaagagttttctgagggggtgacatttaagctgagactttcaacatggtaaggattcagccatttggtgatcaaggacgcatttcagggtagagggattggcatacagaaaatccccaaatttgaagaatgccaggaaggccagtgttaatgaggctcaatgagtaggtgaaaagggatctgagctgaggctggagaaggaagcacggacccaatttgatagggcttgcaggccatttccattttattttaagaccaaagaaaggcaactgaaggcttgtaagttggggagtgatatcatctgatttcgttttttttttttttttaaggaactagcttctttatggaaaatggattgtagggtgaccataagaagtgaggggacaaattaagatatgggaaaaagctgatggtgacttaaactgagtagtgtctataaagggggtgaagagaagttagtgggtgcaagatctaagttggaagcaggatcaacaagacttcctggtgtggaagggactggattttgggagacagagaggttaaaagatggcttgcaggtttctggcctatgtagctgggtggataacgaagatacatattgacatggggaagacggagagaaacagaatgtgtccacttgctatgacaacatgaagccattggtgattttgacaagaaaagttttagtggactgctgagggccgagtccaaattgcagagaattagacagtgaatgagaggagaagaaatcaggacagcctatgtaagaaaaacaatggagaaatttagttttgaaagggatgagacaggccaggcacagtggctcatgcctgtaatcccaacacttggagaggccgaggtgggtggatcacttaaggtcaggagttcaagaccagcttggccaacatggtgaaacaccatctctactaaaaatacaaaaattagccggatgtggtggtaatacaaaagttagccgggcgtggtggtgcatgcctgtaatcccagctgcttgggaagctgaggcaggagaattgcttgaatctgggaggcggaggtcgtagtgcactgagatggtgccgctgcactccagcctgggtgaagcaaacaacaacaacaacaaaaaccgagagaaatggggcagtagctggaattatatgtggtgtcaaggaaaagtttttttttgttttttgtttttaatggaagatactgaaataaatttaccattgatgggaagatccagctaagagagaaactggtgatgcagaggagaaagtgaataacagaaagggaaatctttgagaggattaaagggaatgggatccagagtacttgctttgagactgaccatagacaggaggagagatgctttctccagtgaaatgcgaggaaggagaagacaggtagagatgcagaaaagactggtagatttagtcgggggacgatgtgagatcttctgtgtaacctcttttgttttctctgtgaaatatgaggaaaggcatcagctaaaaatgagagaggactggaggcagagggtgggatgagaaagcttggggaatgaggaaaagatgagtgtcactactcagagtagcagagcaaatttcttggaaaaaagtgccacaatggcagttcagtgtccttttaaatgcggtgatcgcacatttactgcgtcaacagtttgccttcttgtgtggtaatttcaataacacgcagctgagcaagtaaaggcatggcgaatacaggtgcatttggtagagatagagaaaggcaacgaagttaaggggatttgcaaggaggtaattataatgatgcctcattgaattcaagctagatgggggagggtgggaggtaaaggcaaacatgtgctcaaggataggcagtggtaagatggatgctttggggttcttgataaggtcaaagattattctggtggctgtacttgagcagagaaagttcatctccaaagaaagaaagtttactgatgatgagcagttcagggaatgaagaggccagttgtttgatgggttatccacatattctggatcactacagtcatctcttttttttttctttttctttttctctgacctcattcttccatcacaattagtttctttcttaattaagctctttggcatttgccctgttccaatctatttgacactgcactttcagccccaatttgaaaattctaagtgacttcccactgtatactgaaccaaggagtgaacttataaaaaaaaacttaaatttatttgaaattcaccatgtgtcatgtagcacactaaatgccttctctggattatctcatttaatcctaacaaccaccctatgaggtagatactgctgtcattatcttcatttacaagcaaggaaactgaagcagagaaaagttaagtaatttgtgaaaggtcacttagcagtagcggagtcagcatttaaactcagtatgtgctttcccccactgccacaccacctggcactaggagccctccagagtatgacttctactttgctttcctgctttgtccctcattattggaagtgcttgaggagagaccagaaatcaagtagaagttgggctgcaacttgctgggaatgttgccaagtacttgctgctccttcccatggaataccttttccctctcagccaaaatcctatcagtcctggaaggtccttgatgaacctgaaaggtcccatcttctccataggattcccctccttatgaaccccaaaccctcccaaacacagagccctgggatcttttctttctctgaacctccatagcattttatccaaattcctctaatgtcatctcttttacatcagattacacatgtgcttatctccaccgttagattcttgccttcagtggaagtagggacttaacgttcttttcccttaggtgaactcagcatgcattgcagggcagtaggaagccaatgcaggtttgttgattaattttggatgcaaaggaaggaagtgattggtccaagtgtatatttcgagatattggagcatcgggaccagaatccagttctgtaaactttgaagccaacactttctccacattgccccctttttacctcttggttctgattccatttccttccgtacttttgtccctgaaaatatacatgcacttggaagcttcttgactttctctcagcccagatgcaagagaaaaccttcacccatggacagatggacacacacacacatacacacacacacacacacagagctctgattcacctaaggacccagctttgcttctttacccaataacagcacccacaaatctttatctaccctagcccacactttgcctccactacggaagctcttttcttaacccagtggcatccccctacccctgcatgaagtcacagatctagtgcccttttgcagtctcttcctccttttatcagatatttctaatagcaaaaatctggaagacctaaatgccaagcaaaagagttgttaaataaatcacaggacagccaaatagtaggatatagtgtagccatttaaaatgacaacatgggcggggaacggtggctcacacctgtaatcccagaattttgggaggctgaggtgggtagatcacttgaggtcaggagttccagaccagcctggccaacatggtgaaaccccttctctactaaaaatacaaaacttagctgggtgtggtggcgcgggcctgtaatcccagctcttgggaggctgaggcaggtgaatcacttgaacctaggaggcggaggttgcagtgagccaagatcgcgttattgcactccagcctggtgacagagtgagaccctgtccccccacaaaatgaaataaaataaaataaaatgacaacatagaaacagattcatcttctagaacttgcattgctcagtgaaaaatcaggttaaagaacagtttttagagtatatcctcatttacacttatgtatgtctgtatgtgaacagcgtgtgtctgtgtgtgatcacagaaagaaatccaacaggatgtatgccaaggtgataatattttgctcctgcgtattttctatttttctgtagtgatcatggattacctgtgcaatttctaccccctcccaacaaaagaacaaatcttgctctcaggataaactctggcaaaattatttatactgatgcataaatcatatgtaaagcccaacagagacctctttccagaggcatatttattttaatcagtcaagaggggtaagccaaaggaaaatgccacaaaacaggtggaagagggtgttatatacttttatttcatttttgtatgttactgggagttctcagtccttttaaaagtgcagctcatccaggcagtcccaggggatatggccacgagggctgtgctgtaggtgaagggcgctctgggcctgggcagtctctgggccaaagtgggcaggtgtcagttcagacactccactgtgggctgatctttgctttctgtcttacagctcctgttgctgggacacctggtaagtactccacccacagcctttccttccctcgggtccccttttcctctcctcccagtgccctgtctggaggtgctctaaatgcaccagcaactgagcccagtaccaagtcagggccaggaaagggtaattgctcccgaaagatcccctctccctcttccactctcctccttccttttcctccttccacggaggcaagtggtaggcagccacggtgttcaaatgggggagctgtcacagaaaatgagaactctgatctctctctcaactgccttccgctgtccaaataaaaccaagggcttcctctctccaaataaaattcaggcacatgcaaaatcacatggcctgcatatgttgtccccctgtgttgctaaatccttgactgtgcatgtttctgagagctccaaggcctgttccctgacagagtggtctctgcatacctctggctacactttgccgggcacttctgtgtttgtgccactcagcctccaccgctccaggactggccctccggcttttctccctctctctttatccttctgaggccagagaggctcgtgtatgcttgggtgtgaggacgggccatcttgacctcgtttttaaagtatacagaatgacattaggtcagaacggaaacctgatatccaactcccatgcctgccatctccaccagagcccccacttatcttcagccagccccaggggaaatttatccactagtgtccaaatgcctttgtttatcggggagaaaagttagtctcgaaagagtatgtatgtatggggtgtctgtgtgtctgtgctggtggggagaggttggtggggagagagagaaggaactggtgaagatatctcaggtaaagtatatgtatttcgagggtgtttctcttgcctgctccctccttcttccctgttgccctgtctgagtcctgggttccctggggcccttgtggtgggatgtatgagcaaaagcaactgccttcagttgcagaaccattctgggcctggctcagcttttggtgcccccagtaggcctacaggtgcttttttgtctgagattcagggcctctcaggctcttgggcttcctcttcctcacactacctcctctctctgcccctcagcagctcccccaaaggctgtgctgaaactcgagccctagtggatcaacgtgctccaagaggactctgtgactctgacatgccgggggactcacagccctgagagcgactccattccgtggttccacaatgggaatctcattcccacccacacgcagcccagctacaggttcaaggccaacaacaatgacagcggggagtacacgtgccagactggccagaccagcctcagcgaccctgtgcatctgactgtgctttctggtcagtggaggaaggccccagggtggacctgggagggccaggatggatgaaatctgctttcaggcagaggtttgcaggaaaggagggtggcctgcttactgggaagtatcgctgtgagttgcctcagcacatgtcagtggttgctttgcctcagtcctgattgaacagaagaagattacaaggccaaaaacaggcagccaagtgtgagagaagcagaaggaaatccctactgcataaaatccatttccattttaatggcagaattgaaaagcacagaccacaactgaatcctagccctggaaatgactcactatacaacatgatgaattcatttaacccttgagtttccatttcttcacctgctccgtggggcactaacgcctccctcagaggcttctggtgagaatcagtgtttccctgcccccgccccgccctccatgccccttctccacgttctcactgtgctaggtgctcttctctgtctttctcttccaccagcctgtgggaaacctgagatgaaagtcgtgtcttacccatctttgtatttccagcatctgaaactgggcagagcttaataaatattttgctggagaggttgatgatcttacaaagctcccattgaaaggtggctctctgtaaagcaaagttacaatgagattgtgatgaacattgtccttgtggcttttcacttagtcccctcccttcacctgaagagcaaattttcctcaaaagtacacagcaaacaaatgacccactggtgacactgctgcctttagaccctgctggaaagaatctccacatttattaacattcccaaagtaaatttatcaggtagcattcatcaggtaacatttgttgcacattcatgacttttctactgtccacaaaggcatatgtccttatcatatgcagactccttggccacactggattcctccttccctcctcgacatggaagagatggcatcttagggtctcttgtgttcttcctgaagaggcctgtcgggcaggaaaaggctgcagctgccttcctgggagaaggaggagatgagtgtatcctgaacacctattatgtgctaggggctattgtagatacatgacattatcatgctcattttcacaaatgaggaaactgaggctcagaagacttaaattatttgcccaagagttcataaatgatagagccagcattagagtccaggactgtctgatttcagacctaagctgttccctctgcacatcatgtcccaccagtaaggaagatctgggtctcagagctgagccaagacctcccgggtcctctggggttttctgtgtctttcagagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggtatgaggagtctgccaagatgtagggaggggagaagaggggatggacaagggctgaggtcacatgggcctacatggaggtctgagaaaggccacagcacaaaattgggcactggagcaaagaggagtggtgtggaggcctggctaagtattgaccaatgagcaggagtaggggccagagcttggagccctcaggtgataggtgaccaggctgttgttccactttgaaatgcaggccccagactaaggacggcagcgaagcagagctccctcgttggtgcagaggttccctaagctcctgggcattcgtaagaactgaggtttgcctttattcttctcatggctcatgttatagccattcactccagaaagcctggcacgtcatggactgttcaaggctgtgctccatagagtaatgatgcctccagctatgcgaggctttgggcccacccttcccactgcccctgagggctaaggggagcccttccttctgctcctgcctgctcaccagtgtgcctttattagttcggtggagaaacctcggtaggcaggaggcataagtccagccacagaaaccctgtgcagatgaggctggggatgtagtgagtgctgcagaagtgagtgactcagacacagaagagcttcgggtgacaagcactaggacatagcattggatgggggggaggtgggacaaggagagtactgcctgtcctgatgtctgtcttccctagctcccagctcttcaccgatggggatcattgtggctgtggtcactgggattgctgtagcggccattgttgctgctgtagtggccttgatctactgcaggaaaaagcggatttcaggtttgtagctcctcccggtccctttggttatcagtttccacttggcccaggccctaaccccagacattgccagaatccctctctttgggctagatacacattcagatctaggcccgtattgtattatagtcattcattcgtttattagatcattcatttgacaagacttgaacaaactagcttatgtgtcagccaatgcgtgagacatggtgggtgatgccaagagaagtccagtccctgcccttggggagttctcagcattgtgaggaagacagggtcattataataagatgggataagagcaatgatagggacatgaaaagcctaggatagaagtacagaggaggctccatagcccaacaagggctgacgcagttggagaagttctcagggagagcagtgtagtgtagtgatggagtgcacatagtggggccagactgcctgggttcaaatctagttctacagcataccaactatatgacccaagtgagtcactccacctctctgtgcctcagctgtctcatgtggaaaatggggacactaacaggacttacctcacagggttgccatggggatgaaagaggctgatgctcttacacagtgcctggtaggcagtaacagcacacaaacagggctgttgccattctggaggaggtggtgtgtgagggcagcgcttagctagggaaggaggaccctccaggcactgggccaaggcagggattgaagccgggtggggctcatatgggtgtcgaagggggagaagagagggtactgcaagccaccaagaaagaaagaatcccgctaacacctcacaaagcacttttcaattggttcatagccaacacctcagttactgatgataagtaaatacagagaaacagagagagagagactgagacacaggggtgtttttaaaaggcagagcaagcctcagacagatgccatggcgtggcctttctgacactcctgggcatccccatgggtgagctgaattctgcctctggactagcccttttccaggcgggagcggcccctgagcaggggagctgggggtgggaggacaggaaacatctgccagagggaaggcctgagctggtcccatccaaccctggccctggtccttggtcctgaggactcaggccccaccgcctaatcctactaacctcctgtgtgcccctcccagctctctcaggataccctgagtgcagggaaatgggagagaccctccctgagaaaccaggtgagtacaggttgtctcagggattcagtgatggctcaccagggctgccggctggactgcagccagcgagaaggggcttgtgcgagttcagctgggagccagggagggagcagcggtgggaggatggccggggctcaaatcgcttggttagctctgagtctaactcctgggcctaaagatgacctctctggagatgagaagagaaacaccagtcccagatacagaggagagggctgtgtccgaatttctggtaccaggaatctgatgatatttccagagcaagaaatcagagatactttggtctttctgtggagctttggcagagctggcagaggatggggttaggggctgtaagactgaggccaatcggacgtgggaggcaggagtctaaggggaaaggaggaggaggcctggaaacccctcaatttgctgaggaatctgcctctgtggagggatggggtggagtggccaggctcagctgtctgtggaacactaagaggaggtttgggcttgagaaaattctggggggctaggggcactagtgggctctactctgtgggcaaagctcggttccaatgcccatgcactcaaggttgactgaattttggcctggttctgcccccatcacacagtggagccctgagcaagtcagtctccctgatggggttcagtctcctcactgaggaaatgagtgggtggccagggtgacctctcaggccttctaggtctgacattcaggtgggagtgtgtaaaggaacttccaggaggatgccaggtaacttccagactgtagttaaagtcagagcataaaggaaaccagagctttctccgggggtttccatgacagtaggaacaggcaggaaaaaggctgtcaaagaccccacctcagatggctggagtatgattcagagcagagccaacagatttaagagcttgagcaaaatatcacttgttcagctgtgcttgcagcaaggttgcacgtccgctggccaggcccagtggtgataggggcctgtgttcacaccagggccaaaacagatctggaaaatacaaagtccaagcaactggattatccatcttgttgtgtggttctgtctgcactggcataagcacatttcatgaggcatttttgcagccaggcattggggctgcataaatggtttcttaaaaatcctttcccaaaaggcaaagctggtttgctggaattgttggggaatgtattagaatgggaattcagaatgtggtttgctgcagaatttacagcatggcaataaaggctctctgtgttcagggggtgagagaagagactagatgcattgtgtcagatgtctcccgacttcctgagaaatgccactttgcaaatactggggctgcttttcacactggccaagtcagtttatgacaaaaacatgaggcaattaggtgtgttttggacactaaccagagaaagtccttccttccctcccttcctccctccctccttccctccctctctcccttcctgccttccttccttcccccttccctccctccctttctccctccctaagctccctccctgcctctctttttctctctcatgttactttctctttctgtcttcctttttaatgccatggagtactatattcttcaaagttccaacaaagatgcactacatttggacaatgtggaaatggccctcagccttctcttcctgatgtggtcagcaaaaatctggactttacttcactctgatgctgaacaccctgctccacatcttccccagtatctcagatccccaagctgtctggtttgcttctaggaaagctcagcaattccctgaaaagagtgtggcccaagtgactgcttccctccaccagtgtggcccgtggggaaggctgtggctgggtgaccccaagggtgggtacatgaggccatatttacttagcccttggccttacaggactgtgtcaaggggtcagtagtccttgctttgagtctggttatggttttgcagcctcagcatcagcgtgggcaggcccttttcaacagcagtgccctggctaatccttttctttttccccacagccaattccactgatcctgtgaaggctgcccaatttgagatgagtaatcccagccatctccttttcttcctgccttgtcccttctctcctgtttcctctctttttgcctttgttaatgcaaaattaaaatggagactgggcctgaaaactcctgagcaaacaaagccacccgggccttagaaatagccttatcattgcttaaactgcaaacataagtgaaactcaagttggattgtaactaaaaataggtaatacttaacttggatcatttctggtaaatatttatgttagacagaaataagatttaaccctagccaatcgtaagcagccaactaacataattatgtgactaagaacacttcaataaggtacctcacccaaaagacaattatgtaactgcaaacctatcaaatttctttattttacttccacattttcccaattaatacctgtctctgactttctgtcattaaaacattagacctcttttggtttggtgtcacccaattcatgaattgcttcttactcaaatgaactctttaaaattgtattgtgccttagatttttctttaacagtttggtgtcagaagtaggatataaagtagaatctcccccaaagatccctaagagcaatgggtgaccaggcataggtacccattaagcccattgtgttcactggtttcttcctgcatttgtgagtcactaggtaagtccctctcagatatcaggcttgcaacttgtgtcctgagctctctgagtttatttgagtaattttatttctcatttgattcagcggttaatctgggtatttgacaagttcatctgtttccaacaggaactatactaggtccagtatagtgtactagtttccagacaaggtctgatttctggattgggatccagaggtcaaattgggtacttgacagattgaactaggtgttcaacagaaactgaactgggggtccagttgcagtcctcaggtaggtaaatttcagaagggcaagatattatggctttgtcagaatgtacagagtctgggactcctccatctgaaacacagtgatttctatgttcagataatatgggcccagaacctgtgactttctagagaaataggtgtgccttacctattgagccttaccagagatgacttaaagttgcaatggtcacagtgaggatatttaaatctagaaaaaattgttcatttaagggatgtattgggaaaaaatgagatcccaaatgtctcagaaacaatgataaataattttgattggtatgtaaaggtttctaaaagaatgatttaaaaaaatagtctctctaagtaaatctttacaatgtgctaataagaaagtattctaaacctattaacctctttgattgcttgctttttccatctgaacctactcaatgctaacctccttaaaaaattagatcctcaaatgagccaggagtatctacaacaactaaatttaactcttgttattgcacacatgaactattataaaagcaaccactaaggctaaaaataataaaaactaactggaaataggccagataaactagatgtctccttagtcactcatttaaaatttaatccagtctcaataagattgactcctaataataggtgaaaatgccccaaaactccttcttggagaagcttcgtaccctttctccgggcctttgaattgtgtaaatgtttttaaaacacaagcttcagcgaaatgactcatcaaaaagaaagaaggaggaattttttagaaacaaactggcaaatgaaaaatcttaatagtcctctccacaaatatcaataaaaagtgtcagccatctgaacagctaactttaactagaggctagatccaactaattagttttatattattatacctggcacatggctaaaatttcagaacaaaagccatgaatttctgtttgcatctttctgtatgtttacatatatctacacatgtgtatgctatttgtacatattattctatctccagatggtatttattagaaacagtattaaaggagctcaactggcctagagaaaaataagcacttatataaattacatattttctcagaagaaaagaactttgccaaaatgcttttcaacttcatatgacctgagtaatcttttataaataagaatattggcattaatgaaagtgaatattctacctagttttacccaaataagctcatgttgtctgctatacaatttgtcaaaaaaataccttgagatgacaggtagttggttttgttaatattatgtttgccactttaactatgttaaatgaaatgacaggtattcattaaatatctacaccatttccagataagacaaactactaaaacaaaaataaaaaagtgttccacttatctttttctctctacctgattgtttcagaatttggaaactcttattaagtatttttattttcaatctgggtgtttgcataggttcaataagaatctattctccttatgacaggacataattgggcaagtccttggcttggcttcttagcctagagaggcttttaaaggtctaatctgagatttctcaattactagatagtttttaaaaactaaagttgactgataacaaagtcagtaaagtctcttggatatcaccaaagctgtggctaaaatatattttaaaattactgtttttattatacctatataaataatcaggtcaaaattaatgaaactagatttatttttgcaaaaaagtcaactttgatttttggtaaaaatggaaaataaaaatatttttctccagaataaaaaagattatattttagtagaaaactattgtgcatccattgtcaaattctaggcctgttcattttctttgaagttttattatctccctataaaccagattgactcctgaatttttgttttttagttccactagaaactaaaactgcccttttccaaagctctgcaaactgaaactggtgactttaagcttcagaaaaatcactgcaacagagcacttatgccttaatgccaatcttaatgcctgctgctatctgggtcactcagagagtttaccagaatgtttaatgaaataaccagagacattcaaattgcaaaccagtaaagcacatcacattgcaactgctatcttcagtctaccatttaaacttgcctcaaactcacctctagaaattgtttcacctagctgccctctaaactcaaaaactaagatcataatttgctccaaatattaactttgtttttttaatagaagaatactctgaattcctttcaagcaatacaatctaaaatgagcaagttagcctcaatagcaccccaaaatagaagttcttggtatcttaacagcttaacaaggaggagcttgtgttcctactgatgtcaaaagaaatgcttaaagatctcagttggctttatggtgattctagaactgggcaatacttgccaccttaaattagaataaggtttccaatgagttacagcagaggagattggcttcatagacagaaaaaggtctgaagaaagcagaaacaaagaatttaaagtggattggctattttaaagctggttaaagttgcaaaagacaggaatagggaaacagaataataaataactggttggttaacatcaggttactcttttgtaaggatgccaattgaaactggcctgtttggaaaattagatttttaggttattaggttattatctctctctcctgatttttccaaaggccagataagaatgtagtttctgtttggtgacttgaaactttatcgtgggtgattccattttgaattttagtctgttctgtttgggcctagtgcaggagcttagtgcaaaacaatagcctcctaaaatttaaaagactttaaagaacatacatgagtttttcatcagataatatttatttgtattcattaatttatttgattggttaagtcttggctcccgagaatctttgctcagaggaatttttcaatccttggctattattctccttatagttattgtatttacctccccggtgtattgaattatcctatgggttttaaatgctttcctgcacccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcacactctcagcttgctgagtggatgacaaaaagaggggaattgttaaaggaaaatttaaatggagactggaaaaattcctgagcaaacaaaaccacctggcccttagaaatagctttaactttgcttaaactacaaacacaagcaaaacttcacggggtcatactacatacaagcataagcaaaacttaacttggatgatttctggtaaatgcttatgttagaaataagacaaccccagccaatcacaagcagcctactaacatataattaggtgactagggactttctaagaagatacctacccccaaaaaacaattatgtaattgaaaacccatcgattgcctttattttgcttccacattttcccaataaatacttgcctgtgacattttgccactggaacactaaacttcatgaattgcgcctcagatttttcctttaacatcttttttttttgacagtctcaatctgttacccaggctggagtgtagtggtgctatcttggctcactgcaaacccgcctcccaggtttaagcgattctcatgcctcagcctcccagtagctgggattacaggcatgtgccgtcataaccagctaatttttgtattttttatttttttttttagtagagacggggtttcgcaatgttggccaggccgatctcgaacttctggcctctagcgatctgcccgcctcggcctcccaaagtgctgggatgaccagcatcagccccaatgcccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggtctaaattccccttgaggaagacgaagggatgctgcagttccaaaagagaaggactcttccagagtcatctacctgagtcccgatgctccctgtcctgaaaaccacagacaatatggtcccaaatgactgactgcaccttctgtgcctcagccattcttgacatcaagaatcttctgttccacatccacacagccaatacaattaatcaaaccactgttatgaaaagatgtagcaacatgagaaatgcttatgttacaggttacatgagaacaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaacattctgtttaccttttcagggctgtattgattggggtgtagactgaactatccggggtctgtttcttttcggtgatgaaagtcttgagaaggtagtaatggataagatgtgaaggagaggagagatggagatttggagtgtagggtgagtgcccctcttcttaaaactgaatactcttcttctaatgaacttgtattcttgtttccatgtcttcttgcctttccttctatggcaaataaaacactcactttgttttggaacacaagttctcagaaaggcaaactttaggtgaatcgtcagtggagactgctgacttcctgcactgctattttcccagtgcagttaccagaaggatgtgaccttctcagagaagtcattccaggcagattagaaacatgacccacagtctccttgatggtttggtgagtgcccttaaagagccttccattttcctgggacacagcatcactgtgcacaattcttgcatttgaaaagtagcagctttctctgttggatagtttacatcgatttttaaggaggctatggagcttccacccacccttccaaactctatgtattagtctgtctctatgtattagtgtgttctcatgctgctatgaagaaatacctgagactgggttattcatgaagaaaagagggttaattggctcacagttcctcatcgctggggaggcctcaggaaacttacaatcacagcagaaggcaaaggagaagcagtcaccttctgcacatgatggcaggacagagtgagtgcaagcagggaaggtgccagacacttataaaaccctaagctctcgtgagactcactcactattatgagaacagcatggggaaaccgtcgccatgacccagttacctccacctggtcccacttttgacagatggggattatgaggatgacaactcaagatgagactttgggtggagacagagccaaaccatatcaccctagacagaggctcctcaaatatgtaaagccttgttaaatcctgcttttacattaaaatgcacccaacaatctgactgcttctcagtattctactcctaccaccctggtccaagccaccatcatttctcacttggattactgcaatagcctcctgactggcctccctgcactcacccttgccatcctatagtctattctcaccacaacagctattgtgatcttttaaaaatgtgtcatatttgtcacttcttttccccaaatcatatactatcttctccttgtgcttggagtaaaggctagagcttttgcaatattctacaagatgctacaggatcttgctcttcactctctctgacctcatctcctactgctttttcttgcttgctgttggtcactcttgctcttccttgaacgtgccaattatacttctgcccagagcctatgttatttcctgtttctggaatgttctttctcatagacccacattatgcctcattatgtcctttaggtctttactcacatgtcaccttatcagtgaggtctccttgatcattcggtataacccgtcgccctcccatactcttaatgtccctttccttcttcatttttctccattgtgcttattactactgatgtactattaatatatgtttactgtttgttttgtgtctgacttccccactcctctcattagaatgcgagctccaggagaggtctttgtctgttttgttcactaccacatactcagagcccaggtcagtgtctggtgcatggtaaagggcttaataaatatgtgtggaatgagtaaattctttgacgtttgaaatcagagactttaaactggaaagtccttagaaacaatgtagtccaatctcttcattttaaaacggaggaagctgtggcccagacaggtgaaatgacttgttcaaggacaaacaggtagtggatgtcactgacctttatatatatatagtttggattatactataacttttgttctatagtgaaatggtttggctatgtccccacccaaatatcatcttgaattcccacaacacatgggagggacccagtggaaggtaactgaatcatggggcaggtctttcccatgctgttcttgtgatagtgaataagtctcatgagatctgatggttttaaaaaggggagtttccctgcacaagctctctcttctcttgtttgccaccatgtgagacatgactttcaccttttgccatgattgtgaggcctccccagccacgtggaactgtaagtccattaaacctctttcttttgtaaattgccccgtctcaggtacgtctttattagcagtgtgagaatgggctaacacatacaacttgctttttttttgtactcaatattgagtcgtgagctttgcaccactttacaatgtctatttaagtcattactttaaggtcgattctatttttaaagctactctaactaagctactaaacataagtggatatatttaagtgtatgtataaaatttatactaggccagctgcggtggctcatgcctgcaatcccaaagctgtggaaggtagaggtgggattgattgaggccacgagttcaaggctgcagtgagctgtgattgcatcactgtactccagcctgagggacagagcaggaaccagaaaaaaataaaataaaaagaaacaaacaaaaaaacccccaataaccctgcagtggctcttttacaaaaaacaaacaaacaaaaccaaaactgtactgcatgcataagctcccctatgctatgtttgaaccactctgaagagatcaattaaaaggaagtgagtgacattgggagcatgcctctgtgatgctgtggtaacattcataggctgcgttagggctatgcctgtaactcttggagatgagtgggtaagtggggttttgaggtggctgggggctggaagagaaggttggaggagcccacacaagacagtcccttaacacgccggggcacagaaccccaggctgggccaacttttccctgctgaggtgaagacccatctcttgcaggccgtcggcaaacgtcttgactctggcatccaggtgtgaccagcttagaccctgagagtgagtgaatttaaagctgacagcttctttcccttttggaattatgaaataggttacttcttttcaaggacagtttgattttccactgtggaagtcatatattgcacatttctttaaacattcccttttttcctgaactgatcaccttaccagtacagctgatctctcaagcagcaatctctaccagctgtcactggtgctctcggagagaggattaaccaagaaacccagcccaggaacagtactgacctctacttctggactcctgcctccctcttaaaaagtcccttgaacttcctagtgggttctaacctgtcaaaggagaaaatagccacctatggagtaagggtttttagtttctctttttacaaatggaagtttcctttgaatcaggcaagtaacgttaaatagaagccaacttttaagtttctccttataacacactgctaaattataacaccagactgtaccacatactctccagctgccagctattgcagttgccatccttgttactatagtggtaagtatctctgcctgtcatgcatgagagagggggtcgattccctgacggggaggttacggaaaattgtgtggggattttgtcaaccttcaaaagtctcagaaatgtctccttgttttggctttcagcggaaatccgaacgccagaagatctgaatggaatgttctggattgaagaaagtgggaaatggcctcaattcacaaagtcacagcctgatagaaaccagtgtgactttactgcccagtgaacccatctcgtcctccagcctttaggaggtaggttggactggagcctgcagtagtttactctccacctgagtcctggtctccggctgggaacccacttaggccatagagaaaaacgcacactgtgcctctccaccgggcctctggagacgaggctcctcggggatacaaacagtggggagaacatgagggacatcctgaccgtacactgcgtcctcctttcccaggtgttgcgttctctcttgggttgagtggcgaggtctctcccgagtcccagggccacagtgcaatgtcacatctcctttgtggaaagtgactggtaaaagagaacaaaactggaggaacctaaagtcttcggccacctggtttaatttattcaagagtgattaatcctagatgagaaaaagaattgaaatggatcggaaaaaaccaagcgtgcattggccggtaatcggacgcgggcctcccgcgttgcgggcgagaagtctaccactacaccaccaatgctaatgtcgatgaaagagctgcagtgtcatctcttaaagctgattatctctggccattccttaaggaaacaggcactgtcttaaatcgtggtttgga

SEQ ID NO: 823 - DNA, 54703 bp, Homo sapiens
aggcgcgagcttcctgcgcctgctcagcagcctgaggccgcggccgggtgccctcctgccctcctggccatccagggattgggtgtcagtggcctgttgcacattgtcacttctacaagtgactaacaccgtcaggataatctaaaactacgaatactacctgactccacaagggtacggtgtattctccagttttagcatctgccttaaaaattacctcagagttaagcactgctggggacttatttctactcttggtaagtttggactaacttaaaaaaaaaaaaagagctgaccctattctggtctgcctctccgtccccacccccatccccgtccccatccccacccctatcccccactggcctcagactgaagacgaagggatcagtttgggtttactggcttcacatatattcaaattaacaacatgttttagtaatctaagggaaatagtaaaagagttaaaaaggatcgtggattaagacacgtcctcctcttatcgttttgcccaaacctggagtcctttgtattctttttcctgaagaattgctctcctgtttacccataagccaaatgtagaaaccaaagtcatgctagattgagccctttcagcgcccttccacatccagtcatcaccaattcgaggcagacctatcaccccgcttccccactaccgcagtccgagggtacttgcctcttgcctacaatattacaactctggtgtaaccacttagtggtttaagaatgtgggttgttaaatcagaattctgccacttattacttgtacgatcaaggacaagttacttaatctctatgggacccgatttcctcatttttaaaaatgtattcatttatgtacttactgagggttgactgtgtcctgggcactggggatacagaactgaaatacaaattaaattattcctagggacttatcattctagtgtgggagagaatctttaaacaagatttcaaaagcgaaacagatgttaaattgagttgagcaaccaggagaaaaataaagcaaggggaataggaaagtgcgaggcacttatacttgcctgaagacctgcaggaggtgagggagcaagccctgtggatatcatctataaagtggggataactattgctcattttagtgattaaatgagatgattgaaggaaactgcttagcggggagtaagggctttataaatttagtcagggattattcttttcctccttctgggcaatcactagtttcatttcccttcagatcacctttcaacgtttatactagaatgatgcttctactggcagaaagtttttcagcgggttccctttcccttcatggaaagctagcatgatgaaatagccctttctgatttggtccttgcctaccccaacagactggagccctgcatctacaggccataatctctgtaccagcattattgactacacacactatacagttgcctctccatatctgtgggtgccgcatacactgtggattcaaccaacctggagtaaaagatattcaagaaaaaaactgcatttgtactgaacatctacagactacccccccatgattattccctaaataatatagtacagccaactatttatttagcagttatgttgtgttattataagtaatctagaaatgattggaggtctgtgggaggatttaggatattctttaccagaatattgcatcatcttatataaggcacctgagcatgggtggatttcggtatccgcgggggccctggaaccagtcccctgtgaagactgagggacgactgtacatgccatgacatgctctcttcccatgctctcccctgcctttgcgtgtactgctgtctctgtctggaatgttttctcctgtcctttcatagacacagcaggctcctgctgttccttcatgtctcatttacacatgacctcttcgaaagcttcactgaattctgtgacctaagcaatttatcttttatgattcaattgcatttttgaaatagttttattgcagtataatttatgtcatatagttcagctatttgagatattcaattctgtggtttttagtatgtttgcaaagttgtgcaacaatcaccataatataactttagaacattcttgtaatctctaaaagaaaccttatacacattaccagtaactctccatttcccctcatagtcttggcagcccttggcaacaactgacctattttctacctctctatatttgcttattgtggacatttctttttgttctttctttgtttcttttctttctttttttgagatggggtcttgctctgttgcctaggctggtgtacagtggcatgatcatagctcactgcaaccttggactcctggcctcaagaaattctcccacctcccaaagtgctgggattacaggtgtgaaccaccatggccagcttggacattacatgtaaatagaatcatgatcttttgtgactgacttctttcactgaagataatgtttccaaggttcatcgatgttgtaacatgtatcagtacttcactcctttttatggccaaataatattccattgtatggctatagcacatcttattcatcagttgatgaacatttgtgtacaagtttttgtttgaactcaattcctttgggtatatacctagcagtggaattgctgatcataaggcaactttatgtttgacgttttgaggaactctcacactaatttccaaagtgaatgcactatttcccatcctattagcaatgtgtagaggttccaatttcttcccatccttgccaatacttttattttctgtcttttaatcttatctgtcctagtgggtgtgaagtaatatctcattgtgattttgctttgcatttccctgagcactaatgatattgactactagccttatcaggtgctcagaagccatctgtatatctttttttgtagaaatgtctattcaaatcctttatcatttctaagttggattaattttttaaagtttattgagttgtaagggtttaaaaatatctattctatatgtccatgttgttctgtaatttattttaaaaaataaaagatagattctagatcttagcagatatatgatttgaaaatattttctttcagtctgtctttttactttcttgatggttttctttgaagcacaaaagtttttaattcagcaaagtccaacttacctgttttctctttaatcacttgctattgttgtcctatataagaaatcagtgcctaacccaagattccaaagatttactcctgtgttttcttctaagagttttatggttttagctcttacacttgggtctatgaggactcacttgtattttgtacataatttcattttagcaataatcatactatcttctattgtttgcaagtctgtcttcccactagactggtactcctcaggaactgggagttgtttcatttttccagctcctactacctggtgctatactgtcaaatatttagtggtcattatttattgagggaatgaaaagaaaaaatacctcacataaatgagaataaaaccttaagatagtttaaccaagaaacaaacataaaaatgatatatggctctacaaagttactcattttaaatatatttaaagaagacttgcaatgcaccaagcaagtcctgagttgtaggatataattattaacaagacagatttagtctttgttcttgaaacgcatacctggaatagaagacagacagtaaacaatgaccaatgtgatggatatttacaaagagacagtgcaaggtgcagtagaagtgttctaggtcatttggaaatgaattgctctactaatgtcagtttttaaactgaaattggtcctttcaaaccttagaatctggtgatttttcactcctttgtgagaagaccacattggtcttctttcagctgcttaaacatatcatactctggccagccataggacttgagatgaccattgggtttttgttgttgttgtttgtttgtttgtttttgagatggaatctcgctctgttgcccaggctggagtgcagtggcacgatctcagctcactgcaacctctgcctcccaggttcaagtgattctcctgcctcaacctcctgagtagctgggattacaggcacgtgccaccaggcctggctaatttttgtattttagtagagatggggtttcaccatgttggtcaggctggtctcgaactcctgaccttgtgatccactcgccttaggctcccaaagtgctgggattacaggtgtgagccattgcgcctagtgaccactgggtttggtaagatggaggttgtgtggttatgttagtttgggttgtccaggaaatagatgccaagaaggagttagaagcataagagacttattggcaataacatttgtgaaaattaaaggggaggggagttaacagggaaaagcttcaggctgtaatgtagatctgatccctgtgaaaggaaggaagaaggatcaggcaggaagagcctcagactgaggtgcagctgagaaagttttggccagccttgtgtgtagagctccagcacagagacttcccattgaggatttccacattggatggagatgatgagtccttggaccgcgacagtgccctgtcatgcactgtgggctcctaccctgcactcttgctatcttccacagaaggtcctggcttctgtcaggagaccctctctccacaaatctctcttgggctttggtaattatctgtcttgctccttcagggaccctattgtttatagccttggggtactgcagtatcatttgccgtttccttacccgaacccacacgcttgaagagagtgcctttatacaaatttccccaaatcatccaatttaaacatgccatttgcttctgctaggaccctgactcttatggagtcactagtgacctttaagacagtattttctttggaaatggtagaaacaaatggctgactggagtgggttcaagagagaatgggaaatggcaagatggaggcatgagtataagcaactcatttgaggggatttccctgcaagggaaggcggagtaatgggcacgtggtgaagagaggtgtagggaagggttttgcttttctttttggatgagctatattatgatgtatttgcatgcagatgagaatgatctataagaaagatttattctacaggagttgcttgcagaagcaaagtccttgagcagctcagagttgatggcatgtagtgcacagctgaccacagtgacaagatagggtgcccacagcaaccagatagagggcagaatttaggggtaggctgataatggcaagatgaagttgtctgcttctgattgtttctgctttctcagtaaaataggaaacaaaatcatcaggagtggagatagtgtgatgacatttgagaagagaatggaggaaaactgtggagggtgagtagattaaagggatgtaatcagacagcagggcccacttgagatttggggccatacatttaaagcgagactagtaagcagagccacataattttctccaggcatatctccctgtttggatacaggtatggagaaggcagaattgggctttgccaggccagtatgacaaaggatgtggaggatgtgcaagggtgagggcaggggtgatgaagtgaaggccatgaggtggtggtcatgcttgttatactgtcaccctctgccctgagagtccacccttttctgctgtgaaaggcaaatgtctgcagactgcagtactggggctccctcgcccttgacttcccattggaatgggactggaagtctgtggaagacactagccaaaaaacagagggtttggggatttctttatactcccatcatccctccttgccttactatggttccaacagtgactatgtttgttctcctgtggccactgcctgtgtcaggtagcttttctgttactgtttcagctctaagtgggctccagggacctcattctctcccccgccgcttcaggctgttggttgtaatagcttcccatgctcttactccccgcatacttcaccatcccttgttggttcattcaacctgctactcctctgtgaataagcccttcattaagtgctctccagctaaattcttttgaatgggccatctattccttgccagttctctgacagagacagaggacagagaaatagtgctagggcctctgaattggaggcacctatggggctgaagaattgttgtggaggggggctggctgaggaggaagtggtgagagagtgggatgctggaaatgatttcagaggttgtgcagtcactggcaatgagatgcacagggtagaaaggtgggagtgggtagctgaggtgaatggaggaggagagctttgagagtgagaagtcaaggcagtaggaggctaaggtgctcagcacatggatgctaaatcaccaagaatgagtgaaggagaagaatggaaagggagccagtgagggagctgggcactaacatctgctgcaaatgaggaagagcctgagaggatggcagatgattgccacaggagggtagtgggtggtgtagtttcagggcatggacttccagaaaagctggggtttttgagcaagggaggagaattgtctgtcagcagcaatgaggaccatgaaagacacccattccacccctaggctctgtggtatgtggtgcgtgggagggaagaaacagccacctcttgagaaggctccagggaagcaggtttcagttttcagttagagctgcctccaggtttctgagcgagaaggtgaagaaaacattcagaaagaggcagagggtgttggggatttggtagatggcacacctggagctttgggggatacactgcaagagtttgggggctgcgaaggggcttttggcttaagcaaaataaaaggatgaatagagctttgtggggaggagattgtggtgatgatggataacaatggaggtttgactctggaggtgactaaggtggaaagagttttgaagcattacagaatgatcctgaggtcttttaggggaatgtggaggtttaataataattttagcttcttttttaggattagcctcttaagtttatagtgaaaggtggctgccattaaattctccaagcgtaggtcatggtggtggggaaagtggtcctaccaagacacatgggctctggaggcctcccttagcagatttttcgttttgttttgttttagaatggggaccaggctggtctcagaatcctggcctcaagcaatcctcttgccttggcatcccaaaatgctgggattacagggatgagctatcccaccagggacccctcaggcagattgatttcttatgtgtgttcagctctggaggccacattccaagtaagttaagactttggcaaacatagcctggatcctaaaattctcaggattcttttaatgactgtaggacagaaggcagctttttgggattagatctatccaggaaaatttgtggtacaaggttgctgtaattatgagaaatataaaagaacagaaatatgatctttgccctcaatgaggttgtgtttatgtggccttacaagacatgtataagaatgaaaaacctgttctgagatgatgtgaaagtaggtacaagaaattacctaatagaaataagttagaactaaaatgggactgtttgatttcaacctctccttggggacaaattgatgaaaagtaagaaacgaatgtttgttacatgcttattaaattccaggcattttgcctttacatatatcatttggtcttcacataaatcttataaaataggtgttgttgtctttatttaaagacagagaagctgaggctcagagatgttaagtaatttgcccaaggtcataggtccaggtatctgtatgcctgccaaacccattctttttgatgttttttgagacagggcctcgctatgttgtctaggctggccttaaactcttgggctcaagagaacctcccaagtagctggaactacaagtgtgcatcgctgtgcagcaaagaaacccattcttgtctcatgtaaacagtcctgcagggtctgtacttgccaggaagactctgactcttcagagagcagtgattctcaatcttatctcattgctgatctattcaagagactggttgctgcctatgtagaaacacaaagcccatgaaaaagaccccaacagatcatttttctgtttacatgctattgttatatcatttacagtgagtttaaaaatataaaatcgtactcatctggtgagaaggaaattgtattttcatgaggaagcaaaaccacttcattaatacttggaaattatatgatttccttgagtatacacttcgctgctatggaaacgagaaaacaaatttataaaacagtgttgctactagtatgtaagactggcaggagatggcatgtcacatttagaggtagatctggcaattcggagagagctggttggtaatggctacgaagattctgtgacccatctgaccactacttaggtgtctctctaggggtagaatgtaatcctgtgacctatagaagcttaaggagcccaagcacaaggtggactttctcaccctatttaaccaagcacatcagggcctgagtactacttctctgatgaaagagagcccagtttcagtaagtggtgaatgcaaagtgaaaaatggaaacaggaagtagagagaatattttcaagaagtttaactttgaaggggagaagagagcagggtgtgtaaataaagaggaataacggagtcaaggtaggttttgtttttgttttttgagtgatgtcacagttgagcatgtttattaatagatggtaaggaggggagagatgaacaggctgaagacagggggaagaggtgggcaaaatgatggacagaggtttctaaactttggaatccactagaactttacataggaagggacacttctttttacaccaaaaggatggaggtaggaggagaggctagtagagacagggcagtcacagaatgacagtggatgttcttccatgtggatggtgaactcaggaagggcactgcaaggagaactgtgagccaagtttctgttttgaattgttaaaaataaaaactacaggcaaaatacatttaacagagtttacttgaacattaaaggtttcacgaagtaggcagcactcaaaaccagaagaggttcacagaattgtgtttcagccgtgtgagcagcaggcttttataggctgaacaagtaaagaaattacttggctaggcacagtggctcacacctgtaatctcagcactctgggaggctgaggtgggcggatcacctgaggtcaggagttcgagaccagcctggccaacatggtgaaaccccatctctattaaaaatacaaagattagctgggcgtggtggagcgcatctgtaatcccagctactcaggaggctgaggcaggagaatcgcctgaacccaggaggcagaggttgcagtgagccaggattgtgtcacagcactccagcctgggtgacagagtgagactctgtctaaaaaaaaaaaaaaaagaattacttgattgggtccagctaaacatttcccttatttgggtacaatctgttggaagtccttagaggtaagttggtggtttgtgattggttaagcttaagtgtctgtttactgtttctattgaattgggttttagtttgtttgtgtaggagcctaaggtgttcattggccttatgactgcccaattacttatttttttttttaattttatttatttatttttgagacagagtcttgctctgttgcccaggctggagtgcaatggtgtgatctcggcttactgcaacctccgcctcccaggttcaagcgattctcctgcctcagtcacccgagtggttgggattacaggttcccaccaccatgcccagctaatttttatatttttagtagagacagggttttgccatgttggtcagactggtctcgaactcctgacctcaggtgatccacccacctcggtcttccaaagtgctgggatcacaggtgtgagccagcgcactcagccaattacttattttaacagaatgaatgagtggagagtagcagtaataagggcccaaggaaatatgtcagcaggaacagggttttttcaggcatagggggcagtgaatggtttggagagggagaaggctattagccccacctcaagacatacaaagtttgacagaggaaagatgttcatttaagagggctgaaagggattggtgttttgaggggagagcctggtatatagttaaagcaactggtgagagggaatgtttggtgcagtggcagaagttgtaggaagtttatttataatggaatgaattatattagttataactcttttagttgcaagtgactgaaatgggaatatagtgaaccaaaagttaagagagtcaaaagaaaagcttcaggagccagggtgcattgtggatcttaggaaatagaaccaggcacttgacttcattagattctctctctacctttctctctctctttatttttcttttgtcttctgtttcagcttggcttcactttttcctgttgtaaatggactttatttacatggcagagaacatggtcacttgctggttctatcagaacaattccaaggaaagacctaaagtaggctggtttaggttgcatgatcatttctgggtcaattattgtggcccatcttggccacatgcttttccttgtgggtagggttagtttagtaccagaaggtgtggaggaacaagtactagacaagtagaatcaccgttgatgtcctagagaacatggtgtaaaggatctggaggtacaggaacagtgcgaggtggttggatcagggaagaaaaatccaacagtaatgtgaatgttagtgaatgagaagaatggatggagtgacttgtatttgaggcaatggccaaggactgtgggcatatctagtagggtgatttctaaaataatttcagcaatcacagatagaggaaggacttcagtttgaatttgttgtactttcaagagggttctagttcttaggaacagacaggaaaatggtgacaggtaattggttcctgggaggctggcacattctggagacagcagcagtttctggggatgcttcataaggctattatgcactgacatctgccacggaccaccaagtagaacattttcacctgatgagaattaaacattgacaacatcattttgtgcaaaatgccttccccaaattagaaggacttatgcctcagggaatttgtgactgatggaactgaatagatatcttgtagccatcaaaaactggtgtgtggctcagtgcctagtagaacccaggtcttggggtgatggccaaggattctttggagctccttccttgcttgcatcagtccatgtgttccaagacaaagcttatggcacaaattaaaactataacatatacaattctttgcagttcccaaagcgcttttgatacacattactaattttaactttatataaatctagaacataatgttatccctgtttcaaatgaggagatagaggctcagaaaaataacttaaggttttacaactaagttttaactcccaggatgaagaatgtgaattttagcttataaaattatggtcagattatactaaagactaaatatggtactttgtggcaattaattggtataagtcaaagtgaaataatcataagggaatatgtgaatgtactgttaacaacatcaaaataaaattaatatttattggatgccaagcactatgcctaacactacaaactacttatttaatagtgacaacaactcattgagtcagatcctattaccattgcttttctacagatgaaggctgattagacaaatattactaaactgttaataccaccaccatgataaatggaaacaggaataggctgcatacagggaaatcaactaatagtagttgattttaattaggaaatgagcactaggctagggaaagaagagaaaggaataaatccttgagtctgtctaagacaaatgataggttttctccctgtgaagcaaaccacttttatttcttaggccatttatccctccttctgagtatcacttataccaatcagcattttctttggttttcgatctgccttcaaactacatcctcaaattgtagcataaatatttcccagttaagtggagtggggctaaaaagaaacaaaggtgacaaaggactaattcagcttgggacatgggagaatggtaatgccatttacccacatggtgtgtagggaaagggaggtaatcaggaaattgttcagtaagctgaaaagtttggttttaggtgcactgggtttcttcacatgcatgtctggtctttgggagacagccaaataaaggatccctacagacagcaaaagattcaggcctggggctttggtgagtgattcaagctaatcacacatttggaaattattcagcatggtggtaatgttaacaccaccaaaatggattagctcgttgatgtggtgaataaaaagaaagaacaatgcatttagtcttgggggtgtccatatgaaagaggcttaagggggatcaggaatttaattacgtatctgtcattttaatagcaaatttcagagtccttttcaaatgataagtttcccatagtctccataaaactgaatgaggaaatttttaaaagtccataatattcttttactctataatcctagtaacttatttattttaggcttaaatgctattgcaaggaatgtgctggtctaaaagacagtactattaggttatttcctcccattttgaaatgtattaaaaacatactaaatgagccaagtaatataatagggaaagaaatggagaataattacattaaataactgaattccaagaataattgctgtaagactagcttccaggaagccaaggcaaaaagtgatcatggagaattaactagatattatcccatgtagagttttggaaacatggctaattatcagtatcacaagggctgtccctcaccaggagagtccagtgaatggtcttacagctgagaagctgtgttgttttaatttaaaagttccccaggaaattctgagaattaatcagatttgacaagcactactctaataaaggaaacatagaagttcacaggagagacaaactttttttctagctctgaaatcagaaagagattttgttccattgacattgaagaacattcgataataaaacagacaatgtcctcaatggaatttaaaaaaaacaggtaagattttatctgtctattttttttatttttaatagagacaaagtcttggtgtcacctgggctggagttcagtgatgctagttgtggctcactgtagcaaactcctgggctgaagtgatcctcctgcctccgcctcccaagtagttaggactacaggtgtgcaccaccatgcccagctaattgtgcctggctaatttttaacttttttgtagagaccagtatcgcaatgttgtccaagctagtcttgaattcctggcctcaagccaacctcctgccttttgcctcctaaaggtctgggattgcaggtgtgtaccaccacactcagacttatatgtctgtgtctttatactgacttttgacaaaataaaagccaccaacataatattaaattacaattctgttgctgtagtaaaagaatcatctgggccagttgaaaaaactgtactcctttggggcccagaaatttgcatttgtaataagccaccaattgacagtgatacaaatggtccaggaacgcatttttacactgagagaatggatggttaacaacagtccttagcattttaggtttagatatcaaatgttaaggtataccatttgtaatagacattttcaccatttttgaaaactgaagcagggttaatctacttctataagctgggaagacttctgtggtataaaaccagaacacttctggtaaaacttttcttcaacactcaggaaaatattaaaagcatgggttgctttatatgccactagagtagatattagtctcactctaaaaagaagaaattcatactcaatggattaaaaccttttaaaatcatgggataaaacatgggaaaacaaatttactagtcttttggtagagatgcactttactcaaaacattaaagagccaaagacatcactgtgttaatacaaccatatgtaatataaggtcatatatatggtcctgaattgctgcaacccaacatatttggaaacatctgatttgtagcaacacgattttcaagattggtctttattttcaaatacatcaggaaaaaatattcttaaggggagtgcttctttgtggtcatagtcatctcatacttcttaaaaacactagtaaaaataagtaggggagtctgccatataaatgttgcattcctacagatttagtagtaacttgaccacacacagagaaaatgtggtgttggctgaagactgagggatagaggcagggtcctttttctctttactagttatcgaatctagttactagttactgaatcctaaattcaagtcaactctcagtgagagaaacttgaactatcatagattttttaatactctaatatattgtgactaaaaaacaaaggtgggatctaccatagacatataaatagcaccctgctggattcaggtaactttggatctagttccctttagatggttttcatactgcagtaaaggtcatagaagtctgaatccagttcaccttaattctctaggtcctttagtctagatactaagtgcaggatttctttttagggaaaactttgtacttcagaatagcatccatgaaataatatgaatttgaaaattcctatttttaaacctaagtgagcaataaataagcatgtacctttcgttgtttccaattcctgatagcttttgcaggataaaaattctagggcaaaaatgcttattccactgaactaaaaagttggaacccatccattgcatactatcagtattttgacattaaaaatttaaatttttaccaaactaataaatagacgtaatttaaatattaaatagtaacagcaggaaaaacatttctccattctctctcctcccagtcccacacttcccaaaggcaatgactaaactcttttagacatttttttctagtattaaccaataaaacacttctactacttcttgatttgccaattttaggctttattgactttctattatcataggtgatgatttagtattcttaacttcccacttcctatctcctgttatcctgtatcaccattttttggtcagtgtttacactatttcctaagaaaagatgcagaggcagaaagtatttcatgattatttccttccttgcactactttagttttctggaataaacaattgtctcatattttctacctgcgtagttttctatgaactcattatttcaattgttcatctagagctgttgtatgaccaccagcagtttttttttacccccagtgctcaactatatcagataatatattggttccatttttccccctggagatctctctctctgaagctcccccttcctcccgctccaatctggagaaggctctgggcacacctttgtcttataacttcctcttggcatttttctgtggtagatttactatttcaattttgtgttttccttttttcctatttttctagagtattatcatcctgcagttctctaaagagagttgcatggcagatacactttttgagtccttacattcacacataattaattggtcggttatacatttctaggatgcaaataatttctccctcagatttttaaaattcattagttatttgagatggggtcttgctatgttggccaggctggtctcaaactcctggcctcaagcaatcctcccatcttggcctcccaaagtgctgggattacaggtgtgagccactgcacccagccttccctcagatttttgaaggccttctgtcctaatacccattgagcactgaaaacgtcagtgccattttgatttgtgttcccttctaagtgattacaaatccctaatcctaccaccacacctacaacctacaatctcttaagagcttctccttatttctgatgttctgaaatttcacaatggtatgtcttggtttggattgttttatcttttttacgttgttggatattaagtagaccctttcaatttagactcatcttgcaggtctgggaaaatttcttatatttcttctttgataatttctgcctattttcagttctttttttggggggactcattacattaatattttactttcagcttgcctcctaaattcttctatcttttctattttccatttttgttttttgttgttctatttctaaaaaatttctcaactttgtttttcaaacttccatgtattttggttatatatgtttttattttccaaagttttttcatagagctatttttcttttcctttttttttccctttgagacaaagttccactctgttgcccaggtaggagtgcagtggcatgatcacagctcgctgtagcctcaaccttccaggctcaagggatcctcccaccttagcccccacagtagctgggattacaagagcgccatcatgcccacctaatttttttttttttaattttagtagagaggaggtctcactatgttgcccaggcttcttgtgaacttctgagctcaagtgatcctcctgcctgaccctcccaaagtgctggaattacaggtgtgagctaccatgcctagcctcttttactattatttgaatatatacctctatatacttattattttttattgggtctgggaaaggagtagcaataataataagcattatttcaaagaataatgcttaatgttttaaaaaactgtacataatgttaatggcttttaatgtggattgttggggattcagaatgtttaaaatttagcattatgagtaatttctctggataaaactggtaacaagcactttgttgataatttaatgttatatcatccaataatggacaaaataagcataagcagcacataaaatagagtcctcatttactactgttgaccttcctttttcagacacctcttttggctgataaacactactcccccagtgattgtcctgtgcttgattcaatctttctaatctttggcagcttcttttcctatatacggtagtcctcccttaactgttggggatacattccaagatccccagtggatacctgaaactgcataccaaatagcatcaaaccttatatatacattgctgtttttttcctatacatacatatatacatacctatgataaagtttaatttataaattaggcagagtaagagattaacaataataaagtagaacaattaaaacagtatcctgtaataaaagttatgtgaatgtggtctctctctctctcaagatatcttattgttctgtacttagctatttttggacccagttgactgtgggtaactgaaattgcagaaagtgaaactgcagataactggggactactgtatccaccccaaggttgtctacacacactcacccattgcttcaattgcaacctcagtgctgatgacttcccaatctctatctctaacccagacctctatcataaactcctcactgtagactagttctcactagttcccagtggtcatctacttccccattagattctatgagacagctcaggcctttaattttcattaaaatgttttattatttatactttaaataggcaatacattcaaataattcaattcctaaagatataaatgggtatactgtaaaatttccggtcctatcctccatcccttagccacttaaaagttctcctcctgggagggaaccaatgttattggtcttttaatatttttgatatctttccagagatacattctgcatacacaagtaagtccacttttatgtgccccctcccccactagtcactttaattccaaatttgttttaaaaggcaccaatgcaggtggaaccaagactttcacaaccaatatttctttttattattattattatactttaaggtctagggtccacgtgcacaacatgcaggtttgatacacaggtatacatgtgccatgttggtttgctgcacccatcaactcgtcatttacattaggtatatttcctaatgatatccctcccccagccacccaccccacaacaggccccagtatgtgatgttccctgccctgtgtccaattgttcagttgaacaattcccacctatgaatgagaacatgtggtgcttggttttctgtccttgtgatagtttgctgagaatgatggtttccagcctcattcatgtccctgcaaaggacatgaactcatccttttttatgactgcatagtattccatggtgtatatgtgccacattttcttaatccagtctatcattgatggacatctgggttggttccaagtctttgctattgtgaatagtactgcaataaacatatgtgtgcatgtgtctttatagtagaatgatttataatcctttgggtatatacccagtaatgggattgctgggtcaaatggtaattctaattctagatccttgagggatcgccacactgcctcccacaatggttgaactaatttacactcccacctacagtgtaaaagcattcctatttccccacatcctctccagcatctgttgtttcctgactttttaatgattgcctttctaactgacatgagatggtatctcattgtggttttgatttgcatttctctgatgaccagtgatgatgagcattttttcatttgtctgttggctgcatagatgtcttcttttgagaagtgtctgttcatgtcctttgcccactttttgatggggttgtttttttcttgtaaatttgagttatttgtagattctggatattcgccctttgtcagatgggtagattgcaaaaattttctccaattctgtaggttgtctggtcactctgatggtagtttcttttgctgtgcagaagctctttagtttaattagatcccatttgtctattttggcttttgttgccattgcttttggtgttttagtcatgaagtccttgcccatgcctatgtcctgaatggtattgcctaggttttcttctagggtttttatggttttaggtctaacatttatgtctttaatacattttgaattaatttttgtataaggtgtaaggaagggatcgagtttcagctttctacatatggctagccagttttcccagcaccatttattaaatagggaatcctttcctcatttcttgtttttgtcaggtttgtcaaagatcagatagttgtagatgtgcggcgttatttctgaggcctctgttctgttccattggtctatatatctgttttggtaccagtaccatgctgttttggttactgtagccttgcagtatagtttgaagtcaggtagcgtgatgcctccagctttgttcttttggcttaggattgtttggcaatgcaggctcttttttggttccatatgaactttagttttttccaattctgtgaagaaagtcattggtagcttgatggggatggcattgaatctataaattaccttgggcagtatggccaattgcactatattgattcttcctatccatgagcatggaatgttcttccatttgttcatgttctcttttattttgttgagcagtggtttgtagttctccttgaagaggtccttcacgtcccttgtaagttggattgctaggtattttattctctttgtagtgattgtgaacgggagttcacccatgatttggctctctgtctgttactcatgtataggaatgcttgtgttttttgcacattaaattttgtatcctgaaactttgctgaagttgcttatcagcttaaggagattctgggctgagatgatggggttttctaaatatacaatcatgtcatctgcaaacagggacaatttgacttcctcttttgctaactgaataccctttatttctttctcttgcctgattgccttggccagaacttccaacactatgttgaatagaagtggtgagagagggcatccttgtcttgtgccggttttcaaaggtaatgcttccagtttttgcccattcagtatgatattggctgtgggtttgtcataaatagctcttattattttgacatatgttctctcaatacctagtttattgagagtttttagcatgaagggctgttgaattttattgaaggtcttttctgcatctattgagacaatcatgtggttttcgtcgttggttctgtttatgtgatggattatgtttattgatttgtatatgttgaactagccttccatcccagggatgaagccgacctgatcatggtggataagctttttgatgtgctgctggattcagttttccagtattttattaaggatttttgcatcgatgttcatcagggatattggtctaaaattctctgtttttattgtgtctctgccaggctttggtatcaggatgatgctggccttataaaatgagttagggaggattccctctttttctattgattggaatagtttcagaaggaatggtaccagctcctctttgtacctctggtggaatttggctgtgaatccatctggtcctggactttttttggttggtaggctgttaattattgcctcaatttcagagcctgttattgatctattcagagattcaacttcttcctggttttgtcttgggagagtgtatgtgtccaggaatttatccatttcttctagattttctagtttatttgtgtagaggtgtttatagtattctctgatggtagtttgtatttctgtgggattggtggtgatatcccctttatcattttttattgtgtctatttgattcttctctcttttcttctttattagtcttgctagcggtctatcaattttgttgatgttttcaaaaaaccagctcctggattcattgattttttgaaagtttttttgtgtcactatctctttcagttctgctctgatcttagttatttcttgccttctgctagtttttgaatgtgtttgctcttgcttctctaattcttataattgtgatgttagggtgtcaattttagatctttcctgctttctcttgtgggcatttagtgctataaatttccctctacacactgctttaaatgtgtcccagagattccagtacattgtgtctttgttctcattggtttcaaagaacatctttatttctgccttcatttcgttatttacccagtagtcattcaggagcaagttgttcagtttccatgtagttgagcggttttgagtgagtttcttaatcttgagttctaatttgattgcactgtcgtctgagagacagtttgttgtgatatctgttcttttacatttgctgaggggtgctttacttccaattatgtggtcaattttggaataagtgtgatgtggtgctgagaagaatgtatattctgttgatttggggtggagagttttgtagatgtctattaggtctgcttggtgcagagctgagttcaattcctggatatccttgttaattttctgactaattgatctaatattgacagtggggtgttaaagtctcccattattattgtgtgggagtctaagtctctttttaggtctctaagaacttgttttatgaatctgggtgctcctgtattgggtgcatatatatttaggatagttagttcttcttgttgaattgatccctttgccattatgtaatggccttctttatttcttggggaagttctcctggataatatcctgaagactgttttccaacttggttccattctccccatcactttcaggtacaccaaggaaacgtagatttggtcttttcacatagtcctttatttcttggaggctttgttcatttctttttacttttttctctaacattgtcttctcgctttatttcattaatttggtcttcaatcactgatactctttcttccatatgatcgaattgactattgaagcttgtgcatgtgtcacgatgttctcttgccatggttttcagctccatcaggtcatttaaggtcttctctacactgtttattctagttaggcattcgtctaaccttttttcaaggtttataacttccttgcgatgggttcgaacatgttcatttagctcagagaagtttgttattaccgaccttctgaagcctacttctgtcaactcgtcaaagtcattctctgcccagctttgttccattgctggcaaggagctgtgatccttgggaggagaagaggtgctctgatttttagaattttcagcttttctgctctggtttctccccatctttgtggttttatctccctttggtctttgatgttggtgacctgcagatggggttttggtgtagatgtcttttttgtttatgttgatgctattcctttctgttttttagttttccttctaacaggtccctcagctgtaggtctgttggagtttgctggaggtccactccagatgctgtttgcctgggtatcagcagtggaggctgcagaacagcaaatattgcagaacagtaaatattgctgcctgatccttccctctggaagcttcgtcccagaaggccacctgcctatatgaggtatctgtcggcccctactgggacgtgtctcccagttaggctacatgggggtctgggatccacttgaggaggcagtctgtccattctcagagctcacacgccatgttgggagaaccactgctctcttcagagctgtcagagctgcagacgtttaagtctgcagaagttgtttgctgccttttgttcagctaagccctgcccatagaggtggagtctagaggcagtaggccttgctgagctgcggtgggctctgcacagttcgagcttcctggccgctttgtttacctactcaagcctcagcaatggtggatgcccctcccccagccaggctgctgccttgcagtttgatctcagactgctgtgcaagcagtgagcaaggctccgtgggcgtgggacccactgagccaggcacaggagagaatctccttgtctggtggttgctaagaccttgggaaaattgctgtatttgggtgggagtgtcccatttttccaggtacagtctgtcacggcttcctttggctaggaaagggaaattctccgaccccttgcacttcccgggtgaggcgacaccccaccctgcttcagcttgccctccgtgggcggcacccactgtccaaccagtcccagtgagatgaaccaggtacctcagttggaaatgcagaaatcacccgtcttctgcatcgatcacactgggagctgcagaccagagctgttcctattcggccatcttgggacagatcccccaatatttcaaatactgaacatatatcccctaacaaaacacttagtattggctgggtgtggtggctcgtgcctataatcctagtactttgggaggctgatgctggtggatagcttgagtctaggagttctagagcagcctgggcaacatggcaaaccccatctctattttttaaaataaaagttaaagcaaaagtatccttccaagcacccccaaaaatagaataggagggaaagactgataataatgagagttttccttctccaacattccctgaaaattggcggcaggtctcattttgatgtgttgtgtttataagcacagactttggagggggcactgataaacagcactggcagaaataagactatctgcccttgattcttttcacatgttctccaggattctaccttccctgctaccagccacttcactaactttttctggagagatgacttcaaaatactcaaagtcgcaagataaatacacagaaacgattaacgttgcacagagttgacccagtcattctgtaaattgctgcagaaaaattggatttatttattatatattttacacaaattagaaagaaagcaaagttatttagtaaggtaactatatttgtccagaatcttcctgtgacagtcttcttctgggaacagactttgctcactccagccacaggggtagctgggctaaatgcagtacctaatgtttccttgaccacagggactggtctaaggaatgggtaatgagccagtataaatcactgaattcttcccctagggtttttcatctcgaagctagacaaaccagctttttctgctggttatagagtggtgagaatatgagcctagaggccaggtatggtggctcatgactataatcccagcactgtgggagactgaagcaggaggattgcttgagctcagttcaagaccagcctgggcaacatggcaagactttatctttacaaaaaaaaatataaataaaaattagccaggcatggtagcctgcacctgtggtcccagctactggggaagttaaggcaggaggatcactcaagcccgggaggcagaggttgcagtgagccgtgtctgtggcactgcactccagcctgggtgatacagcaagatcctgtctccaaaaaaaaaaaaaaaaaaaaaaaaaaaataacatgagcccagagctcccataaccatgtccatgtccttcatcatgtgaagaacccagttgactgtggggtctcttacttgcaaagataaatagaggtgagaggtttggggttgtattgatgggatgtaaacatctgttcttgttcacaggcctggctctgctctacccttattcttctcaggttggttatatgtgccaaccaacttccccttttgcttaagcttgttgaaataagtttctgttacctgtaacaaaatatatcttatctgcttagctccagttccatatatctgagtgcctactaggtatctccctttggatgtttcctggtacttcaaacttgtatctgtagtaaaatgcatctttcttctcttctgtactctacctgtcccatttcctctattctctcaatctggttaccaacatctacccagccgcccaagccagaaatctatagctcttctagacttctctctttctgcctgatcccccatctctcaatatctaataggtttctaagtgctattcctcttcttaaatatttatcctatctcttatcccttattctagtatccttggtacctcttctgtttttttccttcccccactatactgaaaagaccaaatctcagagtgcttatgctccccactgcctctgttcaatggggtccctgtccccttctgataaaacttctcgtcccagatgattggtccagagcagtcagcataaaggctggtcagtaacatataagaaagtgtggcaagaaaattctctcaaacagagaacaaacacaccaatcagattgttttctatgaggagatcagtacccgagatacaaagagggctactcagttgccaaacagaggctgaagatatgcagagagaaggcagaggtgacgacaagcaggcttcggaaactcttgaataaacagaaaatgagtcagccaaaacttccgggtgttctgaacggaaggtaaagtgattgtctgaagtaatggaaatgaatagaggaatgaaatcaccataatagaagagggccaactcttgctgtgaggatacaactaaataacactagaattgccccagaacctgaactgctttccaattcctaaagtatatatactccaatctgtatgaagcatggctggatgacaatacgttgctttctgtgtgaattctgtgttcccatgagattcttgttatccctatggcctcaacacacaataccataaattctagttgtataaattagttccccaaccaaatgatgctctgccatatctgtttatatgcatacacgatttcctccagttagaacaattcctctcgtctcccatacaaatacccctaacttcgtctgcctaccatgtactcatcttttaagactgagctcagggtcctctaagcagctttctataactcagccaggttagctcctcttcctttactctagcacatggtaattgtatgtcttcataactaaaatatgagcttcttttgtttacctttgtatccccagggcctggcccagtacccaggacaaagcagacatttaatgaatgccattgttttggttaaagctctcagttgctagactctttccataaacaataaatgtactagccttccattatcacccctcttccaatatatctaattgcagcctgcagtatctgaagtgggccacagtactataaaaagacaataattccatggcttttacgtaagatttcctcagctcagaatgcccttctcacccctgttccccaatttcctccaagaatagaagtaggaagcccagaattgattgcactagttcaggcaagagaggaccatggcctggactaaggagtattggtggggtaagaggtagtgatacattctggaggtggaataggcattacatacttggtgaagatttggttataagaggaggaagagaggcatatcaagaatgaatcctagagtttgagaccagcctggccaacatggtgaaactaaaaatatagttctaataagaaccagttcagtttctactaaaaatacaaaaattagctggggctataatcccagcaattcgggaggctgaggcaggagaattgcttgaatccaggaggcagaggttgctgtgagctgaaatcgcaccaccgcactctagcctgggcaacacagtgagattctgttacaaaaaaaaaaaaaaagaataaatcctttggcctcagccttggctgcactgttggcttccctggttttgaggcttttggacttggaccgagccaggctaccggcttctcatttccccagcttgcagatagcctattgtgggattttgtcttgtaactgtgtaagccaattctccctaataacctcccttttatatatacagtaatattattattggttctgcccctctggagaaccctaacacagtatcattaagtgacatcaagtacattgacagtgttttgcaatcaccattaccacctatccccagaactcttttcatctacccaaactgcaaaacttcttacatgaaacactattttcccatttccccttcctcctattccctggtatccaccattcttctttctgtctgtatgaatttgactactctacgcacctcctataagtactattgtatagtatttatccttttgtgacaggctaatatcacttagcataatgtcttcaaggttcatctatgttgtagcccacgtcagaatttccctcctttttaagaagaactaatattctgctgtatgtgtataccacattttatttatccagtcatccttcaatggacatttaggttgcttccatcttttggctattgtgaataaagttgctgtgaacatggatgtacgaatgtctgtttaagtccctgcttttaattttttgggtatatagtcagaagataaattgctgatcatatggtaattctaaaggtttttttgaggaagtatcatactgttttccatagtggctacactattttatgttcctgtcagcaatgcacaagggttctaattcctccacattcttgccaacacttgttattttctgttttttttttttaatttttaatttttagtaacagctatcgtaatgggcctgaagtggtatctcagggttttaacatttatctaatgatgagtgatgatgaatatcttttcatgtgcttataggccacttgtatatcttttttggagaaatgtctactcaagttctttgtctatttttcaatcaggttgcttttgtttttgagtttataagttattttgtaataagaaccagttctaggaatacgggtctaggtcttcaaagcatgagaataagtgtattaggatggcatgaaaatgctagggaccttgggaaaagaggcagaaagaggtgaagctgccaaaggaaattaaaaaaattttaagtctggctgggtgtggtagctcatgcctatcatcccagcatgctgggaggctgaggcagggggactgcttgagcccaggagttcaagaccagcctaggcaacatagtgagattctgtctgtataaaaaataaaaacatcagccaggtgtggtgctatgtgcctgtagtcccagctattcaggaggctgaggtgggaggattgcttgaacctgggaggtagagactgcagtgagcggagattgtgcaattgcactccagcctgggtgacagagagagagagacactgtctcaaaagcaaacaaataaaacaaaaaaaaatttttaagtctcaatctttagggaagagtaaacaaaatacactcaggattctgggcttattttagtattgtagtttgagaactgtataagttaagtaagcattggtggactaccttgtgaacctaaccactatataagaacactacttatataaaaatataaaaaatgccctatcttataatcctttaatttaaatgtaaacttttggtacctaattcatgtataagctgatgactatttacatactaagatttaaacttggaaagtatgttggttgcattaatggattacagaaataattatttatcatataatactttaaattgggaatttaatatttttcaatcaccaaaaattcatttgcatgaatcatttgtggtataccagaataagaaaatacacatgatacagagttatggaaccaatagatagtcatgatatagttgatagaaacatcaagacaaagcaattatgtacagatagagacaagggttgaggaaagagtaaaggtgcatagaaatctgtgctgttaaataaagtagctatagaaaacagtataactgatcactagtaatagataactaacggccaaaaataatatcaactttaaattagataaattttattatttttaaagtaatcattttatttaatctattgaaaactgataaactattagattatgaatttttggtaaaacgttagaagacaaggttagagaaataacctatcatatggttgtatagtgtaatttacatattttagcataaatataacattattttaaagtatatctagggttatttttaatgttttatacttttatattctctataaaataacctatagttaagaaaacataccattctctgaaagcaaaataaaacaaagctttctttaatctgaaactaaagatgagctttccatttcttgtcaggatctgtgttgctaactgtaaaaagaaaatcagagagtaaaaatttaacaatagataagtaaatgcactgaattttaagttaccttgtggctagaaaaagcattcattcttaaaataattttgttgctcaatataaagttgggtatttttggtacatgtaaaaacattgctaaggcttctacatcaaattcaagcttagaattctggattttaaggattacatttctataaagattattagtttgacaaactaacactagaaaataattacataattactgctttgacatctctaagtttactacctttaccactgtttaaaacctttggctgttcccaaatctaccacatgtgaaattcttcgtggtttttgggtctgggagaagaaaagttatcttcctgctacatgtctttgattgccattctggtgggtaaggattggaattccaactgagattctaattcccctgggagcttttggttccagcttgtggtccactggccctgtgctactgaccttcctagcgcctgtctctccaacttaaagtgatattcatgggagaactctgatgggtattatttttcctcaaaggaaactaaggcatctgtaaaaatattttaaatgctggtaatagaagaaaatttggaagcatactcacatatttttccttctttttctagttttttcaaatgaagtaagagattatgtttagccatttcatgtaaattctcaggagtattctaaaagaaaaatgaaggtgaaaaaaattcctttttttttaaaaaaaagaacacagttaattttttgaaagctttgaagaaaagcaaaatgtagcaaaagtttatcttaaacacatttttttttttttttgagacagagtctcactctgtcgccaggctggaatgcagtggtgcatctcggctcactgcaacctccgcctcccaggttcaagcaattctcctgcctcagcctcccgagtagctgggactacaggcgagcaccaccacgcccagctaatttttgtacttttagtagagacggggtttcaccatgttggtcagaatggtctcgatctcttgaccttgtgatccacctgcctcggcctcccaaagtgctgggattacagacgtgagccactgcgcctggcctatcttaaacacatttttaacttgtttgacatttttaacaatttcactttgtatacatcttgttttatattctatatatactcctatagatagaataggttgtaagctccataaagacagtagcagtatctttttttttgagacagagtttcactcttgtcacctaggctggagtgcaatggcgcgatctcggctcactgcaacctccacctcccaggttcaaactattctcgtgcctcagcctcccgagtagctaggattacaggcgtgtgccaccatgcctcgctaatttttgtatttttagtagagatggggtttcaccatgttggccagactggtctcgaactcctgacctcgggtgatccgcccgcctcggcctcccaaagtgctgggattacaggcgtgagccaccatgcccggcctggcagcagtatctgttttgttcattactgaatattcagtgtttagcataataatacatagcagaaacacattaatattttatgaatgaataaatgtaaaattattcttagaaagttttcatgatgctacagacagttggccctgtaatttatttattaggttacagggtaatatctttgtatattttaatttaaatttaatttttttaaaaaagtttttgggccgggcgcagtgactcatgcctgtaatcccagcactttgggaggctgaggcgggtggatcacctgaggtcgggagttcgagaccagtctgaccaacattgagaaacaccatctctactaaaaatacaaaattagctgggtatggtggcacatgcctgtaatcccagctactcgggaggctgaggcaggagaatcgcgtgaacccaggaggcagaggttgtggtgagccaagatggcgccactgcactccagcctgggcaacaagagcaaaactccatctcaaaaaaaaaagtttttgagatacagtcttgcactgtcacctaggctggtgtgcaacggtgcgatgtaggctcactgcagccttgacttcccaggctcatgtgatcctcccatctcaaccacccgagcagctgggatcacaggcatgttccatgacacctggctcatttaaaaaatttcttgtagagatgaggtctcactatgttgcccaagcttgtctcggactcctgggctgaagcaaacctcccacttagcctcccaaaatactgggattacaggggtgagccaccacgcctggccacaaaagcttacatttttaacctctaagctatgctgcctacacagcagacatctaataaacatttgctgaaaaactgaattatactgactgctatatagtgctgtcaatacagtgatattctcagaggccagtgaggtgtaaggctctttccctacatactattttactcatgttctttgattttttttttctttttctccattgtttggcattgctactacttctcactgctttgctactacttctcactgttaacattccaatatttgtgtctagcaggtcacccctcctctcttggtgcaggctgggacacaagataatcaagatggctagaataatgcaaaaattattacaaaatgtaatcatcaggctgttggtagtttctcctacatagttaggcagtttctcctacatagttaagtatataaagttcaatgatggctcgaaatggctatctttgttctctaaggccagtttttgtttaattttagcactgtagaaagtttaggctgctggtctcaaatctagaaaagtggcgtaacttctgatctgggatataagtttatcatttctatagtctactaaatagataattctaataaatttgtggctacatacaaataagaaaactgaaaattaccttgtaaataatttttacaagctccattactgtaaatgatttctcaaagttctcacgaaataatgtaagaatttgctgctctcgaatatttctgtgagaaatgtattgttgaattttagcttcagcattatgaattactgggccatgtcctgaattaaaataattataagagttacttcagtcagataaaaaaatactaagtacaacagaagctaactcactctatttaaaaataattcatatgatatattgaaaaagcatactaaatgtcaaatatgaactatttggaaagctatacaggtgaaagagatttaaaaattatatacaataccccccaattagaaaattatagcaaatacaatctatagaaaatattgtgtacattaaaaatatggaatagaaatttaacaataaaacacagcaataaaaatagcaactacaataataacaataggtaatgtttatggagtgctcactatgtgctaggcactgccctaaatgcttaacatacattattcttacaagaatcccatgaagtaggtacaattattacacatttcttatggtagaaactgagacatacggagggtaaataatccgtccacagttacatagctaagaaggggtggagttaggattctgacaggatctcttaaccactctgtgctcttgaccattaggctaagcttataaaatactgcaaaaggacaatgtaaaaagcagtttcatgtacatgaccaagctctattaaaaattcacaagacccacagtaaaactttaagaatcctatgtataggcttctgtatgtcagaaattttgacaacccagattaagttatactataatttacttcccctttaagacagtacacattaatattatatattatataagtctgcaagaatgatgttcttaaatatttgagaacaaaatatccagaagcaggctaacctattacgggatctggttagacacagacctatcatttatttgctgtgtggctaataaatgaggaagtatctgaatctctctaagctgtttcttctgctgtgtggtgaggaaaccactacctactttacatgggttttggtgaggatgacaactgtaaaggcccctgcacaaaacctgatggctagaagactttaatatatggtagctatggctacagagcataatttacatataaacaactgctgtgctagtaagccagttcactggattcactaaagcactctagaatctttactaggtagcctctcattagcttagcttgaatgtgaattcactcaacgtctgccctcttcgctttaaaaatagctgtctttagcaaaaacaaagcaaaacaaacaaacaaacccccccaaagctatcagcccgcaatcctttaatgtcatcatataaatctaaatgcccagctctaccgtatgttttctattcccccagcagtaggaactcatcgcagagtgtaaatgtgttgaagatactggatggacggatctttcaatggcttggttaatcgcaagttagaagaacttaggaagttaagtgacctagtccctttttccttttgggcctttttattgggtcctgtgtctttcttagctttttttttttttttttgagaaggagtctcactctgttgcgtgatctctgctcactacaacctctgcctcccaggttcaagtgattttcctgcctcagcctcttgagaagctgggattacaggtgcccaccaagacgcttggctaatttttgtatttttagtagggatggggttttgccatattggccaggctggtcttgaagtcctgacctcaggtgatctgcctgccttggcctcccaaagagctgggattacaggcgtgagccactgcgcctggccatttcttagctcttcagatgaaggagagattgatattgtagaacagtctagtgagatctgagacactaacatgtttctttttctggagaatggaaataaagataccattttatagttgatatagaagctattggtatttcaatattgtaaattaaaaaaactaaagctcagaggtcaaacattacccaaagttacacagctaaaatgtggtccaaataaaaatcaagttaacaaaaataacagtggtttatggaatgaaaacattttcccatttcaatgtaagtttatgtctttttaacagttctattaataactgtatgttgaaaaataaccctcatatctttatcaaaagttattaatatggctcttggccttctctttaagtttaactgcacagctagacaggacttaggggtgtattttcctttttttttttttttttttttttttttttttttgagacagagtttcgctctgttgcccaggctggagtacaatggcggatcttggctcactacaacctccacctctcaggttcaagcaactctcctgcctcagcctcccgcgtagctgggattataggtacctgccaccacgcctgggtaatttttgtattattagtagagacagggtttcaccatgttggccaggctgatctcgaactcctgacctcaggtgatctgcccacctaggcctctcaaagaggggtatattttaaagaagtagttgatatgttttttttttcccccagacagagtcttgcttctgtcacccaggctggcatgcagtggtgcaatctctgctgactgcaacttccacctcccaggttcaagcgattctcctgtctcagcctcccaagtagctgggattacaagtgtgcgccaccacactcagctaatttttttatttttagtagagatggggtttcaccatgttggccaggctggtcttgaactcctgacctcatgatctgcccaccttggcatcccaaagtgctgggattacaggtgtgagccactgagcctggccttatatgttatctcttcaaggccaaatacatacagagacaagccaaaatgaaccttcctcatcatttgacacaaatggtttgctaggtttgaaaaactacccactttggcatgcctgtatacccagcgctttgggaggttgaggtgggaggactgcttgaggtcaggagtttgagaacagcctggaaaacatagcaagaccttgtctctatttaaaaacataaaaatataaaaaaatttaaaaattacccacctggatatataatatcagctttgattttcaataactcttttaaagagttcatataatcatagaggtcttcaaataccgttgttccttcccctaggatgcaatctccagaaaagatagcattttcctcttctaagagtagagccatgtgatcatcagtgtggccaggggtatatagaactctggttgaaagaagaaataaggaataataacaattatgaactcgagcttagaagaaattttgagaagtaaattattctgtatccttatctttagacacaaataaacagatgagttaaaaagctgctttttcttttcttgaacccactgaaaattatcattagaaaattctctcctttaactaaaccaagattctcactctgaagtaaaatttaatacttttcccaccctttttcttttctttttttgagacagggtctcactctgttgcccaggctgcagtgcagaggcaggatcacaggtcactgcaggctcaatcttctgggcccaagtgaccctcccacctcagcctcctgagtagctggaaccacaggtgtgggccaccaagcctggctaatttatttttatttttattttttgtagagacaggatctcacaatattgaccaggctggtcttgaactcttagactcaagcaatcctaccacctcggcctcccaaagtgctgggattacaggcattagccacctcatctggcctcctaccatttttcttactttataaataataagcactgattataacaaatttggaaaatagaaaagtaaagtgtttaaaagaaatgaacatcaacaatcatttctattcctcagagggagagcttttattattacagaatatatactttttgattttctatgcatatttatatattttaaaaacaaaactgatattgttttaatacctgatttttgaaatcttaacttactatattgtattttcctacatcattatatgtttacatcattttatatatatatatacacacacacacacatatacacatatatacatatatgtttatttatttttgagatatatcaaggtcttgttatgttttccaagctgttctcacccaggctgaagcgtggtggcatgttcctggctcactgcagcctcaacctcctgggctcaagcaattctccaacttcagcctcccgactagttgggagcacaggtatgtgccaccacgcttggctaatttatttttatttttttgtaaagacaaggtctctttatgttgcctaggctggcatcagtatatacttttcaaagacaagtatttaagtgcttagcatagcagatggcacaaaattgcatgcttaataaatggtaaatttattttagtagttattatctaaaagcttaaaagaaactttcttaacatgcagaaggtggtcagaaaaagactcttttttttttttaaattatactttaagttttagggtacatgtgcacaacgtgcaggttagttacgtatgtatacatgcgccatgttggtgtgctgcacccagtaactcgtcatttaacattaggtatatctccaaatgctatccctccccctccccccaccccacaataggccccggtgtgtgatgttccccttcctgtgtccatgtgttctcactgttcaattcccacctatgagtgagaacatgtggtgtttggtgttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacgtttgggttggttccacgtctttgctattgtgaatagtgccgtgataaacatacatgtgcatgtgtctttatagcagcatgatttataatcctttgagtatatacccagtaatgggactgctgggtcaaatggtatttctagttctagatccctgaggaatcgccacactgacttccacaatggttgaactagtttacagtcccagcaacagtgtaaaagtgttcctatttctccacatcctctccagcacctgttgtttcctgactttttaatgatcgccattctaactggtgtgagatggtatctcattgtggttaagagcttctgcacagcaaaagaaactaccatcagagtgaacaggcaacctacagaatgggagaaaatttttgcaatctactcatctgacaaagggctaatatccagaatctacaatgaactccaacaaatttacaagaaaaaaacaaccccatcaaaagtgggcaaaggatatgaacagacactctcaaaagaagacatttatgcagccaaaagacacaagaaaaaatgctcatcatcactggccatcagagaaacgcaaatcagaaaaagactctttaatctatttttttctctctagttaaacattttaagacagagccgttttttataaattctaccctatataagaaacttaacatgcatttatttcctttttcctttcctccaattttcagtttttgttgacaaaactgattataatacttttaaagtatgacaggtattttatttcaaaaattcttatttacatttatattgttttgtaactatgccaacaataaaccagataaacaaaaagctgagttcaaataatctgttctgcaaagcaccccgacttctcagcaatatacagacttaattctctgtactggtcactgttgcctctatattcttcttctactttgaattatgtgttattctgtaggcttcacattgttttgtttgctattctacctcacaaggttatgagttccagaagggcaggactctcatctcattttcatttttatacgctcagtacttggcacttagtagtagttaattttagtaatagattgctttccatgtaccaggcagtgtcttcagggatttacacaaattacatttaatccttacactactttgggttgggcattattagcctctccattttacattttacataaataaatcacagcaaatagcaatacatgtctgaaggaatatggtttaaattatattttatttagtttaagaggataattacctgctattctagtcagtattgagtttttatgtgcttggaatatatatatctctatctatctatatatataattttttttttttttgagacagggtctcgctctgtcgcccaggctggagtgcagtggtgcaatcttggctcactgcaacctctgcctcccaggttcaagcaattctcctgcctcagcctcctgagtagctgggactacaggtgcccgccaccacacctggctaatttttgtatttttagtagagatggggtttcaccatgttggccagggtggtctcaaactcctgacctcaagtgatctgcctgccctggcctcacaaagtgctgggattacaggcaggagccgctgtacccagccatgtttgggatatacttaataaatcttcccaataatggaatattttgtgggaataaggtaaatgtgatgacatatagatgagtgataagtgacttaccagacaggagaaaatggaagcctaaataagcagcagggaaagctgagaaccaatcagatttgcactgcagaattcctcaaagtctaaggatttaggaaatctggaagtggagggtgaagtggaaggaaggtggctgaaataagaagtctgttgaaagtctttttagcaaacattcagatcctcaagagtctcttcccactttgagttgagaagtgccccaatctcactaagggaaacgctggaggtttaatctttgaagagggtaaaacagaggcatagatgcaggaagtgacaatatactaaaaaaaagtaagattacaagaatatatgtagattcctatgccttctttccacactcagcttctataattctggcagccaggcctttacgctacatgaagattagaagagtctttttctaagttattttaccatctcaggaagaaagactctacgataccaatgttggaaagttcccaactgaagagctcatccagattatcctacagtgaggcctaaagcctacggaagactcccccccacattctcagagctcccaaacagctctgtagtttccatcagaacacaattagtaaacatcagaagataaacaggattactaggcatctaaggaaagttatgttgaagacagcgcataaaaacgaacaagcaaacaaagggggttatgaagaaaatttccaaaacaaccaaaccccacagaatataatatcctcagcaaaaaaagaagaaattgcaactatgaaacaagattaggttagtataaaagcaacattttgggaacaaaaagtttctgaaaattacaaatctgagaacagaaataaaaacatgtagtaagattaggcgataaagttaataaaaatctcccagaaagtatagtaaaaaggcaaaaagatgaaaaatgagagagaaaaaaataaagttagagtagtacaggagttctaacaaaataataggaattttagtaaatgaaacagcacaaaagagatgagagaaaataagcacctcaagaaaaatttttggaactgaaggacatgtttcaagactgaaaaagcctatcatggattgacaaagactcgctttgactaaaactatagtcaactcctctgagttttttccgatgatgggactcagaacacactactgccaaaatatggcacctttgcatgctgaggtaggatcctttgatgaggcagtgattcctttgatgaaggaatcactgtgaaatttcaggatacagtggaaaagaagggaaaaagcaaaagccagggaccaaagaagttcagcaatcagaagggctttagatttctctattgcaatattgaaaccagaaggaaatgaaaccttgcagacaatactgagaaggaaaaatactttcaacttagaatctatactcataaataccttaaataaagttagatgaaaaaaggatactttcagatatctaaggtctcaaaaattcaccatttctcagaaagctactggagatgggttcccctaaaacagagggggttttaagaaacttatggggcactggagaaaggagatccaacactggagagaggcaaagggaagccccaggtgagagtgcagggaattctgagatgacaccagcatcaggcccggaggaaaacaagccgacaggagcaagttattagctggaaggcttaaagggtaggttctttcagaagattaaattgagagaatccatgatgcatttaaacaccctaagggaagatttatatactcagagttaaattagtgataaatacacagaaaactatccaaaataacaaagcaaaaacaatgactaactgcaggaaagcaggaaaagtaaggatagtttactacacggttcagctgtaaatagtgtctacagtcataacaacatcaccgaatgctgatctaaccagcattatgacattgagaggttagaggacaggaatggtgctcaaaagtgggagaagaggaaaacccaattctaattttttcttagtggaaagttaatatctcaaattgaaaaataagatgtaggaaagaatcaaatagtccgctaagatttgtaactgttactgccccactgtttaatttctttctccctagacgcaaccactttcacctgttagctaatcatttgtgtcatttgtctgtttgttcctgtacaacaaaactgtaccattaaaggtaattatgtgtgtctctcttccttgagaccttgatgagcctagccataatatgtaaatgttttcaagtttggattttagattctagaagccacagtaataagtaaaccttttgaaaaatgtttttaaaaattttattattatttttaagagatgagggcttaccctgtcacctagtctggagtgcactggagtgatcatggctcactgcagccttgaactcctggcatcaagggatcctcccaccttcatctcccaaagagctgggattacaggtatgagccaccatgcccagcctaagtaaacctgtctttttacaagatgatctgattatagtttaatttagaatacaaaactcgtttaggccaaccttatattaaaaaataatctataaaaagtagtatacagaaaaagcataaagttatttgtgttaagcttaactcacaggaccacattattaataagcaacagtgaagctctagtaaaaagatgtgtgactgtcactagaaactaaaggttcagtattttcacaggataattctaccaaacatttaaaggtcagataatttcactactatgtacttaaactctcctggagcacagaaaaaggccaggtgcggtagctcatgcctgtaatcccagcactttgggaggccgaggcctgaggtcaggagttcgagatcagcctggccaacatggcgaaaccctgtctctactaaaaatacaaaaattagctgggcgtggtggcggatgcctgtaatctcagctactcaggagtctaaggcaagagaattgctggaacccaggaggcggaggttgcagttgcagtgagccaacattgcgccactgcactccaacctgggcgacagagtgagactccatctcaaaaaaaaaaaaaaaaaaaaaaagaaaaaaaaagaaacagataaagccccaaactgacaaaggtacaaaaagaaaaatactacccaattttattactattctaaaaataataaccaaaatattaacaaagagaatccaaaagcacattgaaagatcatgaccaaataagatttattaaaaaatgcaagaatgctccaatattataagatccctgaaaatcatagtaaagatatggaggaaactagtaagttcatctccctagacagtgaaaagacatttgataaaattcaactcttaaagtatttaagagaactgaaatgactataacttagggaagtttctcctttaccataaatataaaaaccaaccaaatccttaatattaaatattgaaactgtaaagactttaaaaagtctaataatataatagatataaggtataagacatgagatactaatggaagcaattatttttgaaaggccaatgtctgacattaagaactattatgcttttatagtttccaagtatatatttcatatattgcaaacaattactatattatagttgatccaatggcaaggtattaaagagctgttagaaatcatctcttttgtctggttaaacttgctgcaagctgttaatagaagtattcaatgttatatgaaaataattccaaggggtgtatttccagccaactatataaacatgtgtctttgtgtggcgatgtgtcatatcttgtggacaatcttatgaatacatagaatgcattaacaaacagaaccccaatctttctttttttaatctacaaaaactcacttgtagaaccactcttcatctgaaaactgttttgcttgcaatgcctccttcattatcagccctccctgaccccctaccacaccagaactcagtaactgttttctgtgatataaacacagaaaacaatttgtttttctgtgatataaacacagaaaacaagtagcagggtttcttaaattggggaatcagtaatctcaattctccagtcacctgggtggctgctgtaatttgcataaaactgttaaaattcacttcacacaggcaggaggagaaaaggaaatgacatcagaggtgctttgctaaagatcacaggaactgcagctgtggccttcctatttcgcaggtagaaaatttatctagttctgttacttctgtgatagagtggactttgtaaggatgactctcttagagaattcaagacagtgatcaaaaactgtcagattgacttttcttcaagaaatttaacttagcttgctagtttacatccagaatcaaattcttactgaaaaacctttctagttttctactttttactgcaagggttcttggtggatattatctctgtccctactgcattttatgttatttttttcaaagttggcaagtaggcaagatcaactggccaatgaatacatgaggactgaggcagattttaaccttctatttatgcaactttcactgaacaaaactcttaagtgctgttatttatatagagttgaactctgtcaaatgtcttttcactagctagcttaacaaaggttttgcttaaaatattacatgttaatattgaaaacagttgggcttttctgacttcataaaagtggaaattgaaaaccacattcatcaggaaattaaatgttttatccaggctttagcttaatgagaatttatattttgagaaaagattatttactactagtcatttttaaaatgtgtctgtttttgattctttttgtcagttttccccttaaatctttacacagattcccatcagagtacagtaaaacaaaaattaaatagaattcatatatttgaaatccttggcatcaattcactccaggaatccaagacagtactcaactgaaggggaagcaagcacaagggagatttctgggacactgatactgttccgtttcttcatctgaatgctgcttatgggccttgttcaatttgtgaaaattcatgactttgtacatttatggtatgtgatctttcctgtttatatattatactttgataagaagttttaaaaaaatgacctgttccacctggatggcagttaacatccaacagctgcatatctttaatctggtaaattaggtatagctctaatgattacccatgattctatgtgataaaccagtactgtgattcccaaatcttcgagacagaagattcaataaaccatctctacccctttcattaacttggtctagggctggtgtgctatggaggaaatttcagtattgtgaagaatactttttgagcaagtagtaatataacatttgttttcctttggtgtcatgggcgaattatataacatgctattatattttcttgctctttcttactattttcttgcagagtcttgctctgtcaccaggctggagtgtagtggcactatcccagttcactgcaacctctgccctcacaggctcaaacaatcctctcacctcagcctcccaagtagctgggaccataggcacacaccaccatgcctggctattttttttgtatttttggtagagatggggtttcaccatgttacccaggctagtctcaaaccgcctgccttggcctcccaaagtactgggattacaggtgtgagccaccgcacctggctatattttcaacaaaagcattataaggaaactgcctagaaactacattttgaaaatcacagcacagtagaaaaaagggggcaccaatttaaaagaggacatggacatctactacttcattttctcttactcatctgtttgtctatttgcctctttaaagatattaactatatgtaagataaatattcagtgccttctgtgtgctagaggtgaggatgtgaggatgaatctggtatctgcctatatcagagaatggctatctagttactaaacccatttcctctattttgctgggcatacagttaatttcccagacaccctacagtgaggggtgacttatgactgaattgacagccaatgcaacagaagacttggtccatgaaaacctcccatgcaatatcccttccatgctcttttctacctgctggattgatcgagctgagcatgcaaccttgaaaaaaaaagccttcaggagggtagagtcacaagatggaaggagcatacatcattacttgcagagggccactggctaactgggaacctttttgggactgtatgggaccaagaaataaatttatttcctatttgagccgttaaacatttctgagttgttttgctatggcaactggcattaactaatattgtgaacttaaggagctgactgctttttaaggagacacttacccccctccacaaaaccacaatacaacttagtaagtgctattatagaataaaatttatacaaaagctggagaagagcagttaattttgcccagaaagcgttcttgatataagtaacatgtgaactgggctttgaagaataaatagataagaatttaccagggagacaagtagtggaaaggggtgatataaacaaaaacataaacaggcataatatgcccaggaatatttgtatatggctaagtgtttttgtgaggggagtgggaactaagaccagaaaagtggcctggggtcagactgtggtatggtaaagagaataaacattatcttgtatgcagcgagagtcattaaagatttcaagtagcacaatgaaggatggtaggctaaaggggagagctggagacagtaagataaaggaggaagtactggtagtggatgtgaagaagggatagcactgacaaatatgtgtgtgtgtgtctgtgtgtatttacctattttttttttagagatgggtttctactttgtggcccaggctggagtacagtggctatttacaggctccatcccagtactgatcagcatgggagttctgacctgctctgtttccgatctgggccagttcacctctccttaggcaacctggtggtccccagctcctaaggtctgagcggtcaccatactgacgctgaatttaacatggacatgcaattggcatagtacactacagccaagaactcctggacttaagtgatcctcctgcctcagcctcttgtgtggctgggactacaggcatgtgccactgtgctcagctgacaaatatattttttccataagttattggggtacaggtggtatctggttacataagtcctttagtggtgatctgtgagattttggtgcactcgtcgcccgagcaatatacactgtaccctatttgtagtcttttatccctcatctccctcccacccttccccccaagtccccaaagtccattgtattgttcttatgcctttgcatcctcatagcttaggttccacatatcagtgagaacaaacaatgtttggttttccattcctgagttacttcatttagaataatagtctccaatctcaaccaggtcactacaaatgccgttaattaattcctattttttttttttttttgagagggagtttcactcttgttgcccaggctggagtgcagtggcacaatttcggctcactgcaacctctgcctcccagattcaagcaattctcctacctcagcctcccaagtagctgggattacaggcatgcaccaccatgcccggctaatttttgtatttttttagtagagacagggtttcatcatgttggccaggctggtctcaaactcctgacctcaggtgatccacctgccttggcctcccaaagtgctgggattacaggtgtgagccaccatgcctggccccgtaattcattcctttttatggctgagtagtattccatcatatatatataccacagtttctttatccactcgttgatggatgggcatttgagttggttccatgattttgcaattgcaaactgtgctgctatgaacatgtgtatgcaaatatcttttttgtataatgacttcttttcctctgggtagacacccagtagctggattgctggatcaaatggtagttctacttttagttctttaaggaatctccacactgttttccatagtggttgtactaatttacattcccaccagcagtgtagaaagtgtcccctgttcaccgcatccacaccaacatttactgttttttgattttttgattatggccattcttgcaggagtaaggtggtattgcattgcggttttgatttgtatttccctgatcattagtgatgttgagtattttttcatgtttgttggccatttgcatatcttcttttgagaactgtgtccttagcctactttttgatgggcttgtttttttcttacagatttgtgttcattgtagattctggatattagtcctttgtcagatgtatagattatgaagattttctcccactctgtgggttttctgtttactctgctgtttgttccttttgccatgcaaaagctctttagtttaattaagtcccaactgtttatctttgtttttaatacatttgctttcgggttcttggtcatgaaatcttgcctaagccaaagtctagacgggttttgccaatgttatcttctgtaatttttatagtttcaggtcttaggtttaagtccttaatccatcttgagttgatttttgtataaggtgagagatgaggatccagtttcattctctgtatgtggctagccaattatcccgccaccatttattgaaaaggatgtcctttccccactttatggttttgtttgctttgtcaaagatcagttagctgtaagtatttaggtttatttctgggttctctgttctgttccattggtgtatgtgactattttatattggtaccatgctgttttggtgactatggccttacagtatagtttaaaatcaggtagtgtgatgcctccagatttgttctttttgcttagtcttgctttggctatgtgggctctttttggttccatatgaattttagaattgttttttctaattctgtgaagaatgatggtggtattttgatggggattgtgttgaatttgtagattgcttttgccagtatggtcattttcacaatactgatcctacccagagatgaacttgggatgtgtttccatttgtttgtgtcagctgacaaatatttttgatgtaaaaactaacctgattagtgtggtgggcaaggggagggggatggtaaaggtgaagagcagtgcaaggtaatcctgaagcctctgtcttagaagaatgagtaaagtcttacatactgagaaaagtggatgttctgagatcagaaaacaggtgcagattgtgggggagagaggagttcagttttacaataactgagtttgaaataccattttgaaaccctcagataggtcatgaggtatgatcggtcaggcctaaaacttatttaatttaggtatgggtcatctttgggaagtgagaatatgggaaagccctgaattgaattgataggtagatccctaagcctccttgggagacaacacttattttttaaagtgtaaattttattttttaaaacaatggtaatcatatgattcaaataaacaatttaataaagagtgaagtctttcttttctcatttctcaagcaactcattttctcctcccagagtaagcaatgtttattggatttcttttgtatccttcctgatgtactctttacacataccagcacatatgcacagatcttctatttttttttttttttttttttgagacagggtttcactcggttgcacaggctggaatgcagtggtacaatcttgactcactgcagcctctgcttcccaggttcaagcaatcatctcatctcagcctcctgaatagcaggattataggcatgtgccaccatgctcagctaattaaatttttttttggtattgcccaggctggtcttgaactcctgggctcaaacgatcttcccatctcagcctcccaaaatgctgggatccttccatccttttctataacacacatacacagactcttcaccttccctggctaagggacatttacttaccttagagtggctccctcagtcttaatcacatctccatctttcagataaacatattgttgctctccatttcctataatttcttctctctgaggattccgtgggagttttttaatgcaataggtagtgtctagtcataaaacatataaaatatattaattcacactttataattaagccttttaagagatcaactttcatagagctaacacttgtgaatgactgcataaaatattaacattaagagacaacagaaaatgggatgaattacagcaggttatctctgggatgtaaatatttcatatctttcaaccaaacagctcttcattctttcatgcccctctaggtctacatgaaagcctctattttttgagtcagtcctagtttatacaaaaaatttaaaagtagctagcttcggcatcctgacaagtgttgaagaggcactaatacagaacctggaaactcttctctatccaggtgcctaacatgtagcaaaggtgtcatgacagtaattaataacaaaaggataaacattaattaataacgaaagcatgaggtccttgctacaagtactgaaatgaagccccaaaccagtggctaagatattaaacctttaaaataagctaaatctataccacccttcactgacacaaagaaaataaattaattaaccaattaacaattgagtgccaattaactaaccagtatactaggtatactgaatacaaccactgtgatatcaaagttcttaaaagctgtcctgattgggaaactaaaacttacaaacatgaaacaaagaactatacttggtaccatttaatgaatattaaatggacaattcggctaataaaggcagcaggagttcagagagagttaggaaaggatttataaatatgatagaacttgaggtgtgacttacagaatgagcaggatgggtaaaggtacagagaaggacttgcaggtaaggggaacagcattagaaaaggcattaagtccaggcgtggtggctcacacctgtaatcccagcactttgggaggccaaggtgggaggatcacgaggtcaggagttcgagaccagtctggccaacatagtgaaaccccatctctactaaacatacaaaaaaattagccaggtgtggtggtgtgcacctaacgtcccagatactcgggaggctgaggcaggagaatcgaatgagcccaggaggcggaggttgcagtgagccaagatcacgccattgcattccaggccgagcgacagtgcgagactctgtctcaaaaaaataaagcattaaaatgagaatgagcatgacatatgtgtgacaacataatgctaccaactttctactgcaaaatactggctaggaagagtggagataaagttggataggtaagataagctcagatcagaaagggtctcaaattgccttttacaaaataggagaatttaaactttaccacgtgtaatcactgcacactctttagtaagataatgaaatagtgttaactgatgatcaatatggcggctgtgggtagggagaccaaaaggagatcagagagcccaggaggggaatgactacaatttcccagctagaaggtaatgaatagtagggttaagacggtagcactggaaatatgaagggagaaagagatatttcaaagaaaaatggacaaggcacagaaatttgctagtttgaggataaaggagacagaaacactgaaataaaaagaaacaacaacaaataccacctccccttccaaccccaaactctattattttgtatctaagaggccgaaggaaaacaatgatatgcttttctgggaattgacattatataacaagattgagatattgaggtttttttgtttgttttgtttataagctgtataattttatctttcagtaaagaaatggaggcattacatttctgcttatgagacctttagtagacaattaaaaaatcacaattatatcaaaattacaaaataaatgtcatactataactttgtatctgtcttcaaaattatgtgcaaatataaatgaaaacacatatcctatttgagtggttgttggaggctggggatgggggaaatcactgcaaagcagcatgaggggacctctttttggaatggaggaagtgttccatatcttgactggaatggtcacataggtattgatgtttgttaaaactcactaaactgttcacttaaaatgggcacattttatgtatgtaaattaaagctcaataaaattgatttatgaaggaaaaaagtgggccataaacattttaatttttcaaactgaaaaatctgaagagttggctgaggtgacaaagctaattaagaaatcacagagtagtttctttttttttttctttttttttcccgcaaacagggtttcactttgtagctcaggctggtcttgaactgctgggctcaaactatcgtcctgcctcagtctcctgagtggatgggattataagcacacaccaccgtccctggcataaaatagttttttaattcacaagatttaataggtagattaaaagaagaggtaagacaaaattaaaagaggtaagacaagagaaggaaaagtcagactgacagattataagttcctatggtacacagtccccttagattggaagaaaggagctaagagggtaaggaagcttggttgccagttttttataactggcagcctggtgatattgggtgtggtagctgagatgtcccaattgtagtcacaaggcctaaaaaagcagatctttacaaatgtttaaaaatactagctcaatgtaaataagcatgaatgttcttgacctccttactgtgccctgaatgtgccaaccacactctcattccaccatctttgctcctgcaatgctgtttgcctgcaggccttcctgccaggagcttgctccttctctctgtccactctggatataacagcccttgcccttctccactttacgctctcttccctttctcttcttgtacctttattttcctgcatagcacccatgattatctgatctatttttttccctttttttttcattctggtgcccaggctggagtgcagtggcacaatattggcttactgcagcctcagcttccctggctcaagccatctgcccaccttagcctcccgagtagctgggactgcaggtgcacgccaccatacccgggaaatttttgtactttttttgtagagacagggtcttgctatgttgcccaagctggtcttgaactcctgagctcaagcaatccacacaccttgacctcccaaagtgctgggattacaggcatgagccactgcacccagcctgatctattatttatttaccagtaccttccctactggaatgaaagctccatgagaacagagtctgttttgttcactgctataccccttgtgccaagaacactgtctgacatataacagtaactggaatatttaatgaatgaatgaatgaatctaggtatatgatggtgggatgaggaaataaagagatagaaaatgtcagtactgtataggtttcagggacaatgaattatcaatacaatgatatattgcctgaatttcagcatatcttagtaactgccttaaagttacagaaggactgagataatctgttagaatgtgaacaataagagcacctacctcacagtatccacataaattgtttagtgcagtgcctggcacagagtaaatgctcaacagttgttagttatgattaagtctgaatagtaactcacacactaaagtaaaattgaggatttgaaacagaaatcaggatttccgttcctcctttgttaaaactaggcacagtattcaacagtctaatcaatttctaaaagtaccatttaaaactgaggtatttagtaaatggtttatagactacttagctctgtaactgaaataaattattctccaaacacggctttcctcaatgagcttaatgaatgttttctgtttaccattattgatgcttttacaaatatctcctatgcctccagaatgatctcggtgccagtgagtcactacaatttcctggattgctgtgttaaattcagttagagcctgctttaaacagctgatgtattctggaattgctggttctccagtgtcaatgaggattctcctgaaaattaaatggaagataatcacacaattggaacactgcgttgacattagcattattttgcacacagataatttacattaaagaaactgcaaaaattattttacttttaacatgcacaaaaaccagctacatcacttcagcttaactacagtaatctcaccctaagaaagttttctgagaaaaattagagctaaatataagtctgaacaaggaataatagcagtcatcttgaacatttacatagcaattaaaataaacatggcaccattccaaggactttacatattttaccaattacattcctcgtaacaactgtttaaagtagatattttatcattatatttagaagtaacttgcccaggttactctacagataaatggcagaaacagctttcaaacccaggtattctgatgccagaatatgtgcttttatctatctgcctttgagatctcatatctcagtatatttcaaaagttttatagatatgaaagattttgattcaatggcacccctaaagaaactagtctttggcactagatatacaacttatcactgaagttttatattagcaccctgacacatgaaaatgaaggctttagtgaagcatgggaaaaacatctgagctattttctttctttacttagacaaccccattagctgtattttttgcttgtggttctgaatcttccttatattttgtttgcccttcctcacgattttatgaggtggcctttctctgtgaagttttgctgaactaaagacatgggggtgacatgttcctcaagatccaattcttttttttttgagacagggtcttgctctgtcacccaggctggagtgcagtgttgcgatctcagctcattgcagccttgacctcctgggcacaagcgattctcccacatctacttcctgagtagctgggactacaggtatgtgccaccatgcccggctcatttttgtattttttgtagagatggtgtttcgtcatattgcccaggctggtctcttaactcctggggtcaagcaatcctcccacctcagcctcccaaagtgctgggattacaggcgttgagccaccatgcccagctcaagatccaattcacaaacttcttcactcatactgtttcacagtaacacctcaataattcaggctggctgacagattagccttgatgaaaagtctgagttattcattaattgatcaataactgtttatggattacctaatatgtgctacaaatttgtttcttgcagtaagcaggacacaacaaccctgcttacattcaactgttggtgagaaggggaactgcatatgactggaaataaacaataaaagtaacataccatagaaagcattttgcaaagcattaaaattaaa

SEQ ID NO: 824 - DNA, 8502 bp, Homo sapiens
agtgcaggggtggtggagaggggactgtgccagttccctggacaatcccagctgcttcatcttggactgacatggacaccaggcagtaacaccagctcttgggagttggtgggaacaggtgtaatatcaaagctcccagctctgcactctcctgtcacataggaagacctcagaaaatggaggttccttcctttccacctgcactgggggagtgcaatgagcagaagaaaagcgaaggtccctccaccttctgagatcagctgacacctgagcttaggtgcatccctagccctgcagcctgttgcttcccttgaccgccacccccacctccatcttcaaggctgtgctgggcactccaggctgggcctgacgcgttccaaatctgcagctcccctcactctgcatcctgggcctccaccactctccaggagagtgggagacgcctgagccatgggtggcgagaagcggcagtcctgtgccgcctcagtgccccacttgcctccttcgtggaatggacttgacatccctgccttgctggccagggcgtggccgaaacctacccaggatgtaggagcacctggcacagcgcttggccagtgaggcggtggttgcaataataataaccatcccttgttgaacattcaccagataaccaaattctccacaccgcatttcacttaggcctccctacctaagagctgggtcctaattcactggttctgtacatcaggaaggcaaagcacagacaggcaagtagcttgcccaaggtcgcagagctgtaagggatggggggctgggattgggaacccctggaatccactttcagagccaggtttcttcccctttgccctgtacagcaggtgcccatgagcaggtgttccttccctacaggcctccctcctctcccctgctggaaagggcagatggggagggctgagaggaaaacaggggcatggtggagatgcagaggatctgcctcaggctccgctgcctcgaggaagacagggattctgctgctgggtgctgaggagcgccgatggggcattagtgggacccagagtgtggcactgtaaatgagagctgtgtggagtgcttggggaaggcttccccgaggaggcaaagtcttgctggtggagaatttgtcagcaggaaagggaagggatcatcatgtgcaaaggcaggcagcctggagccagcatgtgtgtcaggtacccaggagcagctggagtgttcctggcacccacgatactgtgcagaagtggggaggtgggcagcagagggaaggctggggtgagtcatgaggatctgtgaatgccacactaagcaacttgtactttattctaggggtgcaggggctttgagaagtttcaagcatgggagaactttttttgttgttctttttgagacagggcctctctcactctgtggccaaggctcgagtgcagtgacgcgatctcggctcactgcaacctctgcctcccgggttcaagattctcctgcctcagcttccggagtagctgggattacaggcatgtgggaccacgcctggctaattttttgtattttcttagtagagagatggtttcactatgtttgcaatctgcccgcctcagcctcccagagtgctggaattatgtgtgtgagcccggccaggggagaacttttgaacacttacctgtgttctatgacacagatcctttgggggataacaaagatcctttgggggacccagggtggactgcagggtggagtctgaggaaggagagcacccagtccaagggagagatggtgaagccagaatgaggcaggtgagtgggcgtggggatgctaaacccccagagccagtaggagccctccctagcaggatcaatcagacgccatcaggccttcccttcacggagggtcgactccactgcagactgtttcccaaaaggccaaatggacggacacatggcctttttgctatctcagccctcatgccttgagaacatattttacaaaacaaaaaaagagaacagcaactttcagtttcagcatcaacatgtaaacagcttggcaaaaccccatctctactaaaaataaaaaaaaaattagctgggcatggtggcgggcacctgtaatcccagctactcgggacgccgaggcaggagaatcgcttgaaccctagaggcagaaggctgcagtgagctgagatcacgccattgcattccaccctgggcaacaagagcaaaactccgtctctaaataaataaataaataaataaatataataaaaacaccaagagcgatctctataacaagaaaaaagagcctgtcttactgaggccctacgacagtcacccagctccagccgcctctagccttcctgtctcacctaaggaggtgggacaaagctaagacacctgtgaagacaccagggatacggatgcactaaaagaccaagatttaatcataaaattagaaacgtgcttccccgtttcctaaatcataccaccacatcaacggggctccagtgtaacagcagtggattgtagctgagggagctattaggcacagtaatttttttttttttttttttgagttggagtctcgctctgtcgcccaggctggagtgcagtggtgcaatctcggctcattgcaacctctgcctcccgggttcaagcgattcttctgcctcaacctcctgagtatatgggactacaggcatgcactgccaagcccaacttatttttgtatttttagtagagacagggtttcgccttattggccaggctggtctcgaactcctcacctcaggtgatctgcccatcttggccccccaaagtgttaaaattacaagcgtgagccaccacacctggcctatgttggtttttaaaatgttaaacctgttttgcacatatgaaataaatcctgttaaattgtggtgtattcacagattcacatttattcataaattcaatttgctaatattttgctaatagttgcatttatatcagggatccctaaccctcaggcctgggactagtaacagtatcaggccacatagcaggaggtgagtggcaggtgagccaggattgccacctgagctctgcctctagtcagatcagcgacagcattagattctcaggagtgtgaaccctattgtgaacagcacatatgagggatctaggttgcaagctccttatgagaatctaactaatgcctgatgatctgaggtgcaacagtttcatcccgaaaccatctgccccacccaccatgtcccatggaaaaattatcttccataaaactggtacctgttgccaaaaaggttggagaccgctgatctacgttcatgagaggtattggtctgtagttttcctttcttccaatgtttttatctgattttgatacaggaaatgctaacttcatgaaatgagttaggaagtattcccttcacttctattttttgggaagagaatgtagagaattggtaccatttcttccataatgtttgctagatttgacaacaaaaccactgggtctggtgctttcttgtttgcaaggttgtttattgacttccataatttatcaatttccataatagatataggcctattcagatcatctcttttccctgtgtgagttttggttgtttgtgtctttcaagaaattgatctgtttcacctaagctgtcaaatctgtgggtacagagttgctcataatattcttttgttatctttttaatgtccttgggatcagtagtgatgacccctttctcatttctgttatcagcaatctgtgtttttttttcttagttagcttagctagaggtttatacattttactgacctgtgaaagtactgtttttatttcttttttctattgctgctgcacaaattagcacatttttacttcactgaatttttctattggtttcttgttttctattttattgatttctactataatttttatttctatccttttgcttgctttaggcttacactgatctttcttctctagtttcctaagatggaaacttagattatgaattttaaatctttttaatctcttctaatataggcattcaatattataatttatctccaaccactactttcactgcttcctataaattttgatacattgtattttcatttttatttagttcaaaacattttaaaatttctgttcagacttcttctttgacccatctggtatctagaagtgttttgtttaatctccagttattttgagatttcccatctacgtttctgtttttgattttgtttaatttcctctgagagcacactttatatggtttgtattctttgaaatttgtaaggtgtatcttaaggccaagtatgtagtctatcttggtggatgtttcctgtgagcttgagaagaatatgtactctgttgaatgaagtatactgtaaatgtcaattagattcagtggcttgacagtattgtccagttcagctatatccttactgatttttttgcctgctaaatgtgtcaattactgatagaagagtgttgaagtctccaactataatagtggacttgtctatttctcttgcagttctattagtttttgcttcacatacgttgatgctctgttgttaggtgcatacacattaaggatttaacaatgtcttcttggagtattgaccctcttattatataatgcccctctttatccctgatcatttttctccctctgaagtttgccttatctgatatcaatactgctactccagttttcttttgattagtattaacatggtatatctttctttatacctttatttttatgctatttgtgtctttatatttaaaatgggtttttttacagacaacatatcattgggtcttttttttttaatctactggcagtctttgtgttttagttggtatatttagcgccattcacatttaaagtgattattgagatagttggattaatatctaccatgtctgccgctgttttctagcaggtgcacttgtccttgtttttcttaccttcccttctttttctgtcttttctggtttaactgagaattttacatgattccactctttttactttctagcattataattatacttctttcaaaacattttaattcattgtcctagagttcgcaatatagatttgcaactaatcaacatccactttcaaattgcactttaccacttcatgggcagtgcagctgtcttctagcagagtattcccagttcctctctcctcacccttgtaagagtgctattcttgatttcacctatcctttactatggaccccaacacaatgttactattattactttagccaggcagttacctactagatcaactaagaataggaaatgtaaaagattttctattgtcttcatgtactcctttcctgacagttcctttatgtggatctgagtttctaacctatatctcttcccttctcccttaagagctgcttttaacatgttttgtagggcagattggctggcaataactctcatttttttgcttgtctgagaaagtatttttttttttgttttgttttgaaacagggtcttgactgtcacccaggctgcagtgcagtggccaaacatggttcactgcagcctcgacctctcaggctcaaaggatcccacttcagcctcccaagtagctgggactacaggaccgtgccaccacactcagctaatttttaattgttttgtaaagttggggtctcactatgtcactcaggcttgtctcaaactcctgggctcaagcaatcttcctgccttggcctctcaaagtgctgcgattacaggtgtgagccaccgtgcctggccctcaaaaagtttttgtttctctttcattctttttgtgagagcaaaaaatttctataacatggatgtcaccatttttaaaccatcataaaatccaccattctgtagcctttacatacacaatgttttcttcacttttgaaggatacttttgctggatatagaaatctaggttgatggggttttctcttttttttttttttttttgaggcagagtcttgctctgtcgcccaaactggagtgcaatggcgcgatctcggctcactgcaagctccacctcccgggttcaggccattctcctgcctcagcctcccgagtagctgggactacaggcgtctgccaccacgcctggctaatttttttgtatttttagtagagacggggtttcaccgtgttagccaggatggtcttgaaatcctgacctcgtgatccacccacctcggccttccaaagtgctgggattacaggcatgagccactgtgcccagccagttttctctttcaacactttacatatttcacccttttctcttcttgcttgcgtggtgtctgacaagaaggctgtaattcttattcgtttcctgtataagtaagctgggtttttttctatggcttctttcaagattttgtgtttgtctctggttttctacagtttgaatatgatatatgtaggtgttgatttttttttttaagtatgtatcctatttggtgttctctaagcttactggatccgtggcttggggtctgcctttacttttggaaaattgggagccattataactttcacgatttttctgctctgttctccctttcttctccttgtggtgtttcaattgtgcatataccttttgaaaatatcccacagttcttgtataatctgtttttttccccatttttttctttgcattacagtttgggaaggttctattaacataccttcaggctgattttttcctcatctatgtccagtctactgatggtcccatcaaatgccttcatcatctctgttatagtgttttctctttctctttctttccttcctttttctttccctccttccctcccttctttctttcttccttcttttgtttgttttgttgttgttgttgttgttgttttagacagagtcttgctctgttgtccaggctggagtgaagtggcaccatctcggctcactgcatcctctgcctcccaggttcaagtgattctcatgcctcagcctccacagtagttgggattagaggtgtgcgccaccatgcccagctaattttttatagttttaatacagactggacttcaccatgttgcccaggctggtcttgaactcctgagctcaggcagtccacctgtctcggcctcccaaagtgctaagatggagaaagctgccatataaagagttatcttagggggaccagggcaagatctgagggatcagttagttggctatgccccttgtctgggcaagacactgcagtggcttgggtgggggtggtggcaggggtggtggggtgaagagcctaggtctattctgaagacagggtatctatgaggggtctctgtttctactcttccagagcacaccaccacctgcagctgtctcctgcctccagtgcatcagagtctggagcgcgttgcttctctggagggagataaagacacagtggctacctggggagataaaacagcaccagcaggaatcaggggttccagagaggagggaacctggccctgggctatgtgtgtatcagttgtgatatgcataatcatctttggtcttattttttccaagtgactggaaaagttcatttctagcttacttacctctgttccttccttaaactcctctagcctggcttttgtctctgccatttctactaaaaccactctgctcaaggctgtcatcagtgtctccactgcccagccctggactgtcagagccactccgggacatctgcaccagatgcatgagtttcctgatacagcgaaatctcagcaggagttgacacccacctgcctggtgctctgggatgaatttctgcacagatgcaacctctgtgggtggaagccaggatgaagtatatgcatctgtgaagactggccttccatctgttttctgatgcaaccaaaatgcttcagggctcgtcttatctggaggtttgatggctacagacgtgaggggcttccaggtagagctcagacctgagacttctggtcccctgtctggacatctgtatgaagacggagaagcaccagccaacctctccacaaccctcaccaagttctcatggaacatcctctgatggtccctctcggtgctgggttctggcaggagaaagagaagtcagggaacagaagagctgctctgccaaagtcatacccttcttggagacacagggaactccatctctcattctcactagcaatttgctgtggcaactcaaatgtttttccagatggaacataagcagacgtgatgtgtttgccttccaggtctaacccatgcaaagcctcctgggaacacacctcacgctattttctattccatcaggtggatatggatgatgattaggaactagggtgaggtggagccagaaaacacaaggagcctggatccctgaatgaccacatggacatacacatgctgaagactgccttgtaagcaggaaataaacatctactgtattgaa

SEQ ID NO: 825 - DNA, 2098 bp, Homo sapiens
ggtgatgccgagctgaagctgggaagcggatgtgagggaagagttccaggcagagggaaggcaaatgcagagatcctcaggcaggaacactgaactgttctccgtatttgaggagcagagggcgtgtcagtggtggccgcagcagctgagcaaaggtcttagaatcccagctaatgtcgtgggacctagcacccaatcccaaaagaaagaagaatagataggaacccactgttgacaagaaggtgcactgagaagtgtttttatctgacccgatctgcatccagtttagaagccgatacatcagggatttaacaatctgtcttaatgtctagcaaggggggttgctggagggaaaacacagagtcagagttctatcttcagccctgccagcaggtccctgggagatgctagacgagtgacttttctctgggcgtggttggtgtaagggatgcacacgcaggaggaaggtcggagtgtaaatgtgtgacctgggcctgttactgggtataaatgggcctgtagtgaccgggagctcatgttctaccaaaggggttgccaattttctgatttcgagtgtggcggtgtaaaagagaaaagcaactgctgccagctgggagctggtttgcaccctcactccagaagccttgatgttgctaggagctgacctggcaccaacagcacggccatggtggtgtcctgttgagcaaaataatttcacaaaaaacatcagacaaggtcactctctgactgatctagaaaaagaccattccataataaagcctcaatacagaaacaagaacattgtccaaaccacaaaaattaccaacacaatcctctctcccacagcgtaagttactgctgctttttttttggttgttgtttttgtttgttttgttttgtttttgaaatgaagtcttgctctgttacccaggctggagtgcagtgatgcaatcttggcttaccacaacctccacctccaggttcaagcgattctcctgcctcagcttccagagtatctgggattacaggcacccaccatcatgcccagatcatttctgtatttttagtagagacggggattcaccaagttgcccaggtgagtcttgaactcttgacctccggtgatatgcccaccttggcctcccaaagtgctgggactacaggtgtgagccactgcacctggccactgctgcttctttaccaagtacagttttagcttgattcattcctcccatcttctagataagaattattaagataaccaaaaagaattatccctacttcctgatagcatccaacccagagcaaatgcccccctttttggacccgcctaggaagtcccctaatgaaagttccaatcctgtaataagtcctttcacacatgttcttgctgagatgtctgtggtgttcagcctcccttgttcaactacaggtgcttcctggtggtccttggttggagggtactatcagaaatggaggagcaacaaagattcagctgaagccctcactgcctgggactgggacccttgactcgtcattgtatgcacacctgaaactgcttatgtcgctgaggtgccaacctgctgatggttggaagctaattgagttctgatattgtgttgatacccttaagcattgggtttactttttattttaattaattaattaattaatttttgagacagagtttcactcttgttgcccaggctgaagtgcaatgacacgatctcggctcaccgcaacctccgcctcctgggttcaagcagttcttctgcctcagcctcttgagtagctgggattacaggcatgcaccaccacacctggctaattttatatttgtagtagagacagtttctccatgtttgtcaggctggtctcaaactcctgacctcaggtgatccacccgcctcggcctcccaaagtgctaggattacaggcgtgagccaccatgcctggccatattttttatttttcattttttactttttgagatagggtctcactctgttgaccaggctggagtgcagtggtacgactcagctcactgcaacctctgcttcccagctcaagtgattctccagtttcagcctcctgagta

SEQ ID NO: 826 - DNA, 11983 bp, Homo sapiens
aggaggcctggggaacaatgagtaaggcagagagggaacagaggcttgtaggccactgtgcggactttggcgtttagtctgagctggggacccactggaggattctgagcagagcagtgacatgattgcgcttacatttttaagacttactctggctgctgtgttgagaacagatgaccatggggcatagacagaagcagaaaggtgagttggaagctattccagtaaagcaggccagagatggaggaggtctgaaccaggtgatagagggaagagttagaaaaaagtgtctggattctggatatgttctgaaggtatgttgtgccgaaggctagatgtgtggtatgggagaaagagcaaggtcaagtacgacttcagggcttttttttttttttgagacagtttcactcttgttgcccaggctggagtactatggttcgatcttggctcatcacaacctctgccttctgggttcaagcggttctgcctcagattcctgactagctgggattacaggcatgtgccaccacacccagctaattttgtattagtagagatggggtttctccatgttggtcagggtggtctccaactcccaacctcaggtaattctgcccgcctcgggctcccaaagtgctgggattacaggtgtgagccactgcacccagctgagggcttctgacctgagtaactgggaggacaggcttggagggtaaaagaagaatcatatcttagacatgttaattttgagatactcagccatgtagatggacttgttgagtaaacagctggataaccaaattgagaatttaggaaagaggtccaggctggagatggaaatccaggaatctttggttgtagactgtgcaagctacaagactgacagaagctcatttaggcctagggagtgtagctatagaagaagacatccacaaagctgagtgctcatcactggggccctccaaccagggaccaaggaggtaaagagatggagcagagtccaatgagaggggagaaaaaccaagagagtccaactgaagaaagtttcaggaaggacgcaactgtgccaaatgctgatgagtctagaaatgagatcatactgttttgcaactacttttttccctttagctacataataaatatgaaatcttaacagatagtatgaagttttaatagatgcagggaatttttgccattataaacaattcagcatctttgtagctctaagtacgtccctaataatttacttttattattaaatattataaatggacaaattataattttatataaggtacaaagcaatattttctctctatatatacatatacacacacacacacgagtgaaatgattaaatcaacataattaacatctatcaccttaaatacttatcattttgtgtggtgagaacatttaaaatttactcttttagcaatttggaaatacgcagtccaccattatttatttattcatttattttgagacagggtctcactctgtcatccaggctggagtgcaatggcactatctcggctcactgcaacctccacctcctgggctcaagtgatcctccttcctcagccccccaagtagctgggactacaggtatgcaccatcatgctcagctaatttttttttttttttttttttttttttttttttttttggtagagatggggtttcaccatgttgcccaggctggtctcgaattcctgggctcaaacgatccacccacctcagccttccaaggtgcggggattacaggtgtgagccaccgtgcccagcaccaccattattaactgtagttaccatgttgtgcagtgttatctcaaaaaatgtattcctcctaacactgtacactttgaccaacatcctaatgatttgcttaggataaactcttacatatggaattgcttgatcaaaagtgtccatgattttaaggattttgcatactgtcaagactgctttgattcaatgaccaatagtacaacagagtgtccattttactacacgggtattataattaatttctcattttttgccaattctataggtgcaaattgagcttacatttgactactaataagtttgaacatatttcctatcttcaatggcaatctgcattttggggggtgaatttttcattgttagcccatttttctattggtatctgtggctgcttctgattaactcatatgcaagaggttcctgtatactaaggatgttaacccatttttctgccatccatctcaggttatatgacttttcattttatttctggcatttgatgtggtattaagtttttatgcagtgaaatcattaatattttcatttatggcttttatctttatgacatttagaaattccttctctccccaagattacaaaactgaatacatggaatttctgaagtgatttgttagtaaagccatttattttttgctttaggaaaaactgtcctccagaaagttttcttgctttcttttgcctcctgatactacattttaaaagactatatatgggccgggcgcggtggctcatgcctgtaatcctagcactttgggaggatgaggtgggcagatcatgaggccaggaggtcgagaccatcctggctaacatggtaaaaccccatctccactaaaaatgaaaaaaaaaaaaaaaaaaaaaaaatagccgggtgtggtggcaggcacctgtagtcccagctacttgggaggctgaggcaggagaatggcatgaacacgggaggcagagcttgcagtgagctgagatcccgtcactgcactccaacctgggccacagagtgggactccgtctcaaaaaaaaaaaaaaaaaaaaagaccatatatggattctgtttccacaaaagtcctattgaaatcacaacatttaaaaaatagaatccaataatgttaaggccaaatgggaaaaaaggggaaaaagtaaacctatctttggggcacgaaggaagataagctacaaggtattgcatgcatcactgttacatatatttttagaatttttgtattttctatcctcttttcataaaaagattggagaaatttcaacacatttcttttcaaacctagtcatcattttttggttttaaccacaaatttaaactgtcatcctaggtggctccactgtctaactcaatgagtcttaagacagagctgatttggcacagtgcaactgtttaagtaatgaagaagggttgaaagtagtgacacgtgtttccgatgcttttttccatatgtgactttttaggaaaatatcactggcaatgtagcaaaggtgtaagagtctcggcccaggagtcaggctttggactgaaacccaactctgccatttattacctgcaggatcttgggcgaattatctgacatctcccagcctccactgtctcttctgtgtaacaggggaaacagacctacctcactgagttcatgcaaggattaaatgagataatgcatgtaaagcactccacctggcacacagtaaatacacaataaaattagcttctattgttatcttagcatcttttacattcatgcttaaattctgtgagtgttccattacctcttttgctagtttctgtccttgttccacacatataggtttttctttcatatcattcagtcttgctaaagttttggggtcatctcggagatcaatctaattaagaaaggtcaataatgtcccataatattacaaatctttaaagaaaaatcaaagcatgtaatcccacttaattcccacataccaaaaaaagattaaacaaaagaacttaatttttaaaaaccaggaaaataattgctttcttttggcacaattttttccaaaaatatgatagaactcattaacttgcagctgagattaaacacttacatcatttgctcagctttgggactgtttgtctgagagcagcctctacgacagaccaaagagcttattctaaaatgcagaaaatcaaaccagacatacctgagttcctattaataaaaagggtacatttggtgcgtattccttaagttccggtacccactcctctttcacattttgaaatgaggctggatttaccaccgagaagcatataaggaagacatcggtcattgggtaagataaaggcctcagacggtcatagtcttcctgaggaacaaagaaaagcctcattatgtatttacatttctattgtttactagtaatatgtacattagattacatggtcaaagatgcaaattcaggagtactccactagtggaatgtatggcactctaagtaaaatcagataactctgtttttgttattcttctttgtgaagttctgaacacccatgaggtaaaaaaaaatgacaatatcattaacaatgacaatgaaaactttggaaaaatacattatgatcactaacgctgtcactaaaaacatttttaactaaaaagtttgcacaaagaattgaatatagctagacattgcctaagtattataatttataataattaatacatgctaaatatttactatgtgtcaggcactagtctatatgctctctcatggattacttatttaatccttgtaacaacaatatgacacaagtacccttaatcctgactttcatttgagtaaactgaagcacagaagttaaattacttgcgtaaggatgtgtagccagtaagtcaaggagctgagattcaaatcctggcagtttttactccagagtctatactcttaaccactatacagcttcactgagaccttcaagctttgctttccttgtttctatagttttattaattgtgtgtgtgtgtgtgtgtgtgtgtgtgtgtgtgtgtgtgtgtgaagatttaaagagaaacatacacagtaaacccaccaaaatcctcctttactctccaactttcattccctctacttaatattttcatgtttattcttccagttctttttctatgcatgaatataccagtaactgcacatattcatacatctgtacataaaatgaaatcatgcagtacttgttgttctgcactttctttgtcttggacatctttctaaatcagaatacgttagactaccatatcattttacactgttgcttcagagtccccagaacagctatactcctgatggttattttagtctctatcacaaaaggcagtgaatatccttttttgcatagactattttatgtgacacaaaattctacttatttacattctcgagagtgaacagagtccggattccatttttggcatagctagactctcatctggtttcaaagaaactttatttttagcctgggccacctcccctcttaaatgactcgtttcactacagaactacacaaatgtggaactaagggaatattaaaaacatcatcttccacttggagtttcagcagtagtatttccctcatggaacaattttcctttcatgcatttttctgacatttttcataatataactttcaactaaagcatgttaatgtcccaaacccttgactggtgggtaacccttttgtttttctgtgatgcttttgaagggcacacctataatctagagctgtgggcattaaaagatttctcaggtgttcgctatcacatgacgacaggggaaatgccacccccaatcttctgcaacttttattttttaaagtgaacgcctctaaatggttttgattaaagcagtgccctggtgttaagaaattcacaatgaagagatcaaatagggtgggtatgaaacacgttatacccccagacagttactagaggaagacttcttgaaaatttaactttttaaaaatcagcttgtgttaaacagtacaattgagtgccttatatgtactttctgggctctactgcctgtttcaaactgcaagtccataaaagaaaaaaaaaaaaaagaaacagtatgtcatcttagcatcccacccagcaactccacacttctgagcaaacatgcagttgtcatggccgggaaatggggtgttctcattaaaaagcactcctcatccatatttagatttccaattttcacagaaataggaatggggatactatcccttaggattatgaggaataaatgaaatagtgcaactaaagcactccgcataacacctcgcacatcgaagaactctttcaatgcttaaacataaattctctatcccatgggaaaccaagtctcttattcctctgcaaatccacgcagggtcccctgagtcccacacttgcctcagctttgcagctccctccaatcacagagaagtcttttagtaagaaataaaatcaaaacacacaaaactcaggtctctcgagacagtataattttcagatgaataaaagagaatgatatattattactgtactcattagtcacttagccttaagactatttaaaatgtaacaaaaatagatttatatttaagaaagccaaattagagattttaatggaaattttacttttcaagcaagtttacctcctcagggaaacagaagtgtgcgctctttctctagtgagagatgacaagaaataaaaactaattgaatgccatgttccctagagatgcttaacaatattaatccaagtattttacagaaggtaaatatattgtacagattcctttcataaccacagtgaatcctgactttcctccatgagagacgtgagcacaaaggaggacaattggaccaatcatttctagatatttcttaaattgcaggttttgtttgattaattaaaatgtgaagaactggggctattaaaaaataaaacacacatatgtttagacctccttggaaagaaatgttacttcttaagtctgaacaatctaaaatgaattccttctgcctgtcatctctggctaaataattggcagttagtggccgggcatgatggcccacacctgtaatcccagcactttgggaggccgaggtgggactcttgaggtcaggagtccaagatcagcctggccaatgtggtgaaacaccatctctactaaaaatacaaaaattatctggccgtggtggtgcacacctgtaatcccagctattcggaaggctgaggcaggagaatcacttgaacccaggaggtggaggctgcagtgagcagagattgtaccactgcactacagcctgggcaacagagctaaactccgtctcaaaaaaaaaaaaaaaatcggcagttagtacaagaatgagacctttctgcttctatccagctgagtaattagaagtctaataatagcaaatttagaaaataaattatcccctgtgcatactgtaccctgcatcatataaaatggttcatatgcatcacatagtatcctgtgtgaatttaatatgaaatgtgggatttgggaatgaataagtggaggtgtgcagaatctttcatcttcagccatatattttaaatttgagaacacaaagaagtcaaatgtagagcaactgcccttacttttaaaagatcgacttatcaaagtcacaacttctcacagccaactctccagtgtcctcctaattaacaaacccattatattttagttctaattttaaaatgtaggtatttaaacatttcagcatggtaactagaacattctcaggagtacagaaaagtgtattaaagacagctgttcaacatcaaaacaatgaaagaactggtgagtttagtcagcatggctgttggactgcatggcagactctttagcttcttaccaattggctaagtaccagaagtatcaagtttttaagtgtgttctggcagcttagtgttcaggctgtcccttgttgaagagtcctcgatatgtgataatgacaaccttactttaaaaatatcacacatggccaggtgcggtggctcacacctgtaatcccagcactttgggaggccgaggtggggagattgcttgagtccaggagttcaagaccagtcttcccaatgtggtgaaatcctgtctctactaaaaatacaaaaattagctgggcatggtggcacatgcctgcagtcccagctactcaggaggctcaggtgggtggatcagttgagctcaagaggttgggcctgcagtgagccatgaacatgcctgggtgacagagtgagaccctgtctcaaaaaaaaaaaaaaaaaaaaaaaaaaacacacacttaccacctgataagaatctgcaaacaaaaaactaaagaaatgcgctctgagaggaaacaaaagctcttccaatgccacagagaaatgtagccaatggccatcagctggagacccctttctgtgtgcagctcagccagcagtgcccatgagccttacttctgcactattctttgtccccttcatgtggacctgggtgttccctcctaccttagtgatctctgtttaaaatatatgtttttgggatgtgtatgtctattttaaaatacatatccaaaacatttcttaaataaaaacactcacattggacgatttaccttgtgccatgctttgttagctggtatgctatcatgtattatttaaaagcaatcagcaaagatttattgagactatagccctctggagcttgcagtttagttgggaattcaagatataaacatataaaaagacagtcatatacaacaataggagggaataaaagtgtaagctggagcaagtgaatatagaaatgcttaacaaacattactaagcacctactatgtgcccagaacagtgctaactgcaataaataaaggagggaaggatgagattcaaataacatctatttgtaaaacaccttataaacatttacaaagctctctcattaagtatctatatgttaaaaataaggcaatgcacttgaatgtgcagcagtgcccacaatgtgcctggacaccactccagcgccttgcagacctccaagccacagcctagaagaggaaactgcaggctggtgtgggaacgtgcatcaggttagcacccaagaagaacaattctgataggtgaggagatacacacaaatgcataacagctttcgatcttaggaagttcatggtaaggtagataagatgtatgtgaacatgatattacaagttagaatgtggtaaatataaaaagtagtaatgaggggacactaagaaaagacctcttggaagaggcacttgagttggtccttacagaatggagagaacttgaacgtatccaacatgctaggaatgcgactttagtccagtcccttattccttagggccttagtttctctgtctgaaaaacgggagacttatcagtgacaaatgctttgaagaccataaagtactataggaatgtattacaatcccaaataatgcaggatagtactttgatgtaagaaatagtcatttatcaaaacctactagagttttcctctgtaacaacctagaatgagaaacaacctagaacaaggggtaacagataagccccagccttcccaaatctaaagcagcttctgactacgtgaagagagacataaaacatatgacaactaagtaagaatatccctgaaaagtggtggctttgtggtctgtgcagtagcaattctctgtgtcacttccaaggcacacagtagtaatcttcatctacaacatctgtttctagcgagaagtccaaaacaggcatcgagctcttgaaaccctccacccttcaaagggtgctacacagaagtccagaggacacatgtcatgaagccagcttctgagaatgcaactgttttctcctacatctaacttatatatcacaacatgtctatggtaatgcttggtcagagtagcctatgaaacctcatttctttttttttttttattttttgagatgaagtctcactcttatagcccagactagagtgcaatagcacaatctcggctcactgccacctctgcctcccggattcaagcaattctcatgcctctgcctcctgagtagctgggattacaggtgcctgccaccatggctggctaattttttgtatttttagtagaaacgggtgttcaccgtgttagccaggagggtctcaatctcttgaccctgtgatccgcctcccttggcctcccaaagtgctgggattacaggcatgagccaccacgcctggcctgaaacctcatttctattgtgcagtcattttgacacttttgagttcattttatatttaactttgtgaaatgaaaatatcagtttttacctctttaaaaataactctgtttttcaaggaagctgggttgggtcctttttgaaaacactttggtaagtttggttcaaaactcaccagtgatgagtttactgaatttgcctaccacttcctactacctcccagcactcttggactaaagaaaattttggggaagagaaaggtttttttaggtgctataaattcttaagaggtcactgtttttcaaaaactttgcaaacatctggtgttttcttttcttttttaattttcagttcagttgtgaaatggtatttatatgtcactggcctgattagcgcttagtaaaagaattcttgaaattaaaggtttagcttcttacttttagctactgtcatcttcatatgttttgatttataataagtcagcctcctaattaatataccaattatttaggagctagagaactagatcttgggcttcttttccattgtgctttccttttggccacctgactgattgtaactcctgtttaggttggctggaggaaacggagagaaaatttacatctggtggagcataaagaaaccagctagaggactggccttgtcattatctaactgtgttgtgacgaactggcacttcctcatctctaaaagcagggccctgaactagaagaccgccacgtcacatgatgaaaaacactcaaactaacacttcttacccttgtgagcagccctactagcagatttaatgtgggaggaggttcacactacgggataaaaatcaagttttaggattccattttatctaagctgaccaccacaaggcagaggatcaagacttagctaaatacagccctcaggcaagcttcacttccccatctgtgaagggagaataaatacacatgttaagataaatgagagagctggtcaagtgtttcgagctctttggcagacaagcctgactttccaaaaaaagacaaaccacaacttcggagccagtgctatttcttctgtgcatggtgaggtgacttccccagttgtaaaggatttagagctgaaattccatattgtctggagctataattacaagtctcttgcactaaaacagaggtcagctggcctaaagcatgctgaaagaaggtaaatgtctggtcacatttccatgtggtatactcctttcctaactttttggcacaaatttcatgttgatagaacattcattcactccacaaatatctggcaagtaggtgctgagtgctgtgtatagacgagtgaacacaacacagaccctgccctcattctgtgtagaggacagcagaggagtaggcacagggctctcagctagggcagtaccaccctatgtctggggggcatttcggacatttgggaggtgctgtcaattgccaaaatgaatggggaaactctgctagcatttaagggtgggagccgtggtgccacaatgacctgtatgaggaaaaccagctccaggcccgcatgactagtgagtgtactgctagacattcataaacatgaaaaactcttttgtgggaaaacagcctgttgcatagcaagagtgatccatcttgaagtaaaactgccatgatgaccaatgtttgacgcctacaattcaaggtggtccagtagcacagataagccctcacaacctccccgtggtcatgagtttctaaaggaagtcagggatgatgagcttcctgtgtctttaccctaaaagcttgctatataaaggatactttctggaggttggttgtgagaatccaccatctcttggcctacctagacatcgtttctgtttctaagtctctattaaatatttctttctgagaaa

SEQ ID NO: 827 - DNA, 118776 bp, Homo sapiens
acatttttgcatggttcttgattgactttctggtgctctgcctggaggtctttgcttatctgtgagttgcctgagtcacatttttacatggttctggtgctctgcctgcaggtcaagaaggagccagtatctccaggaggagtgagagagtgctctgccagtgtgaagtgtgaatccttgagaggctgtggcaagggtccatgcctgaatgtgtagaacaagaacagctggaggctgtggctttctccaggaagaggtttctaaatctgcctcttagaagatatcagaaagttaaaggtactgtaccatcttcacaggccgaattcttactcagatctttacaacagggactggtcctgatctttgctgttgattgctttcttgttttcttggtttctatttgaatcgtcaccttttattcgtcttccttggtgccttttggttgtgcttatttcggctttatgtaagcagcatctctggatgcataaatgaggcagataaaattccccagggtgactgatctgcccttcatctattttgagcactgcagagaagttaccatggcccacagcataactcaatcactgtaagccagtgagcacattctgagtttttttttttttaaataacctttcctggaggcatttggcataagctaagcttaaaggcacatgattcaatcattgattattcaagacatgtcatacttaggcttttctaataaccatattgtcactgtcaactagatattgagctctggtttctaattttgcactggaagctgtacaaagtctattgtgttctgtgtgtgtgtgtgtgtggctctggcaatgcagaaatggcaacaaggaagtatctagcacccatgaaaagactgaagaacaccaatttgctttctctcagtcaagccatctttcttaagacaacccttgtcctgtagcttgaactgtttaatccttgtatatcttccatcccttccacccttagggaacctccataaggtgaggacaatgtgtcttttttaccacctgctattgtctaaatgttagtgtccccctcaaattcatatgttggaactaatacccaatgtgatagtatgaagaggtgagtccttttgggaagtgattaagtcatggatcagtgcctgtgttagtcagggttctctagagggacagaactaataggatatatatatataaaacaaactcatatatatatatatatatatatatatatatatatatgagtttgttaaggatatgtaataggatatatatatatatataaaaaacacattcatatatatatataaaacacattcatatatatatatataaaacacattcatatatatatatatatatatatatatatatatatatatatgagtttgttaagtagtattaacttatacgatcatgaggtcccataccaggctgtctgcaagctgaggaacgaggaagccagtccaagtgccaaagctgaagaacttggaattcaatgttcaaaggcaggaaacatccagcagtggagaaagatttaggctgggaggctaggtcagtctagccttttcacatttttctgcctgctttatattctggccacactggcagctgattagatggtgcccacccagattaagggtgggtctacctttcccagcccactgactcaaatgttaatctcctttggcaacaccctcacagacacacccaggattaatcctttgcatccttcaatccaatcaaattgacactcagtattaaccatcacagtgccctcttaaaagaggtgccttgcccttactgccatttggtaatataacaagaaggcaccagttttgaagcatagagcaagtccagacaccaagtctgctgttaccttgatcctagactttccactctccagaactgtaagcaatacatttctgttatttataaattacccatttaaggtattttgttatagtagcctgaacagactaagatatcaccatacctctgtagtttagcacagggcttaagcttaaggcagcatttattcattggttcattgatttatcagttcatttaacaagcgtttattggtaaacaccaacattccagcttgtcttggaatgaagtttccccatctttgataggaatacatgcttatcacttccatgtttgctctgagagctcccctatacctcctctacttcttggaagcatgctcctctaaggttgttagctctgccctcctatccagatttgttcttttcctttgcatctgcagaatcagcactatttctataacaaagtggttccccttacttctgaatatcactggtttcttttattaatttctttcattcaaggttaaagaggtagttatatgatgtgacctgtgatggtttcgtggtgtgtctgctttggcttggataaatcacatcccccagagctccttttctagtatgtttctgactagggtggtctacaagggagagtctcttgcaaaaattggaagatggaagtgaggcagcagctattttgtagcacgcacgtaccttctcctaattattgaaacactaatctaggtgctgctgtgaagggattttgcagctgtaaagtccctaatcagttgactttaaattagtcaaaagagatattattctatgtgacttaatcagttaaaagctttttaaaagagagtctagaccaggggtgtctaagggagagagtacagtcatgggttcttagtttctgtttctcattgggccagaaaagccccttcctcatccctcttttctgcttattactagagacggaaactaaaaactatggcttcaggttgctaaaagcctaaaacaaaaacaaacagaacaacaactacaaaataaagtggtttggataagcttgatctatactctccctgaggtcggagattccaagtagtagagcagaaggaaagttgtagaacttttctacgttttgggacaaaaacactcatgttgttgctgatctgctgatttgccttgttggtgtgaagcagcagctagtttataattcctttacttttcagatgtatctacttccaatttcactgactcttgggttaagtgtatgtgtacagctccatgacaaagagccctgacttctgcatgacatcctcatcactgagctcatccttgtggtagtctagcctgcttatggctttccctttctgattacctgccttgtggatgtcaggcctgcttagccagctcctacagttgtgtaagataattctttgtaaaaaataaatggatatattaaaaaacaaaaacaaacaaacaaaaattttctgctggttctgtttttcatgtcaaaccctgactgatacataaactgaagaagcaattgttgccttatatatcattcagttggacggtttggaacccagatgtccaccagcattcattcaattattcataactgtaccatagttgacaatatagcaataaacaaagcagatatggaccctgcccttggagagtagattctagcaggaaacagatgttatttaatatttataggataatacattagcatagagttgtcagaaggtgtaactaggagaccctgcctgaacttaggtgtcagagaagagaagtaagggcctggaagaaagagtgagggcctgacaacaaatgaaagtaattcaggaggttctgcaaagttgtcgttcatggcagtagaagggatgaggcttgggagataaactgtagagggctatgcaagccaagataaggatgtctgactttaccctaagggacaaatacttttatttaaaaaccttcatgttttggaatcctatatagttattttataatgtcacaatgtggttatattttgaacctttgaagatcccatggtgttagtgtgtttgatcagccattcctgcccctgtcctcttatttttttgcacattttttacaatcctcttgtgtaacccatgatgccctttctattgtgcaagcatcagttggctactgtcatactagtcatagtatttttaactcgttctcctgccttatgctttgaattctcacccattgaaaggaaaagaaaacaaaacctgcacttttcaaattaatttacctgacagtttcctcttgtcaacgtttactttctgctctatttagatgtacagaaaagcttccggagggtgggcattccccagcctcattattcctgttcttctgacaccacctgcggtgtgggagcttagcccttcctgaggctgttaaccctttcttactgctgagccccctgatgctctaaggattttcttaatgaagtaattgatttacttactgaagtaaacgccatccttgaaaactagagcagtaaataccatcaattctatggactagagagaggaaacactgaaatggtgctagaaggtgcatgacaaaaccagtcacaaatctgaatgaggttgaacagtgtgaacctagggtcagtattttttttttttttttttttttttttttagacagggtcttactgggcaggagtgcagtggtgcaatcctagctcactgcgtgtagcctttaagtcctgggctcaagcactcctcccgcatagctggaattacagacaagggccactgggcctggccagtttttgctttttttttttttttttttttttctctttcattattttcaggtttccctgtagctgtctttgggaaagcagtgaagtatagaggttaagccaaattgtaaattgtaaagccaaactgatttgggttgggagtcaagttctactatagcctatttctatacttgtaacatgggagtaatattactacatgtaataggtaaaaaacgtgacatgtgcaaagtaactagcttagtgctaggcacatagacggggctcagtcaatttggcatattaagcattatgatctttatttttcatctccaaatatttattctgaaaactggaacatgctgataaggtaagcatgtgacactggaaatgcaaaatgaaaatttacattctctaagccacaaagagctacattcacacagcactgggggaggtgggcaggaagaggataacctactcccagccaagggaggcttctgacaaccttctcctagcagcaaggactcatgtgtgaggatctcagcacctgagcactcaccagtcctaaaatcctggagtcttagacccccaaatcttagaatcatctcttaacaaaattttatttttaaattgacacataattgcacatatttataaggtacatagtgacgttttgatacatacaatgttgagtgatcagatcagggtaattagcacatccatcatctcaaacatttattatttctttgtgttggaaacagtcaatatcctctcttcttgctgtttgaaaaaacataatattgttaactatagtcatcctacagtgtcacagaacactagaatttattcttcctatctacctgtaattttgtattctttaacaaatctttctctatccccctgttctgactattcttcccagcctctggtaacctctgttccactttttacttctctgagatcatcattttttagcttccacacttaagtaagaacacgtggtgtttctgtctgttcctggcttatttcacttaacagaatgtctgccagtttcatccatgttgccatgaaagacaggatttcattatttgtaatggggggatagtatttcatctcatgtatataccatattttctttatccattcatctgttgttaaacattttggttgattccttatcttggctattgtaaatagtggtgcaataaacataggagtgctgatatctctgtgatatattcatttcttttcctttggataaatgccctgtaatgggattactggatcaaacagtagttccatttgtagttttctgaggaacttacatactgttctccatagtggctataaagagtttttttttgtaaatagttcctttacgaaaattagccaggcatggtggtatgtgcctgtagtcccagctactagggaggctgagacaaaagaattgcttgaacccaggaggcagagtttgtagtgagctgagattgcaccaccgtactccagcctgggtgatagagcaaggctctgtctcaaaaaaaaaaaaaaaaaagttcgtttttctctacctccttacctgcatttgttattttttgtctttttgataatagccatcctaactgggatgatagacaatatctcattgtagttttcatttgcatttctctgatgattagtgatgctgagcattttttcatatatttgttggccaactgtacatcttttctgtttggatcatttgcccatgttttaattggattttttttttcttgcttttgagatgtttgagtttcttgtgtattctggatattaatcatctgtcagatgaattgtttgtaaatatttcctatcattttgtagattatcttttcactctgttgattgtttttctttttcgctacccagaagctttttagtttgatatcattctatttatttttgcttttgtgtcttgtgtttttgaggtctcattcataaagtcttttcccagactaatgtcctgaagcatttcctctttattttcttctagtagttttatagttttgggtcttacttttaggtgtttaattcatttagggttggtttgtgtataggtgagatgtgggggtctaggttcattcttctgcatatggatatccagttttcccagcaccatttattgtagagactgtcttttcccctatgaatattcttggtgcctttgtcaaaagcagttggctatagatacatggattcatttctggatcctcagaattgttctcagtgagcaattctgttccattgttctatgtgtgtgtttttataccagtaccttgccattttggttactatagctttgtagtatgttttgaagtctggtagtatgatgccaccagctttattcctttgcttaggattactttggcttaggattacttatgtctcataaaaattttagtgttgtgtttttctatttcactgaagaatgtcattgctgttctaatagggattgcagtgtatatttctttgggtagtacagtcatttaacaatattaattttctcagtctctgaacatggaatttcttttcatttttttgtgtccccttcaatttctttcatcactgttttacagttttctttgtagatgtctttcacctcctagattaaatgcattcctaggtagagtgtgtgtgtgtatgtgtgtgtacttattgtaaatgaggttgctttcttgatttatttttcagctagtttgttgtttgtatataaagatgctactgatttttgtatgttaatttttgatatggtttggctgtgtccccattcaaatctcagctgaattatatctcccagaattcccacatgttgcgggagtgacctagggggaggtaattgaatcacgtgggctggtctttcccatgctattctcatgatagtgaataagtctcatgagatctgatgggtttatcaggggtttctgcttttgcttcttcctcattttctcttgccactgccatgtaagaaataccttttgcctcccaccatgatcctgaggcctcttcagccacgtgggactgtaagttcaattaaacctctttttctttccagtcttgggtatgtctttatcagcagcatgaaaatggactaatacagtaaattggtaccgagagtggggtgttgctgaaaagatactcaaaaatgtggaagcaactttggaactgggtaacaggcagaggttggaacagtttggagagctcagaagaagacaagaaaatgtggggaagtttggaacctcctagagacttgttgaatggctttgacaaaaatgctgacagtgatatgaacaataaggtccaggctgaggtggtctcagatggagatgaggaacttgttggggaccagagcaaaggtgactcttgttatgttttagcaaagagacttgcagcattttatccctgccctggagatctgtggaacttggaacttgagagagatgatttagggtatctggcggaagaaattcctaagcagcaaagcattcaaaaggtgacttgggtgctgttaaaagcattccatttaaaaagggaaacagagcatgaaagttcagaaaatttgcagcctgacaatgcagtagaaaagaaaaatccactttctggagagaaattcaagccagctgcagaaatttgcataagtagcaaggagcctaatgttaatacccaagaacatggagaaatgtctccaggccatgtcagagaccttcacggcagtccctcccatcacaggcctagaggaccagaaggaaaaagtggcctggggtccctgtgctgtgtgcagcctagggactttgtgccctgtgtcccagccactccagctgtggctgaaaggggctaacatatagcttgggctgtggcttcagagggtggaatccccaagccttggtagcttccacatggtgttgagcctgtggatgcgtagaagtcaagaattgagggttgggaaccttcgcctagatttcagaagatgtatggaaatgcttggatgcccaggcaaaggtttgctgcaggagtggggccctaatggagcacctctgctatggcagtgcagaagggaaatgtggggtcagagcccccacacagagttcctactggggcactgcctagtggaactgtgagaagaaggccacctttctccagaccccagaatgttaaatccactgacagcttgcaccgtgctcctggaaaagccacagacactcaacaacagcctataaaagcagctgagagggaggctgtaccctgcaaaaccataggggaggagctgcccaagaccacggtaacccacctcttgcatcagtgtgacctggatatgagacctggagtcaaagaagatcatttgggagctttaaaatttgactgccctgctggattttggacttgcatgggccctgtaacaccacccccgccttttttttttttttgccaatttctcccatttggaacaactgtgtttacccaatacttttacccccattgtatctaggaagtaactagcttgtttttgactttacaagcttatagacagaagggactttccttgtctcagatgagactttgaactgtggacttttgggttaattctgaaatgagttaagactttggggaactgttgggaaggcatgattggttttgaaatgtgagggcatgagatttggaagggccaggggcggaacgatatggtttggctgtgtccccattcaaatttcaactgaattgtatcgcccagaattcccacatgttatgggagggacccagggggaggtaattgaatcatgggggccagtctttcccatgctattccgtgatattgaataagtctcacaagatctggtgggtttatcaggggtttctgcttttgcttcttcctcagtttctcttgctgccgccgtgtaagaaggaccttttgcctcccaccatgattctaagtcctccccagccacgtggaactgtaagtccaattatacctctttttcttcccagtcttgggtatgtctttatcagcagtgtgaaaacagactaacataattttgcattctgcaactttactgaattcatttatcagctctaaaagtttccggtagagtctttaggttattctatacatacgatcatatctacaaacaggaacaattttactttctcctttccagtttggatgccttttgtttctttctcttgcccagttgctctggctgggccttttagtactatattgaataagagtggtaagagtgggcatccttgtcttgttccagttcttaggggagaagatttcagatttttccagctcagtttaatgttagctgtgggtttgtcatatatggtttttattacgttgaggtattttcttttcatacctaatttatttaaagtttttatcacgaagtgaagctgaattttatcaaatgctttatcttcatctattcatatgatcatgtgatttttgtacttcatctgttgatgtgaggtaatacttgtattgatttgtatatgttgaaccaggcttgcatccctggtatgaatctcacttgattgtggcatataatcttttagatgtgttgttggattcagtttgctagatgttgttgaggatttttgcatctgtgttcatgaaggatattggtctgtggtttcctttttttgttgtgtcctttatctgttttaggtctcagcgttattaagcattatgatcttgaacaaggtgacttctccagaggcaaagggggatttaactgccatttactcagcagtttgctcaatagtttatctttcccctttttactcattttcatacaatgggagtaagaagccttgtttgctttaagagcagtacctgatttctcaagttccaaatcaggaatcatgatagaaagccaggttcatgagttgtgaggatcctcgtagaacttgcccagattattttaaaagtgcattgggccgggcacggtggctcacgcttgtaatcccagcactttgggagactgaggctggcagatcacttgaggttaggagtttgagaccagcatggccaacattgtgaatccctgtctctactaaaaatacaaaaattaaccaggtatggtggaacacacctgtaatctcagctacttgggaggttgaggcaggagaattgcttgaatctgggaggtggaggttgcagtgagctgagatcgtgccactgcactccagcctgggagacagagtgagactttgtctcaaaaaaaaaaataaaaagtgcattggaatgaaacattttcagaaatagatagtggtaatggcttacaatattgaaattgtataattaatgccactgaattgtacacttaaaaatggttaaaatggtaagttttatgtcatctatattttaccatgattaaaaaaatactaaaagaccaaaccaaaaaaaataaaaaaaaaaaaacccaaaaacaaaaaagcaaattggagacaggcctgctggctgtctgaataatcccctccgcccactagcaaatgtaggttagctcagtaataatgtgacccacttaagaactgtatggggactattgttgctaactgattccagaaggtgagttagaaaagcccatatctaacctcctcactttacagaagtgaggtcggagaccctgcaagtgtgacttgctgaagactgtgtagcacccgaatactctgggaacgagctcaccaatgctgcacaacaccatgctgactcactgaggccactggaacattccaggccttctgagcactgaaatgagggctctttttgtccattcttactccaggtgcctaatccttgtcgctaagcatccagttgctcagagttctaaaattgtacaaagcaggaccaaggcattaggtttcagtcacagccaagcaagtgtggacagtgagtaatgtctgaagattccatagcttgatcacagctacttttgtcctgctgtctgaactccattgtcaattctcaaacaggccacactctcatgataggggccattcatatgctgttccttctaccttgaattcccttctctactttgatatttcctattcttcaggtttcaggtgaaacatagctttgtttagaaagctttcctatcctcccagcctatgttagctcagcctattgtgtaatttcttagtaacctatacttctttgtagtcttcatcatactggtaattatttgtattatgtctgagttccacacgtgagggcaggatcttggtctgccctgtccgccactgtttcccaagaacctagcatagggtctgtctggcacatttgtgttcattaaagaaaaaaaataaattaaccctgtcttcttatggaagaatgaagataatgatatagccttacttgtattaacaggcatgtgtggctgaaggaagtagggtagacactccctttaatctgtaggcattagttgatactccaaagaaatatgcaaatgagcagggtggaggggctgagtgcgactgctcacatttgcattgtatgcatgtgagagtaaacagtaaatcaatagcagaggggatataggttggatataaggcaatgttttctggtatgatattaaagattgttaaaaatgggtcacataacagaggaaggttgtggaaacaccttccctagcggcttcagaaaacaggccagagttccattttagccggttattttaggcctactccaggcagcagggtagactagacatcctcttagggtccaatcgttccgttcctctgacccataataaataaagctatagatgccgttgttgccaatacatacacaaatgcaaaatgcttctacacagtcttgtggctgtaaatgttgctagttcatcttctacttagtgttctgaattcaccttttgtttagaaaattacctcagtctttaagcacggcaatctctttctctaaaggatttattctatatttcaaagcaagaactgcaatgcatactaatttaacgtttgtattgacacttaccttaaaatgtggagaatacaagctaggaaaaaggatttaaaaaatagcctgctagtccgactaagttccagcatacaaacagagtgatctggacatgttgtgtgtcataatcccagtgaggaggctgggacacattttctttctctgcctttaaagtgaaggaagggaatggtcttgaatatgcaaatgaatctaatttaattaacttttacgaccacagctcctttgagataatcatgggagccaattcgatttccttaaaattcagccatttccctaaagcctccatgagacacccttgtcttttccaagaaaaaaacaaaaacaaaagcaaaatgtgaaaagatctaatcagaaacaatgaaaaagagtaagttatctgctgcagttcttctatttggtctcaccagaagctgctcacacagtcatttacttcagtttgtcactcctgagtctggcgctgccagccgcagagtgaaatcatttcaggtcagtcatgtaactgctgacccagagtttatcctaaactggggctatgaaaggtaaaggtaatgatatttcatgcttctgagcaaaaactcaagcctcgtgaggctgagggaagaattgccttgacctcaggccagagatgaagacgaatttatgccacttcttcctttgccataatattctttccttgtcctccccctgattacaaatataatacatatttattggccaggtgcagtggctcatgtctgtaatcccagcattttgggaggccaaggcaggcagattgcctgaggccaggagttcgagaccagcctgacaaacatggtgaaaccccatatttactaaaaatacaaaaattggctggatctgatggtacgcctgtaatcccagctacttgggaggctagggcaggagaatcacttgcacctgggaagtggaggctgcagtgagccaagatcgtgccactgcagtccagcctgggcaacacagcaagactctgtctaaaaaacaaaaaacaaaaagcactccatatttattgtgaaaaataaaaaagagaacagaatgactaaaagaagctgctcagatcttggaagagtttggaaggctctttcccaattttgattccttcttttccccttaataagcagacttttagaggactttgtgggtggtggttgtggtggtagtggaagacgggggtgctaagtttgtgaagtggggatgttacattcaagttctttttcttttttttttccttaaaaatttttttttattgtggtaaaatactcataacatttaccattgtaatcatttttaagtgtgcagttctgtggcattaattacatttacattgctgttacccattgctgtcatccccctccagaaatttttcatttttcccaactgaaactctgtgctcattaacgataactgtccagctcttggctaccactattctactttctgtctctatgaatttgactattccaggtacctcacatcagtggaatcatacagtatctttttgtgatttgcttatttcagttagcttaatgtcctccagtttcatccatgttgtagcatgtatcatgtcaaaatctccttcctttttaagggtgagtaatatttcattgtacatatatatcacatttgcttttccattcatttgtcaattgacacttgggctgcttccaccttttcgctgttgtgaatagtgctgctatgaacacgggtatacaaatatctccttgagaccctgctttcaattattttgagtatacactcagaaccttccttttcttttaaacctatattccacaccactcacctctcttgtttctaacactatgcaattacatagctgcccatggtttctaaatcctggcccctgaatcattgttcatggttgaaaagtatgtggtggttccacccattatccgatccacctgaaagtgccttgagacacgttcggcaatgtgcaattgggtttctgggagctatgctacctgctagttctagaaacattaaatgtcacatgacttaaatattgcaattaattttagcatgaccagaggcaatatttctacttcttcacataggcgagctatgtctaaaacaaatatcttctgaagagtaggtcacagtgctgtgcattacatgattatataattgtgcaggctactaattggaatgtagagttaaagttactgtaggaggtttttcaactgagtagattaaagaactcaaagtttatatttcctttagttagatttttaaaataataaagtacttaaattctaacaaaagatacacaattataaaataattagaaagaaaaaagatgatgtgataaacagaccacttctgtgcttataagacaaaaggagaaagaaaggtaataaaaaacaattaaaaccaaagttattttcccactgataattttatctgtctttcttttcaagtcctttagtctcaaaattattcactcttccatgtcctagtccaggatgaatattctgtgcctgaattattgcaatttcaacagctaaaatctattgaacacttaattccatgccaaacactgttagcctaaagcatgtatcagcttactttaacccttgtatcaacattctgaagtcagttttatcactcggggcaactgaatatctaatattcattctcctctcttcttgcttgcccacagagtgcaattttgcttggagtatcaatgtattcaattaaatactcatgttcccagtctccatcactgctaagaggtccggtgatccagttctagcaaatgggatgtaagcagaagtctgctgggggcttctgggaagcttttttctttcctgataaaatgagacacacatagctagattaaagctcttgacgtgcccctgcttctttctgttttaagtctatgacctaagacagaaatgttatggctggagctatagcagccaccttagaaacacaaggcaatgagccaacttgctaagaaaggcagagttgaaagctagagagaacctggaatcctggtggcattgctgagcagttgaatcattcccagcaactgcctacctctctaccttcagttataggggaaaaataaactatttatttaagctatgagtagacgggtgtttagttacttgcagctgtaagccttcctaatcccatgtttcagttaaggaaataaaagcctaagtaacttactaaaatatatatgatccttcagtggtgatatggtgatttgaacttatattatctgacctagagtctaagcttagtctcttagacatggttctatgtcacatcccccttgtgctatattgcaaggtctacttatgagtttttcaggaaataaacttgatcttgagcctccctcttacttcttcttctcacagatgccagtgtgatacatctaaagccagatctgaccttctcactttcttgcttaaaaccatcaacaatatttctttctgtagagctgggatgtaacctcaactgtcttgagagccaggtagataaaataattgatagaggcaagtagatcataagaaaatcaattttgttggtgtattagttagctactgctgcgtaacaaattgcccccaaaacttagcagcttaaaacaataaatgctcatttcttatatggtttctgagggtcaggaatctgggagcagcttaactgaatggttctggctcaggtctttcatgagtttgcagtcaagatgttgatgggggcttcaatcatttgactactagaatggagctggaagttctgcttcaaaaagactcactcccatggtgattgctggaagcttcagtttgtcaccatgtgggcctctcctcacaacatgtcagctgttttcttccagagccaagtaatctaagaaaggcagaatgacagctagcctgggaaatggaataacatcacttctgtcacattccattggccaaacatatcaaacttgatacagcatgagaggggactatacaagaatgtggataccaggaaatgaggatcagtggggaccagcttggaggctgacaacaacaggtagatattggacaaaagggtaatatttgctatttagtttcagccaattgttccactacgtggaatacaggtcttatgttactggattttcccatttctcaaataaagttagatatatgagtttctgagttatatcccatggtagtaaatgctgactcagaattgtaaaaaatcctgtgtaggtcaaataaaatacaaatgcagttcagatatggcctgtgagttgccattttgcaacctctgtggcccatagcttggaaaacatatgtaggtccaattccaatctgtgatactgcctgaagtgatattttcagtaggattttgaagacaagtccaggcctagccaggaatgtaccatggtaatttaataatatcttccatggataaaggaggggagagtgatgacatatgtgcctcagattgacagagacggctatataattcattacccaaactaggatacttttgagagtaaagggaggtgctatattaattatgctgacatagtgaccataaattaggactgactcaggcaaaccaggatgtgtggtcaccacctgcactgcccttagtgaaaccttcccacttctgaaccccgctgcccacactcctgctgttcccccgctcatcctatcttctcttccccactcatctgtttcctcctggacttcaacttcttcaagttccagtggaagtatcactttttttcctgttgtcttcacctcctcccctccttttcaggtgaatcactcttttaccagagttttgtagtattttatacatatctttaatgcagcatttctgacagcaacctatgcacaggggccagtggttactcatttaggattctcagtacctatctcagcatctggcttaaagtaggtgcttgatgataatttattggaattttattttgaatctcacctcccctctttttctctaataccctctgcaggagatgataatgaatagtgaaaaatgccaagcagacaataagcagaaggaacagaggaaatccacaaactggataattgtttcttgagtaactgaccatcaatctagatagtggttgcagtaatttcaaattcttctcttccttttcacttcaggtgaatgaaacctgttttcaccgagaatgagcttctgtcttgatagtaagaatcgctactatcgcccataacgtatagactaaattctcagtgtatgtatgtgttttataaaagctatcctctaggaagttcataactaagcagtgaaaatcaatctcaggcatacacaggacacgtaggaagatttattctctcatgtacgcatctaacatttagtaatacttgtgcattgtctataaacctcaggggggaaaatagaaactgctggatagcaatgctctctataaatgcccatgagtgaaattaaactggaagatgttaaagggaaagctccgtgggactgaggtgtgtttttgttagagatgggtagagtgaatggtaggacgccattataatccaacaaattattattaattgcaatcctaatgtcagagaggtggggtggagcaaaggataaccacgtgctaccttttctttggtaggctttcatttggtctcttttcgaatcagaagacccagaaaacttggatccacttctggctctcatccctctgggcagtgtgatttggagtaagtcataacttttctctgtgctatcttcctgtttaggaaggggctactagtagcaccaatttcacaaggttatatgaataaggtatgtgaaaagactttgtagattggggtgaagtctacaaatggtagttaggactattctcaggctgatgttcaggcagcgtgttggagagagagtgggagggaggaacagaatggagaaccatacttaagccgcccccaggcctcctctgaaaccctcccatgaaagcaggttaataatactacccaataaagcaggaacacttagaaattagtcttgaacaagattaagtttgccaaggagggctggtcctgacatcacatgctttaaacctgtggttggcagccaattggttgctctattattacctgctctggagagggtgagtctacagtggaatgctctttccttggttcaagctgtttctgctgagtcccatagagttgattatagttcttatactctgtaactggctgtttcattcttgactcacctccagactcataaatatcccacagaaaacacagaggctttaaaagttgcctatcttttaaccttgtgctgtaatatgttttgtagaattgccaagacatacagtatttttcctgcctttccaatacctattcaggagcaaaaaccatgataaactccctttgcatcttttgtaagagagctagacaaacgccggagagtttctctgcagttgtgtgaccttgggtagtttcttcaactacagaaagagaggtaataataactaatgtggaggctgttgtgagcatgaggaataatttaaggaagagcacctggtacatggcaaatgtcccataaacataattgctgttgttattaataataacgtgaaaagcattcagaacaaaacatttgaaatgagtcccggaaagattaatttatacttaatagtcaagagactatctctcaatattttctatgtgctgatttagaagaaagtccctgctctagctggagagacaaatgtcacacacagaaatttgaataatgcaatagatggaggacatttcaatatattaaaaaactattaaagaagataacccaagatggaccgagtgtacctacaacgattttgttgttgtttttttgtttttcagttgagcagatgctccggctgccactccatcatatattggaaacagcattactttatagtaaatcatgaccacggtgtatggcaatgaagttgcatctgaagcagccggcaccctatgtgctagctggcttttagaccaggagactgtgaatctgtggtcaggatctctttagggctgctaaatatatactacccactatcactcgctggagctgcagaccctagttttagagtttcacttcttaaagaccttcatccttattaaaatggtaatatccttactgtcatcaatcactgacacattggtatgagtgagtttgagtctggtttgaagagtaggtttactggaggaggaggctcacagggaagctgggagggaacccacagctactctgcagagaaggagagagggaggtgaggtgtggaggcaaggggaagagagggtggctatactaacagtctcctggctagagaggaggattggaccattttgcattctttttttttttttgagacagagtttcactctgtcgaccaggttgaagtgcagtggcacaatcttggctcactgcaacttacatctcccctgtgcaagtgattctagagcctcagcctcctgagtagctgggattataggtgtgtgccaccatgcctgactaatttttgtgtttttagtagagacggggtcttgccatattgcccaggctggttttgaactcctggccttaagtgatccacccacttcagcctcccaaagtgctgggattacaggtgtgagccactgagcctgggctattttgcattcttaaagtagctttatcgttcatgcctcttctcctctatgctagcactggttatacttacaaagatggagcatgattttcttccttattcttctctttgttctaggaaccagaaagaacaggtgttaatcttattagcaaggaaaggaggcctcagcaatagcgagaaaccgaacttatttgtgaggccttgcattttgatgtgaattgtttccagggatttaaaaatattcagtaaaacacaaaaaaagtaatgaaaattttttaatagcctgaggtgagtatagtgtagttcttctggtgggaaaattatataacgttaaatcatccttcttcatgaagatatatgtattcatatatgaaactgaggtttcataggttgttgtgaatggttcaaagagctatggataggccgggcacagtggctcatgcctgtaatcccagcactttgggaggctgagttgggggggatcacctgaggtcaggagtttgtgaccagcctggctaatgtgacgaaaccctgtctctactaaaaatacaaaaattagccgggcatggtggtacacacatctgtaatcccagctactcgagaagctgaggtaggagaatcacttgaaccagggaggcggaggttgcagtgagctgagatcaccccagtgcactccagtgtgtgcgacagagtgaggcctcatctcaaacacaacacaacaaaacaaaacaaaacaaaacaaaacaaaacaaaacaaaaaagagctatggatagagtgatgggaaaactgaaagtagatttactgttaatttttgttaatcaccatctataattattttatatatttgtgtacttatttattgtcagagtttccccctagaatggaacccagtgagagcaaggaccatttctctgttctccaccatgtctcccaccacctaacacagcggttggcatacatttgaggaatgaccagtttggttcaaaattacctttttcctaaatttactttaatataagcactaaaatgagatacctgaagattgtttgaaacataaaaactcaatcctgacatgaaattatatgataatcatgaatatattctctgctagacccagattagtatgactctatattttcaacatctgccattttaaaataaattattcaacattattagattccttataaatgacatcaattagcactgcaaggctgagtcttgagggatttttttttttttttttagaggctgggttggtaaatgtcttaactcttcatattccctagaaaggatgaaagcaatctgggctcccagcaggctccctcccgcccatccctattgaagatttaattaatgtgcacattattttgggctgcccattccaacactgctggacataggtagaagtaagagtttgaaccaggagaatgggacggaagcccctgctccccaccattgggagagttaaaactggcacttcccatcgtttagtggcagtgaatcaaagactcttgtgctgactgctaaagacttgcttttatatagaagtccctgccaggcctttacatattgaaatgaatcattgtcgcctgtgtcagttttgctcttcatttgcttgatgtatttcatctgcatttggaggtattaagaatcactgtttgatctattgtatttattgtcacacagttatactttgggttttctgcaaacctgtagaaaatatgctgcttaaagatattaaagggccattagcatcctacatcgtcaaagcatttaattctaagacacctcttaaagtttaataagacaaaagacttgctttttcttaaatctctagactagggtgaccagcttgtcctggtttgctaagtactttcctggttttaaagctgaaagtcccacattcctggtatccttccaggcctggataaatggaggttagtcaccctatccctccttgtgttgttgggagaccttatcaggacttcttgaaaccagagcatacaattgatttgagtccagctttaagttaaagaataataaatctctaccatggcaaagaaactaaagtcaataagtagtaaaagtacactatggaattgccgtgtgcagagttctttgaagtactactctttggaaccagcctgggattcagacatttgtgccttgctgctttttgatccaaggaatgcagggtcaagttatcagaaacatttgaagttgtttagagaattgtgaagaatttcactaggctaaacaaattatacatcttgggattgattgcaaagaggcttaggatgatagtgtctgcatcaaagatgcagtgatgcctttgatagaatgaatcactgctactaaaccatcttaaatgagaaccagcttttccctccaaaccaatcggattgatctgtgcattgaaatatgttcctgtcacgatccttttactgcattggagacaagaatgctgcaaaaagaagtgccagaagccatgcttgctgggattgagaatatcttatttacggtctgagcgcattatggtttgaccactcctctatcgtacatgctaattccttgaacattactaaaggatcctctgaacttctcagtctgcttttccaatccttttttttttgttattgtgttctgtgttctcttatgtgatggtcagtggggtgtggccacaagaggccacacatcagaggctcaggaaaacaaagtttattatccccagagggtctggaaacaggaggcatctttactggggttttcatggggaagacagggcagaggaaactggaattggctagtttgaataattcctgtaagctttgggctataggagtagtctttagtttcctggtatgcagcctgggatgattaaggcagaggaatattgcctcctggtagaggaggtatggctctggactggttagttttcataacaaaggcattctccatgagccctctgctatctctaagaactggctaacccaaaaggggcagtctctcctgagctagatttttaagatgttaaaacatcataacaggccaggcacggtggctcatacctgtaatcccagctttttgggaggcgaaggcgggcggatcccatgaggtcaggagttccagaccagcctggtcagcacggtaaaaccccatctctactaaaaatacaaaaattagctgggtgtggtgccgagtgcctgtaatcctagttacctgggaggctgaggcaggagaatcgcttgaacccaggaggcagaggttgcagtgagcctagattgtgccactgcaccccagcctgggtgacagagcaatactctgtctcaaataaataaataaataaataaaacatcataacatatagaaaaacattacaaacaatacaaattgacatttcattgattcccagagagtgaaggcagcatggcatagcagaaagagggaggtctgaagtgaaatcgtatgggtttaaatcttggctttgcctgatatgaactgtaaagtgtaggcaagtctgttgacttctttaggtctcagtttatcatctgcaaaataggcttaacaattcttgtcatgattgctgggaggactagataggatgatatatgtgaaagttcttagtaggtacagaaattatactaaaaaagacaaacaaatccacatgctatgatgcagtgtggactatctttggtcacctacatgtcaaaggtggtcttaaactgctctggtttggtaaatgttggagtagactagaagtcagagagtacggaatccacccttatttgctctcaggctttggtttacaatgagctcaagtgtagggattgtgtcaaatgattcctggaatcctttacaatttgtaaaattctatgaattcgtgaagtctgcaaaatgtgaatccgaggtgtatgtattgtagagcaactattagaccatttatcacattatacatatatatataaaattattatttttttgagacggagtctcgctctttcgcccaggctggagtgcaatggtgtgatctccgctcactgcaacctccacctcctggcttcaagccattctcctgccttagcctcccgagtagctgggattacaggcgcctgccaccatgctgggctaatttttgtatttttaataaagatggggtttcaccatgttggtcaggctggtcttgaactcctgacctcaagcaatccacccacctcggcctcccaaagtgctgggattacaggcgtgagctaccatgctcggccctatcacattatattttacagaagccatcatcccatacctttgagtccagccccagaaagagcagtcccttgcataccatccagcatgaccttgggcatcctttccccactccccaccatagctgtttcggctagagttggaaacctgtccacggtaggccccttggagtctcctgctggacacttgggattagaatggagacagtcaagttaacagacagtaatgctggacctggacggtcactagcacgtgttggaagctgagggcaccagccagtgtaagccactgtggatggtgtaataggagagcaaaggaaggcaatctgggaatgggttggatggggagggagaaaaggtgggggaaagagagaaatgtaaaatgagggaagcagaggaagagataacatggcaatgaagaaagtaacatctttggtcattttctgttccaatcacccacagcaggcctgtcagttctctcttaccttctgttctcttttacctaagtagattttagtggcttttctattcttgatctccaaccatgccctaagacatatggtaacacagactgaggattctctgacggcagggctttgtctcattcctttttggaacaagcacaaagtagatgctcaatgaatttatattaaaatgacatgaaaatcatatgtttgtatctgaagtgtcactgatggcatttatatgaaaaaggttaattaaaatagataattatgtttcaacaggcatttccctggatcttctcatttggtctacaagtattttttcttttcttttcttttcttttttttagagatagggtcttgttctgtcatacaggctggaatgcagtggcatgatcatagctcaggctggaatgcagtgacgtgatcatagctcactgctgcctcaaccttctgggctcaagtgatcctcccacttcagcctctccagtagctgggactacaggcttgtgccactatacccagctaatttttcaaaattttttttgtagagatggcgggggtgtctctctatgttgcccaggctgatcttgaactcttgacctcaagggattctcccgcctcagcctcccaaagtgctggatttacgaatgtgagccaccacatctggcacacaagtatttttgagtactgtcttcactgtgttttcgggagccacacaggatctagctcactgtagggtttattttaaaatgtctgttgaacggaatggctcaggattgttttacatactgtagagatataaaaagaaacataatttatggttgctctacataagcagtatccagtatagttgggaagacacatggaaaaaaaaatcaaacatagtgatttgaagtggatttcaaatagctggaagaatggaggttcagtgaggtctcatgtatttagagaagttttgtggaaaatcaggaagttgaattacaccttgagagctgggtgggatttggcatggtagagataggtagaagacatggtagagatggtagagacaggaagaagacaaaatgcttagcaaaagcttggggggcagtaatgagagttttgctgtaaacacaacttagaatttaatgattcacatgaagaaacctgatacaccgtgtccaagtacgggaggcaatggagtgccatggttaagggtgttgacgatggaggtagactttctggattcaaatctcagctcctccttccccccccgcccccgcaactgcctttgtgatgttgggcaatttacttttctgtgccttagtttcctcatctgtaaagttggggataataatagtacccacttcatagggatgttgtacaattggaggggatgctgttggtaaagttcttagattagtgtctggaacttagtaagcatttaatcaatgttaaccgttaattgtttttgtaatggaactctggttctatgacccaattaaaagaactatccagttaattttgaattgggtatagaatagcagatctcttggtcattaggtaagccagttactatctgaattggtgctggactactggtaggaactggtttatggtcagaagaacattgagtgtgtagaactcagtggaaggctttgagagccagggagaggaatttggacttggggacgatgggcaaggcacagtcatatttcctgagcaggggaatgatgtgatgaaggtgagaacaggagagcgggggcagcgggcagtcccgtgagcaccagtgagggagtgggggtgctagtgcaataattcaggggtaaggtgatgaaggccagggacaggactgtggctgtgagagggaaatgcagtgggaaactggagagacttcaaagggaaggtgtccacttctcacctcctctactgctgccaccctggtccaggcgactgtcacttcttgtgtggattactgcaatgttcccctaacccttctgcctctggccttgcccggaggtctaatctcttcacaggtaccgctttgcagtctggcagctttcctattgcactccgaggacaagctgaacgcctcgctcggatctacgaggcctgtgtgggaatcccgcttccactggcttcattccctactaggcatccaccccactccacgaggctgccatccctgacttcctccaacacatcaggccttcctcagggaacttgcctatgcctgttcttcttcttctttttttatacggagtctcgctgtctccaggctggagtgcagtggtgtgatctcggctcactgcaagctccgcctcctgggttcacgccattctcctgcctcagcctcccgagtagctgggactacaggcacctgccaccacgcccagctaattttttgtatttttagtagagacggggtttcaccgtgttagccaggatggtctcgatctcctgacctcatgatccgcccgcctcggcctcccaagcctgttcttcttaaatatctgcctaggctaagtgtggcggctcacgcctgtaatcgcagcactttgggaggcccaagtgggtggatcacttgaggccaggaattcgagaccagcctggcaaacatggcgaaaccctgtctctattaaggatacaaaaattaatcaggtgtggtggtgcatgcctgtagctccagctactcgggaggctgaggcacgaaaattgtttgaacccaggaggcagaggtttcaatgggcagagaccgtgccactgcactccagcctgggtgtcagagcgagactctgtctcaaataaataaataaataaataaataaatatctgcctagataattcctttacctcttttctcctttaagtgtctgcttgaatgtcatcttattagtgacccttagccaccgttttaaagtagcagcccttctccacctgggcactccctgttccccttaccctgtctggttttctctttgtagcccttatcactacttgacctaggagctctttatttgtttattgtcagatttctgcactgggatgtgagttctatgaggacagatgtgtttgactgtcttgcttacggatgtatccccaggaactagaacagtgcctggcatacagtaggtgctcaataaatgtgttgaataaatacataaataagaagtcagatttgttttgttaggcacaatgcccagtggcccttcagaagctgccttatttatgcttccagtgacgctgttcaaggaatgtattgttctcattgttttacaaatgacagcactgaggcagagaccagaggtgaacaggggcacagagctggtaagtgatgcagtcaggagttatgtccagttcctttgaccttggtgtcgccattctgcatggctaagatgagatggggagggaggcgtcaacaggatgccggggcttccaggttctggaagatggaagagcgtcagaagcactgacagaaatgcaaatgctgggaagaaggccagagcttcagaaaaagaagtagctgagggaggaaatgttggatcaagtaaatattcaggaagaaaatcctgcttttaaggagaatgactaaataatatattgtccaagacccctgtgagagtgaaagtgcgcactattttttttttttttttttttgagacaaggtcttgctttgtcacccaggctggagtgcagtggcacaatctcggctcactgcaacttccacctcccaggttcaagcgattttcttgcctcagcctctcaagtagatgggatcacaggtgtgcgcaatcacacctggctattttttgtatttttagtagagatggggtttcaccatgttggtcaggctggtctcgaactcctgacttcaggtgatccacctgcctcggcctcccaaagtactgggattacaggcatgagccaccgtgcccggctgcactattaataataaggtacaacaacaggcatacatggaggttgtcccagcaaagggggataagcggtccctttggattcaagtgattggaacatccatgaaagtcatgtctagagatttgggtatctcccttctagagatacacagggaagacacaaggttagggttcttatcatcagggagaagggggaagggaacatgaagaccagctttgagaccctacctgagataagtgggaggagaagaaagagcctatggaagacagaaccagaagggagaagaggtacagaggtcaggaggagaggggacaggaaggagggggagcggggaaggccacatttttcacgcaatttaaaagtaggtcagtgggaagctggtaacaaaaacaagactagagaatcacttgttttttgattttgtaacaaaatcttcatctgtttcaacacagtgctaaaaggcatttaattaaagcagctttgaattcattttgacttgagaactgtttttctgcggctcctatataaaccttgagactctttgggatgctttctttttttttttttgagacagagtccttgctcagtcacctcggctggagtgcagtggcacgatctcgactcactgcaacctccacttcctgggttcaagcaattctcctgcctcagcctcccaagtagctgggactacaggtgtgcgctaccatgcctggctaatttttgtatttttagtagagagagggttttgctatgttgaccacgctggtctagaactcctggcctcaagtaatccacccacctcagcctcccaaagtgctgggattacaggtgtgagccaccacttccggcctggggtgcttttaaaggctggatcaggaatcgggttttggtgtcccagcctgaagtttaaaaaagtttttttttaaatttttttaattttaaggaatgttatttgtttctggacaatttatttatttatttattttttactttaagttctgggatacatgtgcagagtgtgcaggtttgttacataggtatatatgtgccatggtggtttgctgcacctattaacccatcatctaggttttaagcccctcatgcattaggtatttgtcctaatgccttcacttcccttgcccaccacctcctgacaggccctggtgtgtgatgttcccctcgctgtgtccaggtgttctcactgttcaactcccacttatgagcaagaacatgccgtgtttggttttctgttcctgtgttagtttgctgagagtgatcagcctgaagttttttcctgtacctttgcttggcccaaggcaataagaggtcctgcattcagagtggcattgacacagatcaaatctgggccccaggtagaagatatagaagcaaaggggatacttctgtgatttctgtggggtcagaaaggttaaaaattgagtttctgagccagcatgagtaatagtgtctaaaatctggttttccatggtaaagtagaaattttacatttcatgaacaattcaagcagatattttcctaccttggcttcttccttcaatagagggagggagatggggcgggggaagcaagcaagccaacagaaccctagttcaaaacataattgaaatgatagcataaacaacaatgctggtgtctacaagtaacgtggtttaccagctctggtggtctgtctcataattgggaaagagagagagctaggttgctgagcacaacatttttgtctatccagacatgattagtccacttggctctagccagaaggtgccttttccaggtagtgacgatgtgcgcttagcacatggcttagtgttctcagtttattagagagtaaagtctcaggactgaggccatggaaacagaatcactctctcgcattctctgaatgggagtatgagtaattgtgtcgggtagcagcaaccggcagaggacaagcagcaggccttccctgcagtttcttttttatcacagcagaagtcttactgggcagaaatcactgtggcacacaacgcctgggcaccaaagggaataaaatctcacaggaattcaaagagaacaaagtcattaacactgagccaaagcctgctggcgtacatcgcagaaatcaaatggatatagagggctcctgagaggagaaaatgcataactctaggctaccctgcacaagatgctaatatcagtacctaaatagtggttttcacggaagcagtttttctgtagctggtgttcctgccacattggaggaaagtgtgtcaaggctgaccttgagcagaatgagaaagtaggagtttgttttggcacaccacaccgctctgtctttctcaactccaccctaaagactgagccttcttcaacagtcccatgcaaggttttgtactcaaaatgagaatttattggcagtatatggtacggcaccaactatgctcaatatgctcctcctttctcttttgatcacctccctccttcctcctctcctcttgtcccatctgttttatttccgtggcttttcttttcccttttcccttctttttgaccattcttcttttcttttccagaaatatgaaacagggagagagagaaaggatgggagggggtgcgtagagtggggctgggggagacagagaggggagtcagggagggagggttatctgttacctgtagattttaaatctgtaatgtttgttggggtttctttgttttgttggtgtttattttcgcctcatagggttgttgggaggattaaatgtggagtgtttagctcagtgcctggcatgcaataagatctcagtaaacactatttattagtaatgaaaagtttacccttggaataaacatcttcagatctaggccatctatttggggaatgggggatttcttctctcctcttaaaaagttcctttttctcaagttcttgttttatttttatctattattattatgatttttagaggcagggtctcactctgttgcctaggctggaatgtgatggcgtgatcaaagctcaccacaccttcaaactcctgggcacaagcaaccctcctgtctcagcctctccagtagctgggactatggatgcatgccaccatgcccagctaattaaaaaaattttttttttttttttagaaatggggtcttgctgtgttggccaggctggtcttgaactcctggcctcaagcaacccatcagcctcggcctcccaaagtgctaggattacaggtgcaagccactgcacctggctgctttttctgaaattcttttaggataattacatgtatacatgcacatagttatatgcacatgaatgtacatacacacacacagacattttctttctctgttttacagagggagctcaatgcagaaaataaagccaaggcttcaactttggtcgagtaaagtagctttcaaaaaattttaacctccacaactgccacttatacgtacctctatataaaacaacacacaaattttcaataaacaatatttatcttcactgctggcactattgtgttcaggtctgttccattctctttcatttaaaaaaaatgctggccaggtgtggtggctcacgcctgtaatcccagcactttgggaggctgaggcgggtggatcacaaggtcaggagttcaagaccagcctgagcaacgtggtgaaactccctctctactaaaaatacaaaaaatacaaaagtgcagtggtgtgatctcagctcactgatcactcatcttcgcctccccagttcaagcaattctcctgccttagcctcctgagtagctgggattacaggcatgtgccaccacgcccggctaattttatatttttagtagagacggggtttctccatgttggtcaggctggtctcgaactcctgacctcaggtgatccaccttcctcagccttgcaaagtgctgggattagaggcatgagctttataaattttaactcatttagtacacataaccactctaaccactctagatagtagactatactataattactccaggggaagaattgcctgttctttgtttccaatatctagccagaatccagaagacttgcatattatagaagctgggctaaatacttaagtagaaatgagaataatattatggaacaagcaattgctttcataagtcctgatgggcaaacaatagccaaagatggtgaccacaaacctcgaatcagcaaacctgagacttggcatattgctgtagttaggctgaaattatttgtgatgtactgcaaacttttgttgtaaaacataacataaaaatttagtcacatgtaaacattcacccagagaaaatttctgtaacatttgttgttttatcctgatcttaatgcaggataaaacaacaaggggccagggcaccccacctgcctatcaccctttgtcaccaccatcaccaccacccacagaaagaacagcctggtgtctgaaatgatgggtaaagaattgcttgtaaactaaaaagagaaaactcaaatgtctacctgtttagttaatagagttttaaatatttgacaaccttcattcttctctcattataaaagtaaaatgatgttcactgttaaaattctgaaacatgcagtgaaatgtaaaaatgaaaatataaatgaccccaagtatcaccacctacacacagcagctattcacacttggtgtagtgtgagtgtgtttaggccttcagacatgtttcatttggcttacccagtgttttaaaatgtttttcattataaaaacctggatttccagtatctcttgaaaaaataccaagatctgacaacacttggtccacattcttgcacaacagctgctgagagctgagtagctgctgcccctcttgggcagggcagggcttaagtatttcctccaccagagtccccaccgttcccatttttcttacacttggtcaggttcatttacttgttattctcatattctggtgggcatttgagttttctctctttcagtttacaagcaattctttacccagcatgtcagggatcaggctgttctttttgtgggtggtggtgatggtgatagtggtgacaaagggtgatgggtaggtggggtcctctggtcccttgttacagagggtgggggagcagaagtcttttatttctggattctgctctttcttttctagtatacttaacattttaaaaaagctccatatgtagaggattaatttcttttccttcctttctttctctttctttctttctttctttctttctttctttctttctttctttcttttttctctttctttctttctttctttctttctttctttttctttctttctttcttcctttctctctttctttctttctttttttcttctctctctctcttcctttcttttttttttttttttttcgagacaggctggaatgcagtggtgtgaatctcggctcactgcagcctcctcccggggtcaagagatcctcccacctcagcccgaaagtggctgggactacaggcatgcgccaccacagccgcccggcaaatttttgcatttttttgtagagatgtggtttcgccatgttgcccaggctggtctcaaacttctgggctggagcaatctgcctgccttggcctcccaagggatgagccactgcacccagcccatccactaaatctttaaatgaaaaactgccactggcctctgcagtccatacctggaattttttctaggccactggcttttaattttttttaaaactatcactcacaatgagaagtcagttctacaaaatgactcaacatatacatgtttacaacagaaaaaaatgtttcacagaacaatcacttgccctttatgtgatatacactggtaagttcattctcttctaatataattaaaaaaataaacgggtcatgacccattaaattgatgtaataactctcctacaggtcattactcttggttcgaaatacagctttctgggacaatttctggtttacaacttaggacttcagcttttctctttccccgacccattcaagtctcgcatgccattcttcaataatccctttaagccaatgacttgtttggatctgctcacctggatttgactgtccccaccctctacaccatgacttctagacttcagctcagtcatgggcaccacccagtccctgttgtgccccatccagcttgtgcggggcctgtcttgggttggcatcatctctctctatgcgttgttcctacttgacagggatgggaactatggtagaggatgaaacttcttgtcatgctgagaagagcattacctaccatcattaagaaaggctgtacctagagtactcgtaccccagatactcacatgtcggctccctcatttccttcagcttcagttctactgtcccctccccagaaaggcctttcttgactatggcacctcacctagaaccgtggtctcatctgttccctcaccttgctttagcttttctttttagctcttatagagggtctggctgtaggagtcatagaatgtaaaagcagggagagatttagagaccagctatgattcaagcctctaattttatagagaggaaatgcaagtccagagagataagtaaagagtccatggcatcctagattattcatggcaaatctgaactagaaaccagatccctgggtacttgtcagttcctcactggttatgatgaggtttttttttttgttttttttgtttttttaaactctgtcttataataagctctaggatacatgatattagactgtattatacttagtagtaaatagtggtatgaaaatgttctgcttgcaggtttcattttactctgaaacacacacacacacacacacacacacactgaagcataatgaggtaggtgacatagataccacctcaattaaataaagtgcaatatcaaagggaaaatgttaggtaccaagattcaggagactaactgcgttggtacccagaaatttcatacaggcaaagacttgaatttaaggctccagcgaggcacagggtttgatgatgaatggatgacgaggagatagaagcttgtgtcacaggatttgataaaggagagagagggggtacacagcagcataactagggtacaactgtttgtttttggaataaccttccaaactaggggggaaggtagttcaatccacagttggtaacttttgcatatgcaggaactgggtgttttggggagttctagaagctcttccatatagtacttttcagtcctaaacactttgtagattcccacaatacaaaagtgttggggattagtggaaatttatattttttaatgttggcagtcctgtatctagtcactatcttttggcaatgacattaatattcttcttttgaggaattgcttctctctcattggttgaattctggtgggactgttttgccctgactacccttagccaggtggaaactgtaaaacccaagctaatctaaaagggaactgaatctcaatcagtgtgacagagacggaaaatagctaaagctcacatattctagtaacactagacaaagcaacactctgtctagactatgggaatattctcgctacacagaccctgacatggccttactgtttgtcatctgctggcctggttctctagccttccctttcatgtgaactctcccatatcctcctagtaaatttccttctgtttaagctagccattgtaatttctgatgctgacgaaaaaacccttaattacaatggacaatctgacctgggatatccaaacaccactttccaccaaatctatatagtaagggtcatctcaataaacatttattcattccctacaatatgccaggtggtatgccaggggctatcttctaggttatctaatttaactttgtaacaataccacaaaataggaattatcatttaattttagatggaaataccaagtgtcttagtccattcaggctgctataaccaaataccgtagacaaggtggcttaagatcaatggaaatttatttttcacagttctggaggctgggaagtccaagatcaaggccccagctgagttggtgtctggtgagggctcacttcttggttcatagacagtcatcttctctctgtggtctcacatggtggaaggggaaagggtgctctctggggtctcttttataagggcactaatcacaaggactccaaccttatgatctaatcacctcccaaagaccccattgtctttttttttttttgagacagagtctcgctgtgttgcccaggctggagtgcagtgctgcaatctcggctcactgcaacctccgcctccccggttcaagtgattctcctgcctcagcctcccaagtagctgggactacaggcacatgccaccacgcctggctaattttttgtatttttagtagagatggggtttcaccgtgttagccaggatggtcttgatctcctgacctcatgatatggccaccttggcctctcaaagtgctgggattacaggcgtgagccaccatgcccagcctaccccattgtcaaatactgtcacattggagattagatattggcatatgaatttttagggacacaaacattcagtctattacaccaagggtaagtaaattgccaaacattatatagtttgtaagtagcagagttgggattcaaacctatgtctaatattctttcaatatgtctatttttcctttttccttttcctcaactgtagtgcttgtgttaagaatctaaaggtatccaataaagctaaatttgttctttagaaaatctatcagctattaggaagatttaggagccaaaaattattctaatcaatatcatagaaagcatgcatcttagcaataatagactcccagaagatttatgtggtgtttcataactacagtgcttcatgactatagagatcaattaattcaactttctcatcttatagataagaaaatagaggcctacagatttctgtattgtaagtattattgaaattactattatatttgccaataatgaagttttgatccaaaccaatttagtttagtcataaaaaggtgggactgtgtacatttatatagctcaattaaaatctgagagctgaaagaaacctccaggtctcttacaataatgtatccatctgcctctatcatggtgagtttaaaaaatatcaccaggttgtctttttctttatagcctataaagaaggcaattcagtcacctcccttgtaaagcgttagaatgttgtttatacctctcaacctaatgacattaaaaaaatagtataatctatttaaaggtatttaaaattgttatttgaaaattagaagcagccttaaaatagaagtattactaggcaactataataattagaaataacataagcctgaggtttcaaaagtaagtaactagggtgaaagatggacaggcaatgggaaagtttcttttaatcaagaagaacagttatgggggtctgcacaatatagtgtgaagctgttagactcatttttggaccctctgcagttgaatttcttgtagcaaatgtttattgaaagcttcttggctgggcacagtggctcacgcctgtaatcccagcaatttgggaggctgaggtgggcggatcacgaggtcagtagttcgagaccagcctgaccaacatggtgaaaccccatctctacttaaaaaaatacaaaaattagccaggcgtggtggcgcatgcctgtaatcccagctactcaggaggctgaggcaggagaatcacttgaacccgggaggcggaggttgcagttagccaaaattgagccacttcactccagcctgggtgatagagtgagactctgccttaaaacaaaacaaaacaaaacaaaaaaacaacaaaaaaaaaacaggctgggcgcggtggctcacacctgtaattccagcactttgggaggccgaggcaggtggattacgaggtcaggagatcgagaccatcctggctaacacggtgaaaccccgtctctactaaagatacaaaaaattatctgggcgtggtggcgggcgcctgtggtcccagctactcgggaggctgaggcaggagaatggcatgaacccaggaggcggagcttgcagtgagcagagaccgcgccactgcactccagcctgggcgacagagcaagactccatctcaaaaaaaaaaaaaaaaaaaaaaaaaggaagcttcttatatacgagttactgagctaagagcttttagaatacaaagacaaccagatacagttcctgactgtaactagctgggaactagctagggagatacagcagatccacacatacctttaacaatatcaagtgaaaagcggttatcagatccacagaaacgcactgcaggtagggcaaggctacactatgctgggggtcctgggggtcggggaaagctcttgaggatgaatatgattttgacagtcagagacagtagaaaggttatgcaccaaagaaagtatggcctaaagagaggcctaaagatgagtaatgttcatatataaactttccatttcaggtcctttatctacattgggacctgtacttccctgtttagaagctcctctcttcagctctctatatattaaaatcctaaccaccaaggacttatataaagagattgagtggatgtgttaaaagggtgagattgttgatacatttattctcttttcttatttagttgtgtttttctttgtaagtaggattgtattatagaaaataattattttttaaaaagatattgtacctacctctcacggccaacttaaatccttgctccttaacataaattcctgactatctgataacattaaatttgaattggaagtgttaatgtgaactcctgatttaaaggcggtgtgtgtgtgtgtgtgtgtgtgcatgcgtaggctctgtccactgtaagagtctagaagcaataacggctcaccagcaaagagaatacttactggtctctaaatagcattttcttttcttcttgttctttttttttttttgagacagcgtctcactccatcgctcaggctggagtgcagtggcttggtcactgcagccttgacttcctgggctcaggtgatcctcccgcctcagcccccggagtagctgggactacaggcatgtgccaacatgcccagctaatacttttgtggtttttggagacacggggtttcaccatgttgctggtctcaaactcctgggctcaggagaccctctcgctttggcccacgaaaatgctgggataataggtgtgatccgccatgcccagcctctaaatatcattttctactaaaattagccaaggttctttggaggtctggggcagggaaatataacttaaaccaggtaagcctagacgtaccagagttccagaaggaaagtcctccaagactaacaggggcctatcaaggggttagcttgaaggagctctcactgactaaatttgggacgatttgggcattaagaagaaaaagcgaagagagagagagaaagaaagaagaaaaaggaggaggaggaggaagaagaagaggaagaggaaaaggaggagaagaaaagcagcagtttaacgttcatttggctctcactttgacaactgatatataaaggagaagaagtgaacattaactccctctttttaggaagaactgtaggttttctccatttgaggaaagatttccttcccaaacagtgctaggtaataaatattttcatttgaatcatttgaaccttatgaaatggtttatattaaactttttttttttttttttttttttttggagacagagtctcgcactgtcgcccaggctggagtgcagtggcgcgatctcggctcactgcaacctctgcctcccgggttcaagagattctcctgcctcagcctcctgagtagctgggattacaggtgcacaccaccacacccagctaatttttgcatttttagtagagacggggtttcacaatgttggccaggatggtctctatctcttgacctcgtgatctgcccgcgttggcctcccaaagtgctgtgattacaggcatgagccaccggcacccagcctcaactatttttaatgtataaaatttcacatgattttcattccatatccaaatatgggaagaaaaactcagaaaaatcaacattttgcaactcccagtgaaatgaccgattcagggaagaatcatccatggatgctgaaacaattacgtgaaaaattattggagcaaaaccgtgaatccccctggtgccaagtgtctcctgctggatcacttgctgattgcaaagtgaaaacacacctttacatctcagtagggagatgtggctagcattgctttaacggaggggtcaaattgagcttggttaatgggtgagacaacctaacatttcgtttcccctgatgtgatgcaatctgaagttcacagcatgacctataaagcattctagccaaaaatgtcaaagttgcgtgctcatcattctccatttgcccttagaaatccattcagcacctttcaccatcctgccctgcacccctggagactccccccctgcagactccattgcccaggctcctttgctttttggcttctagttagatttggccaacgcaggggttccaacagccgttttgaaggtagaggagagagatgttgtggtatttgttccccaccaccccactccctgcccaggtgcagttttggtggtgcctgtgttgctgctacatccatggctcctggtggggacccctctcccaaagctccagctcctgcaatgcttcagtaactgcactcagctcaggctgttgtagacctagggccagcagtcccacagtgcctcaccatcgcttgttccctatgcctgcccacacatctgtaaatagtcccttcatttcacatccttcagttagaccctttgagtatgccatctgcttccggtcaggacaatgattgattctatctgaatcaaacctgtcctttatttgaacaggacatcaagtctagaaaaacaagttaacaccttgagataacaaacaaatccagaatttgggaccatttactagtctggttctttcaaaggtcaatgttataaaaaaaaaaagtagaactcttccagactaaagtaagctaaagagatataactatcaaatgcaatgtataaatctggtttgcaaaatcatattatactatatcctataccatatttatttttggaacaactaggaaaattttaatattgactagatttttgatgatattaaaaaatatatgataaaggtattatggattttaggcaaatgtcctttttaaaaaggtgcatagtgaaggaataaggctgactaccttatccttatacaatgactgcaacttcctttaaaatgggtagcaaaatatttagataggtaatatggcagaatatgaacaggtattaaatctaactgatggggtcatggtgttcattgtaccatcctttcaacttttctgtttgaacatttttacaatagaatgaaatagtggaaaacattaattaaaaaaaaaaaatgaaattgctaacctacccaggaacgatttattcttttcccaaacggctacagttttttttttacttatactgttcatttgctttttgtatgttcctgttccaacagattgtcagctcttggaagggaaggactgggctttgtaattctttttataccctacaggggctcatgtaaaagttttattattattataattattagagacagggtctcactctgtcacccaggctggagtgcagtggtgcagtcatagctcactgcagcctggaactcctcggctcaagcgagcctcttgccttagccccccgaatagctgggactacaggtgtgtgacactatgcctggctaaattttttttttttttttagatggagtctcattctgttgcccaggctggagtgcagtggggctatcttggctcactgcaagctctgcctcctgagttcaagcgattctcctgcctcagcctcctgagtagctgggattacaggtgcttgccaccacgcctggctaatttttgtatttttagtagaaatggggtttcaccatgttggccaggctggtctcaaacttctaacctcaagtgatccacccaccttgtcctcccaaagtgctgggattacaggtgtgctaatttatttttttttatttttttttttttttgagacggagtctcgctctgtcgcccaggctggagtgcagtggcgcgatctcggctcacgctaatttattttttgtagagatggggtctcgctatgttattcaggctggtctcagactcctgggctcaagtatcctccagccttggcctcccaaagcgttgggattacaagtgtgagccactgtgcccggccgttttaaaatcgatgtgagccagtctcattgtgcacaaacataggcatgtgtggtcagaaggtttctatttcttttttcattaaaggaagggaaaaggctcaaaaaggtgaatgggatgcagagaagtgcaatttggacactttcttggaattatcaaagagcagttttggggtcccttccttggagccattgaagacagatggcatagagtctgatacctcacaatacccttgaaagttttgcaatttcagacaagccgttgaagaaactggctcccaaaaaagattcaggtgcattccaactttacagtctactccagccagagagaaaatcaggattagattaagcctgaatagagaaaaattaattttgagtaaactgcttaatgagatctagtcttgtatttatttaacttacttgaaatagtatgtcaacacataaaaattaatgaggcaggctgggcgccgtggctcacgcctgtaatgccagcactttgggaggccaaggtgggcggatcacgaggtcaagagattgagaccatcctggccaacatggtgaaacctggtttctactaaaaatacaaaaattagccgagcatggtggtgtgtgccggtagtcccagctactcatgaagctgaggcagaataatcgcttgaacctgagaggaggaggttgcagtgagccgagatcgtgccactgcactccagcctggcgacagggtgagactccgtctcaaaaaaaaaaaaaaaaaaaaaattaatgtggctgggcatggtggcacgtgcctttagtcccagctactcaggaggctgagacaggaggactgtttgaatccagtagttcaagtccagcctgcaaaacactgtgagactccatctctaaaaacaaacagacaaactaaaaaacagaattaacataattctcttcctggctaacatttaatcctttttgccctgtaaacctgctgaaacctccacggtgggccagggcagagagagaagctctcaatcatgtggcagaatgtgtgtatgtgcatgagacaaatcctgtggattcctcacacaaacactacctcctaccctatttccagctaagaaaaccctgattttcaggtatcaggtgcccatactttagggaaattgttgtcatcctgttcatttgtcaatctttggttaaaacgtgggcatgtgacataatcaggccaaggaagttgggagggtgagagtgggggtggtggattttctatgaggttttcagaaaaagtttctctgctcttaaaaaaaaaagatatatttgagaaatagaccctttttgtttctaaatgttatcgtatgaagatgtgatgcagcattaatccgctgctaacaccctcgccaaaaaatgaaaagccctgatttgtagcatttgtctgtttccatttctgtggtgtaaattctcccattatggccaatttcaagctctacaactgactggcaaaactcctaaatatttagcaattggctctcaggagcctctgggaaccaacttcagcccaccatggtcactgagagctgcagaactcaacttgtgaaaagagtaggcattgtggtggggatggcggagcagaaaggtgaaagactctaggtccttaatgacacttgagagccatgaaattaaccaaccctggaatcttcctatctctggacttcttattacataagttaaataaaggtacatattggtttaaggctggtcaaactggtgtgtatgtgtggggaatctgggcttgatgtagccagtgtagatatccatgggttcccacctagtggagggaggggaatgcagcaggggaaaagctgaacgctggataatggaaatgttcagttggtcaggaagagggggacagcagaggaagcggggtggggaggactatccgtgttgaaacaggactctggctgcttgctgagaggaacaggatggtggctgtgggccagctgggctgtcagggcccttgccaaggaggctgaagttcagggcaaggctccagcaagagcaggcggctgagtgagagtcaggaagtcaggcagaagcccagggttgggaagggctgccctgccgggtgctgcagatcacagtactgtgggatggagggaaagggatgcatgagagaaggggaaatgcagagagaggcaggagtataattccagaggtctagactactcacttgccataggatgggaaagggctttcaatgtccactaaggcagagtcagaattcgctcagatgctgagcagctgaggctgaaggttggggatgctttcagctgaggctgaaggttggggatgccatggatcaggctgaaaaatgcagaagaaaccagcatcttctccaaagctgccttagagaattttcttggtgattttagagaattgctgtctacctatcttcctagaccttcaaaaaggggcatcactcctccctcctattgtcacaatccctggggtcctgaaattcactgccaagacttatgtttggccttctgaaatatgctccctccttccttgtgtgaagaaatttgtttgcctgcttgtggcagaagcaatttcattcctgttgtgaaatgccccttacttgcagtgtgatttctcctgttattcatttactccttttctttattttctcttcccatccatttagtaacccacccacaggtctattcttcttcagcccagtgccattcattgaatgactacctaggaaggacttttataattgaattttatggaggaagtaggtgcaggaaaaatgaaagctgatgtgtcaacaacattctctggggattttcagaacattattttcctctctgacttagctgggaagccaaagggcaggaaacttggcttcctttgcactctgttactgctggaagtcatggttagtgatattaatttattcagtgggctgagttctgtgacaatatcattaccagggagtaattaagggtgggatcaaacaggagaggaaaccctcaaaagtgaagttttccccagttcatgctgcctcctgcaatctaggaaagtttggcttattttatgagcatctcccaatttagtgagatgcttcagagagtgaataaaaggaatgcttttctgcaatgcaaaacccatcataaaaagtcactagacaattataaaaacggaaactatttggaactcatttaatagacaaaagctagctaattttctttgtaagtaaagaactcctaaaaatccataagaaaaagaccaatagcccaataaaaaatgtgcaaaaaagtccatagaaaatggaacacgaatgttgtttaaacatatacagacatccatttttcatgtattagattggcaatgacaaaaaattaacaacacactgtgttggcaagaatgtgaagagacaggtgctctcatatatgactggtgggaaaataaattggtactatcttatgaagggttatttggaaatattcttatgaacatctatatgctttgacttattaaagccagtgctaggaatttatcctataggtttagtcacatacatagagaatgagatgttcacaagattgcatattgcagccttgtttgtaatagtggaagattgaaaacagtctagatatctcaataagtgattatttaaataagttatgcatattcatataatgaaatatgatatagccataaaaaagagtactctttaataaaggaggatactatctttatatatacaccttgaaagatctccaagatattttaagtgaaaaaaattaaggtgtagaaaattggtcaataaaagaggggagaaaaaatacttacacaagacatgcctgtatttgcttcttatgcataaaatatgtccaggaggatatccaagaaattgataatattttgtaccttggtgagaggaaatgggtgcctggggcatagggtaggggagagagtgtttccttttaaacctttgttcattttggaaatgtactgctaattcaaattagtaaataaaaattgtttaagagaaatgctggacacattacatcagaaatgacctaaattcacccagtctgttctatgtccttaattttccatttcagcctcttttattattgattgttagtagctttccatcttcatctttacattttctctgttcctccaggtgccacacattttctctctgcttctgtcctcagtttgccacctgatttcccctgcagttgtcaagtaactgcctttttagctggatattactacacagacctctttctgtgtgccagactgggataatcatctcaatcctttcttcaacacctcctcccctagagagcagaaaataaagttgtggttgggagttaagccagaagctggctatccttgcagggtaccaggcaactgccagagtagatagtaacttatggcatatatgttgctaatggtggatgaggtcatttcaagagctggaattgggaagaaggataaatacatacatggaggagcaatagaagtctaccttatggagcatgtggaagtgagtattgaagttgaggttcaaatccttgctctgtcacttactggttatgtaaggcaagttttcttagcttaacttctctcctatgtaaaatgggttctataatggttaatgtggctaagactgcggggctggcagttaaccccaatccattcttgttttcttttgtggtaacagatatgtgggcacatggctgctaacatattttcaagtctctcttgctgttagacatgatcaaggaactaattccctgccagtggaatgtgagcaaagtgtgtgtcatattcagctctgggacataagactcctccatgttctttccccttcctacaaggtggaactcagaacaacccaaccttgactgtggagacaagagcaagatcataggggtttcagagtaatgatctgggaggaacctggttctctaaatgcagatatgaagcagagctgcctgtccacctggaacacctgcccactgttagatgagagagaaatgaacttagatttttaaaccattccatcattgttgagtttccttcttatggcagaatagctttaccctaatcaatagagttaagtctttttatgttgtgagtaatagaatactcaactcagactaggtaaattaataagtggttttacttggctcccatataagaggaaattttaaaaggacggaaaattttagggtttttgatttggtattcagtgatatcatcaaaaattgatttctcctgtccctttgctctttcatgaagtcaacttcactctggcgctggttgcccttatgaacaaaagttctctgagaaggaatttggagaaaaggcttcatccttgtaaacagtttgcaaactgaggagatcatagccgtctgcgtgcatttcagtgaacaaagagagcgttcagattttatagcaaaatttcttgtctgggatcccagtcaggtctgtttatgcaaataaaggattcaaacttgcatggttctgattagtcaacactgctgagttctgattggttgatacagctgagccctgattggcggggcaggtgagctctgttggttcaggtcagagctgaaagtccccaagttaaaaaggtatgggttttcagcgaactcagaggacttgtgtgacctttagtcagcaaatagcatcttggctccattttaaatttaggaccagttagccactcaggattcatctgaaaggctgggtctctcaggttcacattggttcatttcttgatggtggcaaaagggctatggcaattccaggcttcatgtcagctccttctagaaggagagagagagaggaaaagtttgcacaagtgagctactttcctacacccccagaaaacttcttattggtttgaatttggtgatatctcttccctgaactgtgaccagggaatgggcttataccgatcagcttaagccctagccacttatcctatccctagcagcaggggtaggccagcttttctagaacatgcgggccatgtggaggaggtgtgggtaaaaattggaatgtatggtagggaaatatcacatatccactacaggaatgtatttattgtttaaggattaaatggagtgagataacatataaagggccgagcacagggtttggcacagaggaggtgggtactgattgttaatttactcttccttcctccatctagttagctgtgcagcaaagtggtacggcgttaaagaagattccctgtttaggtttctcaaggctgtgtatttgcaggaccagtgaaacaggattgtgatgtgcacagagaaatctcttctcagtttcaagattcctgtcccccatagcaattattgtcaggaatcgcccagggggagcaccaccacctcacactcagttcccaggagaattaatataagacttggctccacccttccggaagctcctttccacaatcctagatgattactgggccatcaactttttgtttgtttgtttgtttgtttttgagactgagtctcgctgtatcactcaggctggagtgcagtggtgtgatcttggctcactgcaacccccgcctcctgggttcaagcgattcttgctcttcagcctccccaatagatgggattacaggcacccgccaccacgcctggctaatgtttgtatttttagtagagatgggatttcacatgttgcccaggctggtctcgaactcctgacctcaagtgatctgcccgccctggcctcccaaagtgctgggattacaggcgtgcgccaccgcacctggccaactttgaaagacgcaggtttgagattccagaaggggctgcctacccagcatcttgtgttactagttagtgcttcttcaggtgggaaggtgattgagagacgtgcctgggccaggttaatggcttctcctccatgcacttggttagaggctgtataatgtaatgaaaaggttctggacatgagtctgaaacttcattttaccatcactatctgtgtgattttctgtaatttaattctttttgctttagattcctcatctgtaaaatagggccttgactcttgctctaccagccgtttagggttgttgtgaggctcaaagaaatattgtatttgagaggactttgtaaatagaaaataaattttaaataacaagagttggctaacataataatggaaatacttttctaggacctaaatttctgcatactaaggatcacctggggcttgtgaacaaactagctgagagagaacaggccaagtgggatatttttgttcatagtgacagctgatagggctaggtttaatgaacaattatgtattgattacctaggtgtgtttgctactggtgttttacatgttagctgctaatttaatcttattactaactgtataaagtaaatattatcatactagttttataggtgaggaaactaagcctgagagtggttaagtgcctgtgccaatatcacacatttaggaagtggcaggcccggattttaaagttaagtctgtttagccaccaaggcaaatgaggccatcaactgattcaggcagggaaaacatgaccacccacgatgctgtatccaggtggactagcttataagacaaggagacattcatccaggggcttataataactctttcacttgcctattcatccatgtaatccacaaacattgactgagcacctctcatgtaacaggaaccgtgctagatttgtaataaaacgatgaagaaaatagagttcccaagggttcaagaaacatcgctgcagcagagtagcttgtcagacatcccatttatccttagttcaatcctgttaggaaaattgctcctattgcttggccagtattaaagttttaaacattattgttctgtagaaattatctgcttacactgcttcctgccaaagaatggcataagtccataaaaactgaagatcatacatccagtgatttcttttcagaggcaactgcacaatggttttgaaatggtaataattgcctattgctctctggattatcttattgtctggcaatggttatgaagacagcggagttttaagaggccattcagtaagagtgacagaaggaactattttttaatttttctctgactctcaaagtgagcatcgaattcagagcccataaaggtttgaaagaacctctgtgataaattcaaagttcttaaagttgaagggagactgagttataaaataatatagaaaactaaaggtgtggctcatacataagtggagtgttgttgaaggatcctgagtgaaatggagatgggctgggtgaggctcacgattaaaatagctgctgaaatgaagttttgcctcttaatttaaaggtgctatgctcctctcctttgccaagtattgtgcaaataaacatcccagtctgaaaaaattctacaattgtatatgtccataccaatgctacttgatgacaatttcttttgaggataaaaagcatattttgttaagcacctactaaggactggacacatgaagtattttgctcatttaacactcaccacaaccttgtgagctaagttgtgttttcaccattttacaaagttctttcctgtactcagatttgttgattcattcaacaaatatttttgaagagcctactatgtgccaggcatgctttacatgctcggatatagagcagtgaaccaagctacacatatccctgcctccatgagcttttgttttagtgggtggagattgaactaaacaaacaaacaaacaaacaaacaaacagacaaacataatattcaaggctttggagattagtgctataaagcaagtaatggagtaagtgggaagaaatactagaatggcagaggtaggattttgtgaatttatataggatagtcagtgtattagttatccattgctgagcagcaaattactccaaaacttagtggcttaaaacaacaaacatttattatctcacagtttctgtgggtcagaaacctaagtatggcttagctggtgtctccacttcaaggtctctcaagaggatgcattcagtgtgccagctggaacagttggcaagattcagttcattgcagcttgttggactgagagaactcagttccttgttggctactggctggaggcctccctcagcccttgtcatgtgggcctctctttatggcagttcacaatatggcagttggcctccctcagagtgagcaagcaagtgagagaatgaaagtgtgtgtccaagatggaaggcacagtcttttttgtaactgaatctcagaagggacaccccatcatggctgcttgattctgtttgttaaatgtccaacaacgatagactggattaagaaaatgtggcacatatacaccatggaatactatgcagccataaaaaatgatgagttcatgtcctttgtagggacatggatgaaaccggaaaccatcattctcagcaaactatcgcaaggacaaaaaaccaaacgccgcatgttcttactcataggtgggaattgaacaatgagaacacatggacacaggaaggggaacatcacacaccggggcctgttgtggggtggggggagtggggagggagagcattaggagatatacctaatgctaaatgacgagttaatgggtgcagcacaccaacatggcacatgtatacatatgtaacaaacctgcaagttgtgcacatgtaccctaaaacttaaagtataataataataataaaaaaaagcaagtcactaaagctagtgcatactcaagaggtgggaattacacagggtgtgagtacaagaaggtgggagtcactggggggcgtcttggaagctgtactaccatagtcagtaagacttctctggccgggcacggtggctcacgcctgtaatcccagcactttgggaggccaaggtgggtggatcatgaggtcaggagttcaagaccagcctggccaagatggtgaaaccctgtctctactaaaaatacaaaaattagcagggtatggtggcgggcacctgtaatcccagctacttgggaagctgaggcggagaattgcttgaacctgggaggcggaggttgcagtgagccaggatcacgccactgcactccagcctgggcaacagagtgagactccatctcaaaaaaaaaaaaaaaaaaaagagttctccaaggagaggacatttgaacagaattctaaaggaagtgagagagcaggtgctacctctctgacctcatctcgtactggtctttcctcagcctttgcactggttatttcctctgcctttcagttagtgcaaaggctgaggaagggctagtacaaaatgaggtcaaggaggtagccctagactagatgagataaagttttatgtgggttatagtgtggaatttggattttactttcaatgagatgggaaggctttggaagtttttcagcagaggaaatgacgcgacttgacttgtgttttaagaaaatcactgtggttgctgtgtgaatagtttgggggagtgggaattagcagaaacaatgaaagaagttaggaggctattgtagtaatacacttgaatgatgattatggcttagaccatagatagtaggggaagtgtgggagaggttgttggattttgcatatattttctagtagagctgacaggatttgctgatggtttagatgtggggtgtaaagaaagtgaggagttaatgaggactccaaggtttttggacttagcaactggaaaaatagaattgcccttgattaagctggaaaatactgatggaggagcagattttgagagaggaaatataaataagggattttgtgcatgttaatgtatgcttattagacatccaactaaagatgttgagttggcaattggctattttagtctggagcttgagagagtggaccggactataaatattaatttgggaattcccaatactaataggatatttaaaatcaatggaatagatgaagctacggcagaagtgcgtgtagactgagaagtggaaaaccctgtggattgaaatccaggggcacttcaaggtgtggaaattaggaaaataaagtcaacaaagaaaactgacaagtcactagaaagagagggagaaccaagagagattagtgccttggaagccccgtggagaaagtgcttcatgagggagagagtgatcaactttgtcaaacactgccaataagtcaaacaagatgaggattgataattaactatagatttgggaacatggaggtcattggtggctttgatgagtgctgtttcagtggagtgggagcacgaaaggggagcaagtggagaaggtgagaactgagctttttttttttttttttttttgagacagtctcgctctgtcgcccaggctggagtgcagtggcgtgatcctggctcactgcaagctccgcctcccgggttcacgccattttcctgcctcagcctcccgagtagctgggactacaggcgcctgccaccccgcccggctaatttttttgtatttttagtagagacggggtttcaccgtgttagccaggatggtctggatctcctgacctcgtgatccgcccgcctcggcctcccaaagtgctgggattacaggcgtgagccaccgtgcccggcctgagaactgaggttttatgagaaattgatgtcttttcaaaaattggtttactgaacacatgcattgcaacaagctcccctgtggtgtttattagaaatatttatttgggggctccgcttcaggatctctggaggtggcaacctataatcctcatttttagcaagtctcacgggtgattttcaggcacatcaaaattggagaaccaatatcttgccccgggcacttcatctcacatctattaaagccactgtttgacttaagatattgtaaggatgttccatttgtgtaacccaaatgagcatttggtgaatgatagtttgtcctggaggcatttctatattttcctttagtctttttgttgttgttgtttgagatgcagtctcactcactctgtcactcaggctggagtgcagtggcacaatcttggctcactgcaacctccgcctccgagttcaagtgattctcctgccttggcctccctagtagctggttcaagtgattctcttgcctggtctcccactaagttacaggtgtgtaccaccacgcctggctacctttagtctttttattccctgaagtttttaagaaaaccagacaaagatattctacaaccccaaagagtagcaataggcaaacaaatctcccttccataatggctcctaggaacctctcacattttggaaatttcagaatcagcatattagcttcctgaggatactggaaatagacaaaattcatgcagattcaggaggaattcaatattttcttggtcactgaagtgcttaatttacttagcttgtctacctggaaagacagaggcattattctagtcaggtctactgggaaggctctggggcacctgggctttctttttctttagagtaagggttgcaccattcagcagtatctgtggattgtttttttttctggcctgagatttttgccctaggaacggatatgtttcaaagagaacgatgcggtgtgggaggaatagaggtggtaaaaatttaaacttaagttttccattgtgtactacacagaagaaaggcctcataggatttgggaaaggttgttccttctctcctcaatcctcttttcttttttatggcccccttccaaggcttagagacttgtattttaacccccttagtcctttctcataccttgcaaactttaggacctggatgccagtggaggttttctgtttaggcattttggtcccggaagggagtgggaggatctaatcccattaatggaagctctattttcaatccttcctttagtgagagccgctaatgatttcctccctagtttacttaagaagcaagagaccatgacaatgtctttcttagaggtagaccaacgtggctaacaaaggtgtgtagaaattgtattccagttactcttatatgtatttatgttatccattgtggccaaagcaatgtaaaatataacagacactaatgaaaaacatgacaacggtgcatgtaaatttaactgtggggcctggcgtggtggctcacgcctgtaatcccagaactttgggaggctgagaacaggcggatcacttgaggtgaggagttcgagaccagcctgggtaacatggtaaagccctgtctctataaaaatatgaaaattagccaggtgtggtggtgtgtgcctatagtcccagctactcaggcggctgaggtggggtttgaggctgcagtgagccatgattgctccactgcacagagtgacaccctgtctcaagaaagaaaggaaagaagggaaggaaggaactagatttcccaaagaatggctccataagaaaagaaagttatctgctgatcagaacccctaccatcatcagcttatatatgagaccttgtggccctggcacgcagggaatgaatggtaacatctggagtgggagtcgcatatgaacacatgggcatccttcattattccctttgggaaaatctctatgaagatctgtgatctttgagattgatcttttttagtttatgacatcccagatgatggtgttagtagatagtttgcaatgttaactgcctttttttctttacatatttgaacctagtacttctttaactcacagtgcaaatctgtgcaaaacaatgcacaagttagcacccttggggtgcttaaaaataacagacagacaagactggaactctagttctagctaatgaaaaagctttaaagtctggagtaatttctttgcctgataatcactcagtatgtttatagcaaatggggccaaatttcttttaagaatatatgtggtctaacattattgttagactaacaaagtgtaacattttctttcttttagtgaatagatttgtcagacatttcccaaatatacttttttctcttaagagatgcagcaatgacactgaacaaacagtaattcttgcataattaatacgtagcaggtggacctagcaatttcagtttggaatccctactccttagtccttaactgctttaccctgtcatattcctaccacatctcctatcatgcccaagaacctctcctgacccttgtaaatagcacaatggacaccatttaatttgcctttgagggcagctcttaaatttactgcaaaagtaaagacaggcactgtcagataaatatatgtgtgtgcaaatgtgcaaacgcacatattcgttttcctcaaacctcattctcaaaactctttattacctctttagttcgatacaccttctctaacattctgcatccccatctaacacctgcttgttaatttcattcaattttcagctagtcttttagcaagcgaaggcaacccacccaaatgatataaaaggacttttccttttttttttttaattctcggctccttttactaacactaatctaatgcctaccatatgctttccaagatactggttttcatccttttgttaacttctcttgtgtatcacccaaggtcgagtttcctttgttgagtgcagacaataccacagggtaagggtgggatgatatgaaatgagtatctgaaagcacagcttcctgcttcctgggaagtgttgcttcacttgtgcacagggaatggtgtgagagaggccggagtgtcagaagtccccctgctcttttcagtgtggcatgactgcctttcccactaagttacatccctgatggaagagctacctaggattgtcttaatttaacttcttttataggtccttttttttttttttttttttttttttagacagggtctcactctgtcacccaggctggagtgcagtggcataatcttggcttatagcagccttgacctcctgggcccagttgatcctcccacctcagcctctcagctagctgggactacaggtgcatgccaccatgcctgactaattttttatattttttgtagtgacagggtttcaccatgttgcccaggctggtcttgacctcctaggctcaagtgatccacccatctcggcctcccaaagtgttgagattacaggcatgagccactgcaccctgcccaattttacttcttaagcatttttctatctcattccaatagctttttaatttttaagttacagataaaagatctggttttcctcgccagtaactactataaagctttgggcaacttatgtaactgctctaaccctcaattttctcatctgttaaaaaagagaattagattaaagaaattctaatgttcctttcagcatgatgttctcttagtcaagaggtaaaacagctcaggagaaagatctgtgttgccactgagcttgtctgtgttcagcagtacaataagaggaatgcctccttaacatgctaccacttattgagcacctactatatgctgggtactctgtcagatatttatacacacagtgtttcattgaattcccatggcaaccccaggagttagactttattattattgttactaatctgttttacagatgaaggtgctaagactcagaaagagtaagtagctcttttcagatcatagagtaattgacatagctggactttggccaccaagcacatgtttttaaccatgctgctaccctacttcccaatttacttgcttttcttcattgcctgccaatttacaaatgcctgttcatagctgccatcctggaatcagatggtctgggatctggtcttggctctattgcttactggctctttggccaaattgtgtaacctcttcaaacctcagttttctcatctgaaaagaagaagacaatacctacctgctatggtctgaatatttatgtcctccccagattcacatgttgaaatcttcacttccaaggtgaccgtattgggggtgaggcctttaggagatgattaggtcatgaatgtggagctctcatgaatgggaatagtgcctttgtaaagaaaaggcctgagagataccctttaatctttctgtcatgtgaagttagagtgagaagatagctgtctatgaggaagtgggcctttatcagacactgcctctgccagcaccttgatctcggactcccagcctgcagcactgtcagtaataagtttctgttattcataagtcacctagccttggtattttgttatcataacctgaacagactaagatactaccttatagcgctgtggtaaaaatgaaaatatgtaagatgtgtggcagtagttgcctggttccatattctgcttctacgtggccatcatttaagtaccacctgcatgctcagccccagctcaggctccaggatctgtccttcctacacaggggaagctttaaagacctcttgtttatgctgagggggattcagcatcaaccatggttcctcccagtcctgatggctcagatgtagtaagtgagcctttactctgaatgcagcatggtagagttaagatggaccctgggaccatgctgcccgtgttttaaccttagctctgtgttactaatgacttgggcaagctactttgcctttctgtgactcgaatttctcatctgtaaaatggagaggagtaagagtagctatttcagagggttgttgtgaagatacattaaaaaatataaatacatataacagcgtatggcaaatatttattatttttatttttatagaacttaccttacgtatatatgtatacatgagtgacaaaatgcatgcttatatcattaatgctttttaggtccctgcatggttgcctcgggtccttcttggatcacttgcccggtctctgaggctgcaggcctcattgcaatcgtgcacttgggcagggctcctgcccctgaactcctctcctgaggtggagccttgcagtctgctgagaacctccttgatgctggctcccttcccgcatctctgaatattgcttctccaaaacagtgctctggagttttatgtggttccttggtgcagaccacttgctacccacattccctggagcttgtgtctgctccctcctgcatccttccccattgcttgtgtttcggacctgtttgctaggtcctgagctgatatatgtgtgtgtttagaagttaccacctcagcttgacacaaccttatcaaataactttgtgaaacattttacacataaaatggttatgaatctcagtacacctcaggtggacaagagacatcacatttctctactttttgggggtagtagctttattgatacaatttaactatttataaaattcattttttttttggtatattcacagagttgtgcgatcaacacgattatcaattttggaatgttttcacctgtccctgcaaatcctctattctttagttgtcaccctcttttcccctagccctaggcaaccactaatctattttctgtctatagatttgcctattctggatgtttcctataaatggaaacatacactatgtggtttttcgtgactgacttctttcatttagcataatttttttttttttaagacggagtctcgctctgtcgcccaggctggagtgcagtggcgtgatctcggctcactgcaacctctgcctcccaggttcacgccattctcctgcctcagcctcccgagtagctgggactacaggcacccgccaccaccccagctaattttttgtatttttagtagagatggggtttcaccgtgttcgccaggatggtctccatctcctgacctcgtgatccgccagccttggcctcccaaagtgctgagattacaggcatgagccaccacgcccggccacataatgtttttaaggttcatccatgttgtggcatgacttaagtacttccttcctttttattgctgaatggtatttattcttctctacttttggctcagtaagtaattattattttctgcccctgttccataggtctggtgagaaattcaacttcagtcattcttgtacttcccatctggggctgtgtcaaaattccaggctctcaagcagagccgagatctcagagacccaggagggcatcagacatatgaccacacaggttactgctgggatgtcactgtctctccctgtgtggtctttaagaggctcccctctcctgcctttgtgctagcctctggagtatgagaactgttgtggttgggaaacctgggctaatgttccgcctcttggtgcaccaatggcctgtctctctgaggtcttgctgtgtccttggggccctgccagggagtaaggcaaaatacagggtaccttaaactctgactcctcctctaagccagagagactttcattttagacagggggtattcttcccccagaactatttaaattctctttcgtgccctcaggttttttaaaacaaaaatcaaacattccaaccttgaactttcccccaggcaaaagcagcacagatgtcaaagaagaaaaacagaaggggaaaacataagtgaacttaaaaaagttatcttgtgttagagttctttcctggttgttcaaatctctgtaccaacataagcccataatgtgtttgagcattttatcccactacatcttttcgtatttccagtcaagtcactgtggctctttgctgtaccaccagcccacctgccactgttccctgacagctttttaactcctgcaagccactagttgctgtgatggcaacaccacaacctggatgctgttgcttaaatttttactttaattgcacaatggaactctctctctcttttgtggtggaatgaagatattaaatatttcatctatgctgttagaaatgtaggatttgcatttctgttatataattctatcatacatttttatttctattacatacttctgttataactatctattgtactaggttttggtctcaagattcctttatgctcttaataattgaggatctcaaaaatcttttgtttatttgggttatatctgtggatattaactatgctataaacatttttctttcttttttttttttttgagacagagtcttgctctgttacccaggctggagtgcagtggcacaatctcggctcactgcaacccccgccttctgggttcaagtgattctcctgcctcagtctcctgagtagctgggattacaggtgcccgtcaccacacctggctaatttttatatttttagaaaagacagggtttcaccatgttggtcaggctggtctcaaactcctgacctcatgatctgcccaccttggcctcccaaagtgctgggattacaggcatgagccatcgcgcccaaccaaacatgctataaacattttaaaaataattatttattcattcattttaaaataacaataataaacccattgcatgtaacgtaaataacatatttttataaataatgtatttatttttccaaacaagagaaacttagtgagtagcatagcattatttcatgtttttacattttttgccttttaatgtctgacagtagaagatggctagattcttacattggcttttgcattcggtatagtgtgatacgttgttttcattgaagaatattaagaaaacctggcatcacagagtgatgtagctggaaaacagaggactattttaataacctttttggataattgtatctactatcctaaacctcaactagaggtagtttcttaaaggtttattgggcaataaatattgccatatatttcctttggggtgacagcctcactttgtacattttcaagaaaatgtttagcaaatacctacatctgaatatgttggtctttcaagtgaaatggtgtttcattagaagagtggttagttcaacttgcaactccaggaatattttatggtagagacaaccatgctacttcagtattcagcagaagtgctttctgtgtacttgatagtttgtcacacagaatattacaaagacatgtactgaaatgttgaaattcaatgaggttacttggcaacttgtatcaagggtctaatcccttattatgttaccataacttggttaaagaatatatgtggtaagcaaaaatacttacctgtgatagaagataagcaataggattaagtacatttggtgatttctgaattaaatatgctagaaaaagcttttatttaaatccaaaattctgttctgctcttggagattttagacaagaaaattatgtttctaggatcatacatgttggcagatttccaagcatccaaggctgtgtgttttttttttattttttatttatttatttttttagaaaaattaatctatttattaagaacaatatttatcaagggcctaatttgtactaatatttttctagatatgggaatggagtggtgaataagatatacacagtccctgtactcatgaagcttttaatctagaaggaggagaaaaaaagtaacaagtaaataagcaagataattttagacagatgagcatatgaaggaaacaacatagggtattgagatcatgaaacacaggtgaaatggggtggtcagagaaggtctctctaaggaggtgacattggagctgaaacctgaatgatgaggaggaaccaggtggaaaagcaactgaagcagagtgaacagcaagtacagaggccctgaggtgagactacatttggtggctttgaggaatgaaatgaaagtagtatggcttgagtgcagtgagcaaaagagaaaacggtgcaagatgagatcagaccacatataactttgtaagccatagttagtgtgttagtctttttgggctgctataacaaaaataacatagaccaggttattttaaaataaataacaaacatttattttaaaaaatttctattattattttttgagacagtctcactctgtcactcaggctagagtgcagcactgtgaacacagctcattgcagcctcttctttttggctcaagcaatcctcctgcctcagcctcttgtaaggctggaaccacaggctcatgctaccatgcctggctaagtttttgacttttggagagacagagtctcactttgttgcccaggcttgtcttgaactcctggacccaagtgatcctactgccttggcctctgaaaaatttgggattacaggcatgagccacttcatccagcaaaaaatttatttctcatagttctagagcctgggaagtccaagagcaaggtggcagatgatttggttcctgatgaggactttcttcgtgatttgaagacagatgacttctttttcccataccttcacatggtggagagagaaagagagaggaagcaagcactcttatgtctcttcttataaaggcattaatcccatcatgaaggctagactctcatgataccctcatgacctatttacctcccagagtccccaatttcacatgccatcacaatggagttttgacatataattttggggggacacattcagcccattgcagctaggcacttggattttattatgagtaaaataggaagcaatcggaagtttttaaaattgagagtgacgtgacctaataggtgtttttgaatgattgctctgaatgctatgtggaggatgattgcagggggtcaagactgcagcagagtgggcagctgagaggctatgatgataggttggatggctaggtggtggaagaagagagaagatgggtttgaagatatagtttagaggtaaagacagagaggaggcatcagggacatacccaaatttatattttcttaagctaccaaatgaatggtgatggtagaaactgacatgtttatgactgggaaagaaataggtctgtgagatggttggggaggtggtcatcaggtgctctttgaagatgaaaatcaaaatgtttgttttgtatgttatgtcatatgtggttgtgttcagctgcagaggaaccaaaatcctgacaaaccatatcttaagcaaacaagctctttgattaatcaattaatttattgtccacacaaaagtgtgtcaaaaataggcagacccagctggtatggtagctcacaaatgccactgagatcgcaggcacattctctcttctccttgagcatccttatcatgtccttcactctcacctatgtaagagagggactgagctttaggcatagggtctgcatgtaagacaggagaaggggaaagctgaaagaagtaggggtagtgcctatgtcaggaaagcaaaagctttttcagaaatctataccccagacctccactttatgtaccaaaattatatcatgtgtccaattccagctgcaagggaggctgagctttttagctggtcacagtggctcactgaacaaaattggaggcatttttataggaagtaagaggtgaaaggatactgtgaaggtaggcaaccagtaatgctaccaggaacacatgaagtttaaggtctctggtaagcattcacatggaaaagtcaagtaaggttgaaattataagcctcaagttgaaagttcaactttcaaagttgaaaggaagagcagagatgataacagttcaaaaggagagcagagctgataacagtttggaaatcattagcatgtagatcatatgtaaagcgaagagggcggatgagatcaattagtgacagagtagagttgaaaacttgtcaattttgtatttattactgtgacttgctttaattaattttattaattcaacaagattttaatgtatactttccatgtgttttaaactgctttgaaccctcagggcacaaagatgaagatgtatcttttgcttttaagaagctgagatagaaaaaaaagataaaaattagttttgttaaatgattcactacaatatatattaaaaattaacctatttaggtatatttgtgacatttggataatggtagtagctctactgcagattcactttttaagtgagaatttaagtaatttatcttgagtaatgcaatattcacctgtctacatatgtacatttgcatattttaatttgcgaatgcattaagaaaagcctgagtgttttaatgattaaataataaccttattattagtaaatttgctgctaaaatgaacacaatgcattatggaatcttaacctaaaaattttgactcctaaggaagagaaaggaattacttgtcagatgacctggtttagattaggactgaagaatggtttagtgacgcattgctacctattatttcacttggaagactcatggatgtctcatactaagttttttaccttacccatccctcattcctttccgaacatcatgtttttctgtattacttttgaagtaagtggcattactattgttttcactcaagccagaactccaagtattattctagacagttgtgtctccctcactccactgttaccagcaaaacctacagattttacctcctgaatatttttttgaatctgctctgtcttctctgtcccggctcaccatcatttcacatcttctctccaagcgtgctcctttaaactccatctctgtagctagagcaattttatgaagctaaactgcccaattcattactcttgttaaaatctggcaaaatatctttcagcattctgtaaaaatggtgtcctgaagtacaatctatttaaaaaatattgagctaaattgaggcaaagaggttcctttattgtaaaacttctcagagccttcaacatgctaacgcatgcactgtgaattactaaaggggtgaaatttaggatgcttcaaaaagaagtcacagtgaagctattatgttgaggaataccaaggaatttttcatgaaatgcctctgtgaacactagaaatttctataaactgtcttaggaaatttggtctataaggaggaaattcagtcacctcaacatgacctatgagacctcttgtgacctagtccttatcttcctcatgagcctcatcttctatccctccccgtcttgaatttcttgcttgtaatagcaaaccacatccagttcctgtacacaacatgctccttttttttttttttttttttgagacggagtctgactctgtcgcccaggctggagtgcaacggcgcgatctcggctcaccacaacctccgcctcccaggttcaaacaattctcctgcctcagcctcccgagtagctgggattacaggtgtgcgccatcactcccggctaatttttgtatttttagtgagatggggttttaccatgttggccaggctggtctcaaactcctgacctcaagtgatccgcccaccttggcctcccaaattgctgagattataggcatgagccaccacatccgaccaaaataactctctttatccagctaactctactcaccttttgactctcagctcagagaccttccttgcattccacgttgagctaagtgcctcttttctgaagtccacttaccatctcacaaaaaatgggcataatctgtttatgtgtcttttcaccctagtttacctggggataaagactgaggctatgctgcgatgatgatggtggtgattatagctcagtttattgcacatactagatgccaggcaactgtatacgaattatcttatttgatagtcacaaactcccatgaagtaggtgttattagtatccttgttttgcaggtaaagcagctacggcttagaaaggctgaggaacttgcctgaggctatccagctactgagagataaactggggtgtgaattcagagagcttgactcctgaggctccacctgtgcctataattccagcatgacacctggtaatgggcactcagtatatgcttgttgatctaaactcagtgtgtgtgtgtgtgtctgtgtgtgtctgtgtgtgtgtgtgtgtgtgtgtgtgtgtgtgtggtcttcctctcacatccaaagctactagcactgaggaagttgggcatggtgtaggaaagagaaatctttgctgttaaatctcatttccagcataactgtcaatggagaggtggcatggaagggacaaccagttcgtgtaccaaattactctcagcttgcttgttgtcttaggcatatgttctgggagtggccaacacctgttttacatctgtgttagtctttgcggaataaaaagcaaattagggtttaatggggactattaatcttgtcacctaattgagtagatctaataaatcttttcattcaaaacccaatgggaatttctagttggaaatgagtgtggggaatattcaatctcaaaaatattttcatacacaaagattatatatgagtttgtgaaagatgttgaatattcaatgaaatttaatgagtatgaattgaacacttatcctgggcctagaactgttggcagttgcttttgagagttacagagtacatttatggtaattactgcacttacgaattttgctatgtggtttgggagtatctgaagtatcttatagtaggtctctaaactggtaataataaaaagttcaaatatattattttgttacactccacgaggatcaaacttcatcatgacatgattataatttgaaatatgagtaagaaatacgtagggtcatgatctctataagcccattctttgcttcttaattaaattttgcagctgatagaaacattgaaagcagagcattagcttataaataattcagaaaatggttggtaactcccatagtatatgttttatgagttttgtttaagaagagtctatttcgtgttaggtaaagttggccattgtttagaataaagacctgcattactttctattctaaattaaactgttaatgggagtgcttgcaaaggccttggtgcttttttttctgtttaataggagcaacatcactttggatcaattatttaatttccttatgtcagagttctttcaatttaaaggaaaatatttcctttcctcattcctttttctctgaggatgaaccagacattggaagttgtagcctgggattgtactggagctctcactgtggttgcattctttcttcacattcagcgtcctccttaaagcacacattttcacgtacatctattaaattacctgggagagagttctagacactatcagtcagtaaatccagttgtctcatttttcagttttagctattgttgcggtcatatgccaaggcttgtatgaatgaagggtctataaaaatatctgctgtggtgtgattttttttatccttgtatgagaccatagcatgagacagtagactggcaaattggcagggcgaggagagtgtttgtgcttacacggggcaatgaaaagagttttgattcttctttagctaaatgttataaaactttaaagcttacatttgaataatcgttgcagatgggttagataaaatccatcaactcacaatgtttttcctgtttccattcactagtgagtaacaaggttaaaagaaggaatgttctataaaataagatatagaatttgggttaggtttacaagtgaagagttcctctttgccctgcccccaaattatttttaggccccaggcctctgaagccaaggtaatctgcagggcagctttcacattttatcacaagtcagtggtctctcctcttccttgtccctcctatcttgccggcaaatggctctgtgggaaacccattctgcttcctgtttaaactgtagaaacaattcatttaattcaatatctagcttttgattctatttgcaaaaatacagttgtaaatagttccattcattagccaattttttttttggtctgttaagcatatttgggtcattttatagttaaccttggctgagggagagaagttctttgaagctcttacttacttacttgtgaatttttgggtctgatatggaggctttgcaggtcagaagcatggcttgactgacccaatgcccatttctggctctcttcatcctcgctgacctctacagtagagaaaggagaagctgaatattcactgctctaacctcccttgaagcaaggggtggccttgtaacagttctggccaatgtggcataagcagaattctgctgaggtgggttttgggaacggcttttgatttcctaataaaagaggccagaactgcaggcactattctttccacccctcttggtcttgaacatggctacaatgtctggatctatagcagtcagcttgcaactttgagacaatatgccaatctaaaaatggtagagcagaattatagatgaacagatgaacccttggtttttattagatcatggagccccatattatacagtactgcttccctttagacatcatacatgaaaaataaatccctttgtggtaggtttaatacaaggccacaaattctttgacactcctcccagcaaagtctaattcaccctcccttgaatataggccagccttacccacttgattctaactagtagaattcagtagatgtgacactgcatgactctccatgctaggttcacaagtgatgcggtttctgcctttttcttctctctgacatgtgccttgggagctttgagctgacatgttagaagtcagtctacattgaagctgccatgctgaagaactcatgtgggagaacacacagaaatcgagatgcctgaggagccccagctgtaccagcctctagctctctgagtcttctcagcaagaactgtcaaacatgagagtgaagcagccttcagatgactctggccccagtcttcaagtgccctagctggtgccaagtggagcagacaagctgccacccaccaagcccttcccaaattgcagactaggaacaaaataaatgttattttaagccactaaattttggtttgttatatattatagcaatagaaaaccagaacccctttttttaatgccactgttagttggatattctgttacttgcagccaaaagcatccttatgtgaaatacttagtagtagagaagattaaaagaaatcactaaaacgatccttttgagttgctatatgtgttgattatccaatctattcctctcttattctgtttgtagcaatccatttcactgtagcactgatatcataacttcccattgaagtcagtgctgctttagttgtataaaggttttatttacaaaagggctgggctagtagaaacatggaaaaagagggacttcaattcagggccccatactgctgttttcctgctcttttggcattttgattataataaagacaatattagtaacttcttcactaggaggtaaagcttgagagttcctaactttataaaactctcatcaatgtttgaagctgctttcttaatgaaatgctcctagcatttgacagctttatttttttcattgacatttgcagcttttaaaatagatgaatatttaatatcatgtttaataggtcagattctttgaagaaaatttccattaattagttcccattttctaaagaattgatggtcactcagtattgttggaattcttaaaaaggttttaatcataaatttatttttaagtctggcgtatggaaactagcaaggttgttctaggttaatatacatatccttacatgggagctacactataaattaaaaatcttttatcccaaagtaacataatactatttttagtgatggaaattcctaagcagctttgcaatattgtttgggcagtcttattctactgcactgaaactttaaacctgaaagaacagaactgcaactcctaaaagctagttgcacaaaagccaacttcaattttgtgtctttgtttactcaatgtccacatccttaaactgttggcaaattcgcagctgggtggagcagcaaaaatgtcattgtgctgatgatatggggagggatgggtgtggaggctagattggggcaccagaggagtccttgcaaagaaaagttacataagcgatatcatatgcagaagcagcctctgggttgaaaaataactgcacagggagtgtcagcctttcttggatttcactcccttatttactatccttaagggtcagacctatattcctgggtgggctggagagtctaagtgcagtgagttcctaatagcaaccctgcacaatagcttaaaaagcctggcaatgcttttttgtttttaaaattttgtctcaaggcagcaaggtgctgtatgcaaaagctgaatgaacatctcaatgagaagccaaaacaggacagatgtttcatgctgcgcctcaaatctggttgcttccagcatgatttccaggaagcacagaaaaacggagaagacaactggttttccttggcagctccaaagcagattaaaacaagcactaatttcccatcctgtccttctttcgcctatccatcttttttaggaaactaaattattaattcatgagacaatgccttgtattcatgacacctgatatttttatttttgtaacctgtgaaaaataagttgtcattgtgtgtctctcctgtgtcagagattccttggggtcccatgtcataatttacttggtaccaagcccccatctagcacctgagggaaattatatatatgcagtcatacagactgtgggaatggtgggagtagggatgaaatgtaacaaaactgagacaactgcaagtacatatgagatctgccacctgcctagggtgaccctgaactctgagcaccccaatatgttaagtatcacttgagatcttcacatcattagggagaggcaggtatttctgttctttggccatcgtgtgctccacatcttacttgatggcattctttggattaggacccttagtgtcagtcctaagctcctcagacacctctgttagctaatgcctttctgcaggtttctcagatgcctgcagcattctgcttgcccccagctcattagcagatagagcctataaattcctctctaatgccactgcctcttactgaagtcttacacagctccagaaaacagaaaaccttcacccatataaacgattgcttttagaagcatcaccttctcaagctgcagctaactccttccagaggcttgagttgtctcattcacagaggcagtctttctcaaaggatcggaattatgtagcatgcttgttaaaatacaaattcccactgaatcagactgtctcagggtgggattgggagttggcatatgtaacaagctccttatgcaggcagctacagcttccatttcaggatagagagctagttaatttcatcattgtacacatcaagtttagcatttcctcttagggatgagaatacttgtcgccctcacagcttggagacattaggaaaagtctgtcaatttcaactacgtggataccacccaacccttcagcttgcagcagccttaagaaaattgaggctttgtgggcaaaaattgaggctaaaacctgcactgatctttcatccttggccttggccagacttccacgcttacctttgaggagccgcctccaaagtcatccacactctcctctactctcatgttttcattgttttgcctcctaacccctgccttaccacacctcatgttcacccccatttcctctacgctctggacttttaccccatggtagattccctcagccttcaggcctcagctgaaatctgggtctcactgggatgctctttccctcttagtcttccgacatgacggttgcccttttttccacttgcattctgaaccatagagctgtgggtgacagatgagggatagagttagaaaggggtcggccaacttttcccataaataaccagatagtaaatatctttgtgggccacacagtccattataactactcaagtctgctgttgtagcacaaaagaaaccatagacagtatgtgaataaatgaacttgtttcaataaaacttcatttatggacattgaaatgtgaatttcatataatttccacatgttgcaaaatagtattccttttctgaaaaattatcaaccattgaaatggtaaaaaccattcttagcttcagggcaatacagaaacggagtgggggcccgggggcagctagagtggcctgtgtgctgtggtctgctgattcctgacagaaaccagtgcttctcagacttcaatgtacttacatgtcactaaggatcttgctaaaatgcagactcagattaagtaagtacatctgggacggaacctgagatcctgcatttctaacaagctcccaagtggtaagcgtgcctggtgagcgcaccgcactttgaataataaggcactacagtcagtcatgtgtagaagcttctcctttatataataaaggcattaaaaatagcttaatgacataggaaaatgtcctgactgtaatgtgtgttagatggaaagtgagacagtcgagagcacaggctttcaagccaaacacactcccacttaccaactatatgcatctgaacacatttcttaacctttctcagtttctgttaattcaactgtaaaataaagtaaaaattatctctgcctcaggtggttgtttggattctaacaagacaatgcttgtaaaacactcagcacctagcaaggcctcaatcctagcccttattatttttaaatttaaaaagcaagacatgaatctgtatataacaaactaataggaatgttaattttgagtgtctcaggggatttccttgccatcttttttagaaaacatttgcaagagtcatgcccattcattcattcattcattcaagaaacatttgttgagttcctgcttctgccaggcaatgtgttttgctggatctgccaagacgagtcaaacgtaagctcacataagatggggggctgggaacaaaaacaatctcagcatagaagaagggctgtatgggagtgtgcagggtgctagggaacatagaggaaagagtgttccctccgctgggaggagaggccagagggattccacacaggaggccactgttaagctgggcttcaaaggatgcatatgggctgcctaatgggggaagaaggaagagagtatgcaaaggcagtgaggagtccagagaacctagaccataggagtgtgtgggagtggccaaggagaaggccctggctaatcagaacaggtgtaggcctttatgcagcagagatttgaactggctgggtatcagctctggataggccattatcccttttggagaacatcctgacaattacaataacatgtgctagcagggacttcagaaaagacagtgccagaaaatccctcaccacttttgcaggagtcatcttcataagtaattctctgggaccatacttgactcgataattgcctactgagtgtctgttacaggagggaggctttgcatggggctgcagggatgctgcaatgaggtctgccatctgccacaggagaggttaatcactacaccagagggtgaagggagccaaaaacaacatctcctagagcttaataagaaggagaaaaagatgaaggagtatggatctgaaagtgagagctccagatgggcttcatggagcaggcagcatttgagttggccttggagatggcccattctgtctctgggcattctctccaggatctccagcttgaagggggatttgagtctatttctgtaaattgctaacttcaatcaagggcattggaactaacagtaggttcctgaactgaccttctagcgctgagaaagggacagaaggtgtcatctgaaaggtcccttaacctgtctctccaggggaaaacttgctatcaaagaaaacttggattataacttacagaattaaaatttagaaatggttcctggcaatctctcttctgtcttccattcctggttctctgaggccttctgtcctctatagcagttctaagacagagggttatgtgtgagacagagtggacccagcagcatggggaggaggtacctatttgggtcggtccatttgcattctgattcactgtgtcctgagtggcttaatgctgtttccagcctgctctcttctctgtaaattcctcctttctcagtggtatgggatggatttttctgccctcatattctcctaaaccttgcctgatctttttaaaactgatttttccgcatcctgtttgcctttaattgagatttagccatgcccaggcctgtctggtgacccgaggggagatttgtgcctggggcttggagctgagaatgtggagaaggcaccatgaggctgctccccagaccagcctgtggactaggtttgtgctcagcagagaggggtctgcaggcggaagctgaaggtgctgatttttacaagaaactccctgagacaaagattcacaagcaacattgctcagggtaaacccagacattgttagttgcttctagagctagtgcttacagagtcctaacacttgacctgaactggctcagctcggtctttccacagtgttaggggaaagggatactttctccacagaagagagtttttctgtccccagagctgtagtttgggggatttcttaaaccgcttcctgggcaagaaaacagaatgcctacgaagggctgggctgagaagctgctccaaatggctatttctgtagctgggttgctagaacataaataagaagcgtgtttgtgaacacacgagatgcccttggatgctcccaaatacaagcatgggagaaaagattgcaaaggtctccatttatgtggttggcagaacacattactgaaatgtgtgctgttattttagcgtaagctcatttgtactcactggctggccagatcaggcgaagtttgagttacatttgtaagtgtacataggtacatatgaaatcgatactgaaagccctgttctagaaacagtgatacccaacccagccaacccagtcacaaacaccatggcacgcataggtatctgtttacaggtgccacatttagtatggctatgagtcatcaaacctgtaattacttcgcaaagtttcctaaaccactcttgtcagtaaatagcagtatggcatgcggctctacttcttcaaatgagggagggagtacagttagctgaatcttaattcatagatggtctatcttatttcctagaatgtgtaactaggactttgtcattttgtttacttctgtatctgcagcgcctagaacagtgcctcctacacagtgggtgcttaatattggtgaatagataaatgaatgaatgaacgcttggattttatgtatgagttggaggccatctctcttctctcttcccactcagttgctgttacatctgccaacttctgcttttacttgagtccctggcctatggaaaattacaccctctcagtgtagactgtgggcagaacctgggacattataggtcagcacgtgggtgtgagttcttgtacagacacagaggcctctggcttagcaagtcccaaaggctctgagggactttcaggcagaacactataaggctcatcttccttaaaccatgttttttttttcccattatgaaaataacacatggtcattaaacaaagtttggaaatgctagaaaatatgaaggtagaaaaactacccacagtccgccgggcgtggtggctcacacctgtaatcccagcactttgggaggccgaggcgggcggatcatgaggtcaggagatcgagaccatcctggctagtacggtgaaaccccgtctctactacaaaaaaaaaaaatacaaaaaaattagctgggcgtggtggcgggcgcctgtagtcccagctactcgggaggctgaggcaggagaatggcgtgaacctgggaggcggagcttgcagtgagcggagatctcgccactgcactccagcctgggcgatagagcgagactccgtctcaaaaaaaaaaaaaaaaagaaaaaaacaaaagaaaaactacccacagtccctttacccaaacacaaatccacccttctctttctcctggattatcacatagctttaaacctgcaccattctctccagccttgcatccaatccagtcacggtgccaggaagagatctttctaaagcacagatctgaaaacacttcaaaggcttcctgttgcctttagtgtccaaactgctccacaggattggttctgcttatgtcttcagcttcctagccccaccccgaccccccataatattacgcttgtgccaaatggaatttccctcaattcttcaaacaagctgcaccttctcaggttcactctgcttggaaacctcgcgacctttcttgggtctattctttctctcttttactctgtttccttgtctgtgttcatctgttttttcatacattttctctttgattcagcatttagatagtatttcccctaaaaaacttttcctgactgtccttccccttttctctaccaaatctgagtttggaggtcctcttgtgtgcttcaaaaacccatacatttctcttgtcatgtagctcatcatgcagtattttagtgcttctttgtgacggcatctttctaacctcagtgcttagcccagtgcctggctcatggcacacagctcaataaagagtggtcaaagagaatttagattgaccattatttatattttaaaaatattttctttattaaaatttgtttttaattgacaaaaatggtattttttatggtgtgctagaaacatctcctcttaattttgctttaatcactttttttttttttgagacagagtctcactctgtcgcccaggctggagtgcagtggcgtgatcccagatcactgcaacctctgcctccagggataagcaattctcctgcctcagcctcccgagtagctgggattacaggcaagtaccaccacgcctggctaatttttgtatttttagtacagactgggtttcaccatgttggccaggcttgtctcggaactcctgacctcagctgatccacccgcctcagtctcccaaagtgctagaattacaggctgagccaccgctcccagtctacactgtgttttctattttacatagatataataattatgcaaatataatgttatagatcatatcatgtaaaaatattaatctcaattctttttacttaacattgtgttaagtattttcacttttacccaatcttcatatactttatttttaataactgcatactattccatcaagtagatatattctcgcttactaatcttctattgttggatatttagacattttaggtggtttagcttcttgcaaattatgaataattttgctataaatatctggatatctttgggcataaagttttttcatgttttgaagtattcccttacaatacctaaagtaaaatttcaaagtcagtcagcatttgaaattcctaatgctcggtgcctaactgccttctcaaagtgttatcaatttctgttggcaccagcaatttatgaaatgcccatttcacttaacctcaccaaggtcacttccttctcaaccactaaaatctcttgaagaacctggacatcccaaaggcagcagcactgagtactcaggccaacacttgcccctgttctcactcccttccaagggcagtgtttcagctccagtttgtggagggcaaactttcctggttctcaccccctcaggctgtgcaaccttggatagcatatttaatcactctgagcatgtttcctccttttaggggagtgagacaactcttcagttgctatttattctatttcaaactctttaaatggacctagggcaacctccacttgcatttcctacccttccatcaatacacacacatgcacacacacacacatgcgtacacaaacacacacacacacgtgcatgcgcctgcacataccgctctctgagggctgtccaccaagaccatcttcccactcaccttgtcctgtccttggctctctgatttctttgcttctccctgtagttctcagcctctccctccctccccatctccctttttccctccctccctcaattccttcctgccttccttcctccattcatccaacaaatttatcaaggacctactagtccagccataagtgctgggaaacatggaaaagaaggcagcagtagttcctacgtacatggactttacatactagtggggataacagattaaaaataacaacaaacaaacccatacaatagaaagttacacattgtgatgggcattaggaaggaaatagatgaaggctaagagagagaacctcgggaaagatcttttgataaggaagtaatacccccctccctcacccttgcttacccccttcactccttgctgtgctttcatctccacagtacttaacaccaactgacagaatattttactctttcctggtttatttgtttatttccagtctcctccaacttgaatgtaagctccacgagggcagggctttgctgttcactgctgtgcctgggcactgcaggcctccatagcattagctgggtgactgaaggagtggaaggccctgggacatgtgtgcagaactggggctgtttgtgaggataggtggtgtcagaggtgtataggcggagggaacgtcatgtgcagaggctctgagaaagggaaaaggggtggaaaggagcccagaggggctgagtcaggtgaacaagggggcagcagcaccaggagaggtttgccaggctttgcaggccctggtcatgggtttggatttcactcttagggcagtaggaggcccatgatagttttgcttcgatgggacactgggatacgcctccgtgccctggcagagtatgtctaagatatttgtgagtgggagtggagttgggagtggggaatccacatggtgagttcttgtgcatggttttgtcttaaccctatgaccgaatactccctgctgggtgtgggggactagactccttccaagcctgttgttttgggaccctatgattatcagtcagcaaacatatgactacactccccgagttatcatgtttccttgtgttttgacatccagcctagtggctgacccagatgtgaaacctcgctgctgaaacaggcaggctctggagctgccattttttaggatgacagtagatctgaatgacatctggtggtttatgggaatatcttgtcaccgaccatttcaagtgcaaacaacttccttctcacccacctgcttgctgcctgcttccctttctttgccttcccttcccactggggaatgccagccatttgatcagcatttgtcagcgcagttaagccacatcattgtttgcccagagggacctatttccctttgcccagtccgggcccttgagcaaacctgggaatttatgggatccacggagctgagaggtttgtgagtagcacagagtaatatagaaaagtgcaaatggggagctggacaactcaggagactgtaacatgaggcatgttagcgataccatttctcttcttcctggaatggggaggaagggtgtccttttttttgttttgattgtgagcaaatggcccagcatagatccagctgttataactgaattaaatttacaacaaacttagtgtggcacattttgaatagagcatctaattattattgggttgcatggcaataaggaacaccctataaacaatttattgatacagtatagctttcattcagccaaaacacactttgtttctttcatctccctttgtctctctgtcatctataattggcattcatggtattctctgacggtgctagattaattatcatatgggcacacagtacctggtagcaattattattctgaagaagaaattagagtccactcatatcattaacaagtgggaggaccagcatggtgttccagtcctgggattcagacttcagcccatcatttattcggcagtggtatgcgctacggtgtaatcactgtcacccagcacatctgaaggtcttaggctgtcctttgccaagagtaggggtgggtggagtggctgggggcagggtaaagacatacttggagcaaagttctctggatcctgaggtctgtggtcttaaggcagatgggggcggaataaagttaaaggaggtggggctggcagcacgatccagggactctacatttcctgtacccctactccacccctgcatcaaagatatgtagaaagagcgggaggggcgtggtggctcacgcctgtaatcccagcactttgggaggccgaggcgggctgatcacctgaggttgggagttcgagaccagcctgaccgacatggagaaaccccgtctctactaaaaatacaaaattagccggacgtggtggctcatgcctgtaatcccagctactcgggagactgagggaggagaatcacttgaacctgggaggcagaggttgcggtgagccgagattgcaccattgcactccagtctgggcaacaacagcgaaactccatctcaaaaataaataaataaataaacattaaaatagaaaatatgtagaaagagtttggatcaggattagtcttactgtaatatcagaaaaattcactggtcaaaggatggctctctcacttgcatatccaccaaagagacagagtattttattacaaaaaaggcataaaggtgagaaaataatataaaggatccaacctttgggggtatctgaagaggggaggcagagaatgccttaggggggtggggagcaggtggagcaatcaatgggagggtgaggtgtatgtgtgaggggaaggaagtcaaagcagggactgaagagaagacaaacttctccaattgctgatgttgccacgtggtcctgtatgttacagaaaggaatcttcctgacagtcttttctgtttgagagcaccacacccattcctttgggaatatgagttttctccacttatttcctgccctaggagtttcatgaattggcttgccaaggacaggggtcaaactatctctgacagcaattaattgcttagtggcttatggagtaagcggcttacttcaggcagatgggacagcagtggaaatttgaattctgcttcatggcggtcatgtggatacttcatttttcttgggcattgaacctgtgtacaaccgcagagaagggaacagcaaagggtgaaaagatgctaaagccaattgagcaatctgttctttgcaggcttgggagtccttaaaaaaagctacttcagaataggtcaaatggaggggtggcaggcagttcatggttgctatggtgaccaacaaacatgtttggcttctagaggtcctgcccctgaagaggatgatggcttttgttatgaaatttgtgaatgtcccttcatctgtgtcttcactatttattttcaaagttgtcaatagtaacggactatgcatcacttgtggcccatctctgtccaggtttggtgctatccttggcccctacatttacctctgctgggatgtgaggttctgacctctttcagagcctgcagaggtttatgggaaccacagaaaagcacaggggagtgtggccatgaggagaccagggctctgctgtgtgactttaactgttgtggccctcaattctattaaaaggggggtaaaaatatctgctcttattaggaaaaatggctaatgcatgctgggcttaatacctaggtaatgggttgataggtgcagccaaccaccattgtacacatttacctatgtaacaaacctgcacatcctgcacatgtaccccagatcttaaagtaaaaataaaaattaaaaaaatacctgctcttcctaccttctgaggttttgtgaaggtatatgagattttagatgtaaaagtaacttgaaaatattgagtgcattatattcttttataaaggagcataaaaatttaactccacaatcctgagatagaatgcttattacagatggtaaatatgtaagtgtcaaccctaattgaatgatagtggctgtctctgtgttgagaaggatatgaggctgcatccaggctcagctggcaatggtgccagtcatttagtgatgtcagttatgtgtatacgaggcagaagtggcatcacaagtgccatgtatttgctgtcttggtttaggacattcttccttgcttcttgctgctgcctttggaggttgggaactcattactgctctgtagcttgcttggtattggtttgtcagggctgattcatggaagctaaactcctaccctgtcaacctgaaacctgtaattttgttttttcaaaacaacattttgatttcttactggtaaaagtgaaatgtgtttattgttagaaatgtgacaaatagtagagaagcagacagaataaaataagaacagcccataatctcatcattcctggataacttttaacattttgtttataggtttcatgccttctgatgtaatttattttataaaaggatcattagttgctttatggagaacagattgtaggcgggcagtgtgaattcagggagactaacggggaggctctcatagaagtctgggggagagatgctggtggcagaggagtgggcagtgctgatgaggagaggggctggatttggtgcatattttgaacatagagacaacaggacttgctactaatgggttggatgtaaggtatgagagaagaaggaaggcatcaagcatatgatgccctggtttctagtcccatctcttgtgaaatgatgatccatttactgagatgggaaacaatgagacggaagcaggtgtgtgtgtgtgtgtgagggggaggagacagcaatggaaatcaaaagttccattttggatataagaaggccaagtaagaatttcacacctgagtgaggatttctagtcgggagcttaggggaagaggacaggcagggagattttatctggcggattatcagcatagagaggatgtaggggagatggtctcaggagtgacatgtagatggccaggaggtctgaggacagaggttgagccctctaatatggattggttgggaagaggagaaggatgcaatatgggagaacaaaggagcagccagtggactaggaagaaaactaggaaagaatgcagtgattggaaaccaagggcagagggtagttcaagagaaaggaagtgctccttctctctatgtacacagaaacactcacatgcatagatacatatgcacacacatatttttatgtgagactatgcccatttttatataaatgtagggcttttcatttattatggtgacttttttatccccttaaaaaccttccaaaagattattttgaatggctttaaagtagtctatacttgtagctgtaaccttagaaggaacaaccttgtatatacattttatgtttctttaaattcttgaagtggaattactgtggatatgaaaacctttaaggcttttgatatctgttgtcaaattgcctttcagagaggttgtaccaaggttgtacactccaccagcagtcaactgaaaccaagcatttggcaagcattattagcattaaaattatatatatatgtgtgtgtgtatatatatatataaaatttttaaatatatgtataaagataattgcacacacacataaacacatatatatggatatatatgtgtctatatatgcctgtgtatgtatatgtgtgtgtgcaatgctatctagttttctccacttgcatgacttggttactggaggttgaacaagtttcaacataaggcttcttgtgtgcggtctgagtggtgagcaagttgatctggcacccacacccccttaagtatgaaaaaaatgagtgtaaacatcccccaagtcagccattcagggcatgagggctgcggaggaggaggaaagctggttctgagctagtttctcggtgggggtggagtagatctttgtcagcagtgaaggagccggtgtggttcccacagcttgcagtgcctcctcccttcccggccagacttcctgtgggcccagcctgggaaagggcgtggtcaccaagaggcagaagcagccctcctcagctgcaccagccccgatgtgttaggtggtgaagtctctgttgccctgtgaaccgcagcccacgttgcccaattcagcaacaaacacgagccatggggcccaggccgactgccccacatacagtgtcctttcctgcctgggtggagccttctcggtctgagaggccggtcctctgcagagagaccttcggaatcctccctacggcctggctgggcctctgtccagctgaagcggaaagacccggtgtgctgtgaaactgcagcagggcagcatccgtctgttggtctgcggcgtcgcaaagggcgattgcaccacgttgttaggctgtggatgtggaaatcgacaatactgaggcgatagaaatcttaaaagaatgtatgggacataaagataagccaaaaatggggattgtggcaatcttgtgtgtaacatttctcatttcataactgtgccagtcgcaatgtaactcaaaggaaaaaagaaagcaccacaaccctttgctttctgggtagcacagacacctgtaatattttctatggtcgccaaggacgaattcctgacagagtgcaattagcacaggttcagaggcctcaagtccaaaggaaaggattctgtgagaagttaaaactgcaagatgaaaaattttcagtagaaatggcgctgatattgagtttcttcagatgtttttctttttgtatttataaaatatttccattgtaaagcattcaattaatgaagaatggtgtaaagtaaaagctagtcttctctcaagtccctcaaacctcactcccacttgctaacagtttggtacgtgttttccagtgcttttattatgcaattatgaacatttatatgagtatagtacatagctcatgtatagtccgtttatcaagctgctagcatgcagttagtgttcaataatatatacccacacatacaatttaaaaactgaaaatgagattatactatgcaaattctgcaacttgttttaagttttatttaaatgcaatttctctttgtctttttggcaggtagtttagtttcatctttgctttataaagacaaaaaatcaaaaactttttccagccaaggactaccaggtagatgaatttattcgactattatttgttgcatgccaaagatgcatcaggcattgctcaaggagctgggaatgagtgaaataacaatcctcaccctcatggaactgacattttggtagagggaagcaggcaataaacatgtttaataagtggattgtcagatgttgatagcagagcagatagcagagcatgttggggatggttagggaaggtctccctgaaaaagtgacacttgagccaaggtctagagatggaaagggtaatgccacagggatatctgaggaagggcgtgtcagggaaaacaaacagaatgtacaagagccctgaggagggagatagatgacttcctcagaaacagtaaacaggcaatgtggctgggtaatggtgagagaagggaggacagatggggtggttggaaaggaccggtggggccttgcaggggatttggaggtcctgggcttttactctgagggggatagcctgttcctgggggcatggagcagagcagcctcatgatgtgatgcatgttatcacatgagcaccccggctgctgtggagagtagactctctcaggcaagggcagaggtagggatgccaactgggaggccacggtggcgatgaagcaggggagtgacagtgaacattgggatggggtgttggcagtacaggtggggacgctgttggattctgggtacacttacaaggtagagacaacaggatttgctgatggatcagatgtgggatatgagacaaagtgcaaagccgaagatgactatgaggacctagtaacgcatggagtgttcctaatgagaactttattcattagtcaaggcaagaaacaaacaacacgagagtatggatgacaacagacatcagaacatggagatctggagggccattatagaccctcttttcctctctttttgcctccacaatatcatgtgctatgccacatgtgtgtctcctccatatcagcacctctcagtcctcaccctgagaaacccctaatgggagaggagtacaaactatgaatcccagccgtctgggccagagctcatggggcccattacaagcatggcattacattaataccttgtactaacaaaatccatgttaatgctggattctactccaaaatatctatatgttcattttaatatattcattacctataattaagtaaaattgttggtcttgtatgatgggccactgacatacaccaagaatccctgagaagatataaggcttggagatgtttggcccatgcctttcctattgtatgtgcaggaatactgcctcccaagaagagcccacttattcatgggttggctggtccctaaagcacctctgcacttccaggaccatgctgtatacctgtactgagatgagcaggtaaccagatcaggcacaacacagaatggtcgtctcaccagcttgggctcttccatctctacactgtagtacaggcactttcttacagatggaaatagatttttcttccttccttttaccttataacattctactcatccttgggtttttaacctgtttaaaagcttttctcaaatttcacatcctgttcatgatgccttatgctaccattcaaagtgataacttgtttcaattaatccttagagcacttattttctacggggatcgtggtatatattgggaagacaaagcttgagtcagaagagcagggccttggaatcaggcttactttaatttaaacgcaagccctgccatgatcatctgtgtgattttaggcaactttcttcacctccaagtctataaaatggaattcaaagtggaactggaaggatgattaagtgaaatggacatgtgaagcacctagcacagtgcacagccatttgataaatattattgcctcttcccccttaacctcttaatttggtacttttagtattctacttgtatggttccatgttttgaatttttatgtgttttagttctctaactagacaataaactcttagagtttagaaaccacattttatatttcttgacatccctgaaacatccatcacagtaccttgaatgtgggagatgatttataaatgtttgctgattgatttatggatttttttttggcaagtttaaacctgaaggacatactactctctggagttgagaacatagcaatgagcctcaaagaagaaaatgagcctcagtgttcatggaggaaggtcattgcttagcaccttgggaagacatgcagctgatggatgaggaggatgctggatggctatgctgagttggctttagactctgctcaccagctttggaaatggttacccagaaagatgacaatatcctgataacccctccatgaccaaattctttagcaaagcatttcaacaggccatcaccgtggcatgtggactgatgggttgcacagctgttattatgtgcttacaagggaaattaggagtaattaatggactgggatcaataacagtattatattgtagtgaatgatttaattttctaagtgaagaggtaagcacagatatttcacatcattaaaatagatgtgaatcagcatagcaggtttgaagaaactactccattttttgttgtatataaaagtttaaatttttaacttctatttactttttgaaaaggtaacgcatgcataaggtaacttgaacagttcaaagtagtattaaataattgctccccagagacaatcactattgctagtgtattgagtgttcttccagaggtgccctatgtatttgtgtgtgtgtgtcccttagctggaagtagtttcgagaatccaagaacttcctgttggtctgctatatctgtttggttcatccgtatatctctggttgttaccccagagaccagaccatacagcccaaaatttatggtcaataattatatattgattgagtagatctattttagtcagtgactgatttaatctgttttagcagtttttagaaaatgatcggcatttgcttgatacatctttattgtgaattaacaagacatataatttgacatgtctagataatagagcatcttcatgaattctaatgtattggtacaataattttaaaccactggtacagaagctgcctctctgaatattcttcactgactggagggaactctttggaaaatatgtgccatctgagtttaaataagaatgggttaagaaacaaaaaaacaagattaaaaatatgtcagaatacacatgcaaattggtgcagttattgaaagttgctagttgggaggctacatattttaaaaattgcctccttaggtttacaagccacatattactgtggctgctgccacttctactattattgctgttgccactactaacattattactatttatttggcatttgcccctatacagtaccgtgtatacttacttaccacgtatacttacagtaccatgtaagtattttgtatgcattatgtcatttaatctcgtagcaacattatcaggtaggtattattatcatttgcattttatagatgagagaaccgaggcaaataatgatttcataacttgcttatgttcacagagctaataaaatggtggaagaaggattgtggcccagtgtgatactagagcacatacttctgagtcgtgcttcagttttgaccaaaaatggaacattcttattgatcatcctttctgtttgccaaatttagctccaaatgactttttcaaaattttatattttttattgagatggggtcccactgtattgcccaggctggtgttgaacttctggcttcaagcaatccttccacttcagcctcccaaagtgctgggattacaggtgtgagccaccgcaccaggccagtgccttttttttttttttttttttttttttgtggagatagggtctcgctatgttgccaaggctgatcttgaactcctggcttcgagctatctcctgcctttacttcccatagtgttgggattaaaggggtgagccactacacccagccaacttttgactctttcaacaaatgaaatccactttcagaaagaatgctgttgtgttagcactgggttttcaaaagatatgtgtcaattttaaaagaggagcttccaaaatggtttgcattattaaaatgggtgaatactttgaaagggataataactcatttgtgtgtctatacatgtgtgtttgcttaaaaaaatctgcccttgtatttattgtcacatctcatatatttaatttatttaaatataggacaatacagggaatttcctgttagagttacatagttggaaaataccaaattgtctgtatttcttcacatttcatcactaggcatccagatagtcctaggcaaatctatgaattatgcaaaatgtgtcttgccacatccctttctttcagcacttccctttaattatttctccatctacactctcctctcctcattcaaaaatgccaagagcttggtgaccctctgcagccatatgcagagtcctcaagttcaaggccctaccctgtcctgtcctttctgggtactcctttcatgtgctctaaaatcattcctctttttagccattcaactaaaattttattcttgtagaataaccaatgacatgtaacgttccggagaaaagacagcagagaaaagtaatccacattaaggtgtaaatgactaacagctctagcttaatatagagatcctgacagtggcagtgatatttagaaagagaagattattaggtcaaaagaagtatattctttctggcctgggtcccattcttgtcctttctcgaccataatagatcctgtgtggggaatttcttgtcctacttcagctcatgcaaatcttgtatctgtggttgtacattattctttgatgacatcagagacctacttctgcttttggcatatgataggggacacttgtttattttggttgggaaaggaggagattgttataggcactgataggggtatgggggccatgtttcccagggggattccaggatgtgtccatgagaaacgcatttaatatattatttgggaaaggagtgtttgttattgttacagtggttttgcttgatgatttttgtttttaacagtgagaaactgaaaatcttctatgatcatcttgttgcctctagcagtgcttttgacttatagagtgtgtgtgattccctgagataccaacttttctgccagtttcaaagtttaatagtatttggggcatgccacctagcggtgatagcttttggtttcttgctcattggaggagaataaatcaaaaccctagtaaatcagtctcctagacttgaaagccacatgggaggccatctaggtcatctgttagcttttgcgtaagcaggcaagtaaatcaccctttctgtggatctgagacagaaaaatcagggcatctaaagccccctgggctcagaattcctccggctcccagttcccccagtgaactttgaatgtttgtggcctgcatggctgagacgcgaccctgtatctccgcaggcattttggcaatcccagcaacaaacgcatggaagacaaggctcctctgactctgagccctgacttacctcgtcctcactctgacctgttttctccctctcccttcccccactcttggcttctccttaccctctccacactccccactgcttttagtgccttccttccattgtcatgcttgatggacccaccatacaatacttttttttttttttttgccatagctccttttaaaatttctattttaactttctgtccctaaatagaaaaggataaatgcttagtacagaaaagtttggtaaaaaccctttttgtgtctgtgtgtgtgtgtgtatgtgttgagtgttttttaaaaaacaaaaataatataaaatactattcacttagtaatagatcatgagcattttccccatgttaataatgttctactctaggattttagtaactgcatcacaggatataccagaatttacttcattactgttaaattctaggaaagtgagaatgataggaaatatttttaattcacagtcacgttcaggtcacactttattgaacattgattgtgtgttatgctcctgtataagccatttttacattcataagtacttttaactttcataagatctctgtaaaggccgggagcagtggctcatgcctgtaatcccagcactttgggaggccaaggcaggcagatcacctgaggttgggagttcaagaccagcctgactaacatggaaaaacccccgtctctactaaaaatacaaaattagccaggtgtgttggtgcatgcctgtaatcccagctacttgggaggctgaggcaggagaatcacttgaacctgggagacagaggttgcagtgagctgaaattgtgccattgcactgcagcctaggcaacgagcgaaacttgtctcaaaaaaaaattttctatgaggtaggcattgtgatgccattttacagaagaaacttgaggatctgagaagcagcttacccaagatcacatggtttggaaggaggaaacacagtaaaattttgttctctggatttatagtccctcagccacttcctgaggtcccaatagatactgaatgtgaacatagcttttctgagcattcttgctctttgtcttcaagatgggaacagagagagacccttgaaaggagattagtgttaaaaggctttagagtcaagttggggattgcaaaatagggtatgagaaagtggaaggagagctacctagatagggaagcctgcgttttcatagcctcaggaataactcttgctaaatgctctatatacattatccaattttatcctcacagcaaccctgggaaatacatacaaatataattttactttacagatggagaaaactaagatcagagaagtagttggtctaaggtcactttgctggcaggtgtcagaggcaggattagaacccagcttgtccgattccaaaacttcttcaactgtaatatgaatttcctctccaggttaatgagtgtcctaatcattctaagaatgagtagtaataagaattttatagtgatatagtcataggccccatccctggttttgagggtgtgtttgaaggggggttaatggaacagatgaatgaagtagggggaagaggggggaagaagagtaaagtgaaacaaagcccagaaaaaaaattaaaaagcctgaaagaatgccagttgcaataaaagcaacccatggggaagacagacaggtaatctttgatgcaaaacatttggaaaacaatgctcagctgttgaaaaggctgaaatttctgttttctcatgttttataattaagaagaaatctaagaacacttgttagaaagttttttctccagtggtccaacgtacatttcccaaaaatggttagctcaaaaaactcatcatattacttagcataagcaccagtgaaatagtctttatgtcaattatcccacaagtttatagtgcagggtgagagattagcagcaatatactttttcaggcattgtggccatttcaattgtttctgattttttgatctctaaaataggtaatactccctaattcataggtgttgtgaaaattaatgagtaaatactaagagctttgggagggatttaaaagggagatgttagtgtatgctattattatatcctcatttctattctgaagtcataatgctctgatagtgacactgtcatcatcaccatggaaacccatgatatatgtcacttttttctctggggcctttctccatcctccaggcagttccagatgctgccacaaaaatgcttagctcccttttctggtcatctttaagttccctcactggtttgtaaatgcctttactactaagcttttccttgaatatgtccctgtcccttcacctacatctttcttctcttttattatcctgtattcattcctgtgattctggacacatagctttccattcatttgttctcttttaccttgctcttcctttcctcctgtgtttgggataatctttgttgattcaacaagttgttctttatccctattaatgtctacatggagaagccaaggcaacttgatgttatcaactttattactgaagtttcaacatctatgtagtgttttgcttcagttattaagaagttggctggacacagtggctcccacctataatcccaacactttgggaggcctaggcaggaggaccacttgaggccaggagctcaagaccagcctgggcaacatagcaacaccctgtctcacaaattttttttttttttaaatcagctgggcaaggtagtgcatgcctgtagtcctagctacttgagaggctcaagcaggagggtcacttgagctcatgattttgaggatacagtgagctatgactgtcactgcactccagcctgggtaacagaggaagactgtcaaaaaaaaaaaaaaagaaagaaagaaagaaaaagaaaagcaagcaagcaagaagtcaccataagtagattgctctaatccctgaggatgagtgaaatcaaatcaataatactagttacccatctatgaggaatcaggtggatattatgccaggttgtttctagtagttaacagtttgtaaatgaattcaatcagatttttaaaactctgatattcttcattcttttgagagatatttggcacataaagacaagatatctttattacaacacttaatcggaagaaatgaagcatattaattctctaatgaatatttttaataagttttccatgttaccagtagtgtagtgttcagttatcaaaagaacataatgagatctcacgctgtgtaacagaaagtagtactatcttgcctagaagagaacattcagacatttgtttatagctgtcagtggtcatttctgcagtgttgaattgtctctcccttttcctcccctacttttgagtcacttaaaatgaaaaatgggaaaaaaagcatgctctaatttaatggtttccccatccttcaaatgctctccttttaaacattttctctgacattagtttctctttcctagcaggaggctgagtgtttaagctcctgacatattcccgccgagtggctgtgagtgtgagaagcactgcagtacagtaggagtgactagttaagcctcttggacagggagaaagaactgggagtgtggctgtgaagtgggtaccctgggtacaagtatccctgtctttagaatctgtgtacctagtgtggctctaactccagttaagggcccagttaaagtgggcctggatgtctcatgaagtcctggatggcccccagttcagaggacccagtactgaaggtgccacctttacttagctcctgatctgggctggatgtgaaggcctctgagctgacttctgactctggctcacctcccgatgcttatatgcccctccctgcccttgccaaatgatctccctctccctgcaggttctcacaccaaatacaaacctgaagatgaaataagtcattgctgtgcactgctgaaccccagcctatgcaggtgacagatgactgatgccagcccagctaaagcctcacttcattcttgtgattttgtgggcacaaaagaacttgaatgagttgaacctaaagttaaaactaaaccagaagacagtaagccatttgctcagcagcctctatagcaatcgctcttatagaataagggacaggggaatgacagtggcccccatggctcccagtggctcgtgcttcttcggcatttcctacatttcccttccatcttcctcactggaatgacacttgcaaccctccaagccagggcactatattaagtgctgtacatacagtacttcactgcatacatacagtaatactattattattgtgttattattattattgcgtttttgcagatgatgaaacagaggtcctataagcatttcgtagctctggtgctgagctcaggacttaatgtatatcaagggctccatagtgtttattaaactggaatttgactggttctaaggagttagtcttatcgtgataaaaactctggacttggggatgaggcaagtgctttttttttttttgaggcaaagtcttgctctgttgcccagactcgagtgcagtggcatgatctcggctcacttcaacttccgcctcccaggttcaagcaattctcctgtctcagcctcccgagtagctgggactacaggtgcatgccaccacacctggctaatttttgtattttttttttttgagatggagtcttgctctgtcacccaggctggagtgcagtggcacagtcttggctcactgcaacctccaccttccgggttcaagcaattcttctgcttcagcctcctgagcagctgggactacaggcatgtgccaccatgcctggctaacttttgtatttttattagagacggagtttcaccatactggccaggctggtctcaaactctcgacctcaggtgatccacctgccttagcctcccaaagtgctgggattacaggtgtgaaccagcgcgcccggccggcaagtgtcttctttaagaatatggagatattgacttatcatcattagtctctaggatttctgtgggggctacttttctgtctttgattccacaaccaggtcagtcttcctggttgactatatagctgcttgactataaagcggttgaaaaaattccctgtgattacttgattatgctcagatttgttagattctatttcagtagaatatgttgatatgaatttgccaacatgttgataggtataacttgtaaagagggctgtctggttcaatattggcttaaagcagggaagagggtttctttactgcagggcttccttgcacctttaatatgttaatatgcattggtgatctcttaaagggggaataaatatttcatcaattctaagtagcacttccctctgtactttattatctctgaggtaggatgcttcttacagtcagtggtatcttatagcagttgttggtcaggcagcagttttgccatggttgtcattgcctgggtacatgcgatgttggccatagctatttttgttgtcacatcagctgagttaggtatattcctagcacagcatagaatgatgtttcattgctctttaaagtatcttcataaagatcacaccatgaattggtattgacatgaaaagttactgtatatgtcaaaaggtatggaaacagagcagtcgggtatatacaagatcttagagcagcagaagctcatcattgtaggttaactacatgtcttagtctatttgagctgctatagcaaaatgccacaaaccgagtagcttacaagcaacagaaatttatttctcgaagttctggaggctagaacatccagggtgaaggctctggcagattcagagtctggtaaggggatacactttctggttcatggatggtgctttctcaccatgtcttctcatggtggaagcgtcaatgagattctctcaggcctttttgctgttgttgttaaagtgaaaacaagtttattaggaaagtaaagaaacaaaagaatggctattctataggcagagtagccacatgggctgcttatagttatttctcgattatatgctaaacaaagggtgggttatcacgagtttcctaggaaaagggtaggcaattccctgaactgagggttcctgttcctcccctttttaggccatacaggttaacttcctgacattgccatggcatttgtaaactgtcatggcactggcggagtgtctttcagcttgctaatgcattataattagcatataatgagcagtgaggatgactagaggtcacttccatccccatcttggtttcagtgggttttggccagcttcttttcctcaacctgtttaatcagcagggtctttgtgacctgtatcttgtgccaaactcctatctcatcctgtgactaagaatgtctaatctcctgggaatggagccaagtcggtctcatccttattttacccagctcctattcaagatggagttgctctggttcaaatgcctctgacatgttttcccctccctttttacaaggggacccttaatcctaacggttacagagggatgaagagtcaccctctgtaacttcttcaggctgaataggggctgaatattcctgtctcaggcattttttaatgtgcactaatcccactcataaaggctctgtcctcaggacctaatcacttcccaaaggccccacctcctgttaccatcaccttgggggttaggatttcaatgtatgaattttaggaggacaaacatctagcccacagcactacagttccttatcttcttgcaaagcaataaccaaatgcttgatagaacttaagaaaggaagatacccagtagctagggctatatttgttaccgaggtaggcgcacaaggagtggctaccactcaccaagggagcaacacaactgaaaccaggaaaatcgccaaatccctggggaaagcattgtgtcctaatttaattggcattgctttttctttcctagtggtatgtaatcaataactttgtagatttgatgacatatgttagtgtgaagcgttttcaatcttatttgaccacaggctcttgtttccctagaaacatctcttggaactactgttctgtagaattgaataatgataatatttaatacttacaattagccagtcagtatttacatttttcacctatattaactaaattaattctcactaccatctcatgaaataggcactattggccgggcgcagtggctcaagcctgtaatcccagcactttgggggactgaggtgggtggatcacctgaggtcgggagttcgagaccagcctgaccaacatggagaaaccccgtctctactaaaaatacaaaaaaaaattagccaggcatggtggcgcatgcctgtaatctcagctactcgggaggctgaggcaggagaattgcttgaacctgggaggcagaggttgtggtgagccgagatcgtgccgttgcactccagcctgggcaacaagacggagtgaaactccatctcaaaagacaaaaacagaaacaaatacaaacaaaaagaaataggcactattattttccccatgttgcagatgaggaaactgaggcacatggacattaagtaacttgcctaaactcacacagctagtgtagtagagcaaggattcaaacccaggcagattgtgtgttctttagcagtagggcccatagtttggaaaacgctattctagccacagactagggaggagaatgctgcaaatccgactcatagctaaaaaatgaataagtggcacaaccaccactgcttcttaaaatagcaggaatctacagggaaatataaagatttctttgctctttgtttatattgtgaatgtgttgttaccttttgtatatgccttgttcactccctccaggttgtgaacattaagaaagaaagtcactgtcagtgcgacactgaagtagtacaagtttaacctgaagaaaataccagaataagccggataaatatcagcgccaatgtaggccagatctgaatgccctgaaatgatccattaccttacaggttgctgctgcagtgaaagggaagctgttgctttttttttcccccacaaagttggcggggggggggggcacttatagaaactaaaccactttgtgccactcttcccatctttcaaattgctactctttgtgagataaatttcaatgaaccagatggacttgctgagagaggtaccaatcttctattagctcagtccctagggaagaggcaggtgacagaaggagttaggcagaaaaataaaccagagaacaaaagatggtgtcattgcttggagccgtggtgatgttcaggtgccaggggctcaagtttcccaggcagctgagctaggaggatgattttgcttactccatcttaagaggtttcaaactctgcaacatggtttctccacatgcgggttgcttctgaagatttgtttggtctccctgagatatgtctggccctgtacaagctgctagtgaaaacaacactagtacctaatggtaatttaaggaaattatactgttccggagacaaaatgctgttcagttgctatgtatctgtgccaactgggtaagaaaggaagatgattcacagccctgtccagtgggaccggtgaaatgcttcattacaccttggttccaggctgctttttggggcaaatgctttggcatttgtggattccagaaggattgtaatgattagacatagaccaaggtttaacttgaatattaactttatttttttatttaaattttaaaacctgcaccaagctgaattgggtattaacttttaggagagagaacacacaggtgttagaccagttgtataggatctttcatgttcttcacccaaggtggataaaagatatggatttaaccttaatacatgaattgtagccccaaatgaatcagatggagatggctatcttcatggcagcttgctaaatggcagctattgaaataaaaacaaaagcaaaatgactattccagggctgagagacagttaacaaatggaaagttccagtgtgctgaaataagtcatctttgtatacaatagccactccacacatatattatggtacaagccaagtggtaatacaattctgacaaggttcattacactcagtttataaattaagcttctgggcttaagcctcagagacactctttattctgggaagctgcaaactatgaggcacttgataagaaactgctagaaagaatccagctgttagccattatcatgtttcttttgagcatgctgtacatggtatgcataggtacagagagagcatccaaggagattaaaaaccatggttacattaacgcacacctatctcaggggaactgcactgactttcctctcacaatgtagggatgcttcctgcagtttctctgcttaatctggcaggctgcatttggaatctgtagtgccttgagtcactttcagcggggttggaggatagaagccactaaagcagaatagatgctggggcaagacagctaataatccacttaaatgtcagtcagggttgtgtgcgacagctgaaacatcctctcacgcaaatattttgctggatgtagaatgacatgtaggtaactaccttttcagagtcctgttaattatctttgatacaattaaaatctgaagtctttcacccatatggaaatcatctgagcttaggaaaaaaatatgtttgaataccagtgaggtggtataaaacattcattatataacaaggtttcttaattccttttcattttaaagatgcctactactgtaggcaagcataaccattttaataaatttttagtcagatttgcaaaatctccatgtggcaatcagagcagaagagctggcctctcaccgggaagagttttctgaggtaacaggccactggttttctcttctcaaactaaaagccaagaggtacaacttcctaattaggtcagaggaaaatgactgattagtccaattctacgacttgccacctcagtctggagatgggctgtagtctttccttcacacaagggaggtgatgagtgttggggcaagagcccagcatttggggctgtcgccttgagcattagggtgttggccgctcagccagacatcaagggatcatccagccccttcgcactcccttctgaggatggacaggacctggagctcaggtaggtgaaggctagctgctgttttgggggataattggctgatttcaaacagatgcaagctaatatagctctacattatttgtgaacagccagaactgttcctttgtaacaaggcaaagaaagtgcggctttcagagcacagcacatagcacttgtcccttttcgggatagggcagttagttgggtagttgccaatttacagggatacttatttcataacagactgatggttgggcccgagtgagctctcaaagcagtcctattgacctcacctaaaaatggggacagggggaccagctctttttaggtttcttctgtgattcatttagaatcagataaataaaaaatgacaaactgcatcttaaaaaaacgtgactcctggctgggcgtggtggctcacccctgtaatcccagcacttggggaggttgaggtgggcagatggcttgaggccaggagttcaagaccagtttggccaatatagtgaaactccatctctactaaaaacacaaaattagctgggcatggtggtgggcacctgtaatcccagctacttgggcatctgaggcatgagaatcatggacccaggaggcagaggctgcagtgagctgagatcgtgccactgcactccagcctgggcagcacagtgagactatctcaaaaagatttcaaaaaaaaagtgactcctacttattccttcccttcacaactcagaagtacagaaattttgtattactgaagtgagggtgaggttttggatttctcttccttgggtcttcagtgtattttttacagtataatcttcttagattgtatttttgcattccttcacatatctccatatgtgaagattactctgagtcagtgatcaatcatgggcaagttacttagcctctctgtgcctcagttttctcagttgtaaaatgaggataataatatttctactatttctaatatagaattattgtaaggattaaacaaatgaatatatgtaaagctccttggcatatagtatagtgtgtattattagtagtatttttatattttatcaatttatgagtcttttctatggattcatggcttttccaggtgtgcagtagggaagggtggggcagggacactgaactttagaaaacggattttataatctaatacacacaaaaaatgacttacattttgaaactacatggaataatatgccacaatgtgtcatcggggtcaaatgttggtttcaggtgctacagtaataggaagaatgaggtcaagtaataggaagaatgtgcatctcagggaggaagctgagattgagccgggctaaataacaagtagattgagattggtagagaagagtgaggagggaaatttaggcgagaacaaaatgcaagaagcagagaccagaaacaatgtgacgtggtcttggtgcagtagggagacagggcaggcaaagtggaaggaaataaggttgtacagagtggagccatattgcggaagttctagaaagtgctctctagctgaaggattctgcacttgatgggaatggaaactgggaatactgaacatttctgagtgaagagaagaacattgtttgggatctaaagaagatttccattattggggctgaagagctgagtccacggagactcacaaagaggctgtagccctggctgccttggtgtggggagctggggctgtactgaggcatagcagagggcgaaagaggaaagcaaaagatttaagtgacacatcaaagaaaaaattagtaagaaaattagcaagacctggccaggaacggtggctcatgcctgtaatcccagcactttgggaggctgcggtggttggatcatgaggtcaggagttcgagaccagccaggccaatgtggtgaaaccctgtctctactaaagacacaaaaaattagctgggcgtcgtggtgcacacctgtaatccaagctactcgggaggctgaggcaggagaatcgtgccattgcaccagcctgggtgacagggtgagactccatctcaaaacaacaacaacaacaacaaaaaaggaaaattagcaagatctgtctgttaactgactgaataaagaaattgaagtaaaaggcaagtcagagattattacaaatgttcaatgatgtggatctgagaaatagagacaacatgaaaaaacaggaggacaattgattaaagggagagagaaacaaatgaggagtgtggtgttgtataaattgagttggtagtgaaagtgtgatgtccaataatgataactaacctttattatttactatgtgccagacactgggtgttttacacatgtaaatgtattttatcctttattttatcctcaaggaatctgtttgagacagatactcttattatccccattttatgaagaatgagaagttaaagatgaccccaagtttatacagttaaattgggatttaaacccaagccatctgaattcagtgcttattctagaccatcactttgcttaactacctctcaggaagtccaagctctgacaggaagtcaagactgaacattacggttgagagtcatcagtgcagaggtgttcactgcagttatggggatggatgagctttctgagggaggaagcacgcagataggacagcaggtgaccaaggatgaatcccaggggaggcctacaatgagaagtcaacacagggaagggtgcagaggcccaccgagtgtgaaggagactggagaacagcccaaagccttggccttcaaaggactggtttggtgatgggtttgaagatggaagtcagggttaagaagtgaaagctcaggctgggcgtggtggctcatgcctataatcccagcactttgggaggccgaggggggcagatcacttgaagtcaggagttcaagaccagcctggccacatagagaaaccctgttttcactaaaaataaaaaaaattagccaggcatggtggcatgtgcctgtaatctcagctactcgggaggctgaggtgggagaattgcttgaacctaggaggtggaggttgccgtgagctgagttagcaccactgcactccagcctgggcaacagagtgagactccgtctcaatattaaaaaaaaaaaaaaaaaaaaaagtgaaagctctatccgtgattggagggagaagcgacaaagtttagtcagggaaatgaaggagaaagagcagaatggccaaatgaagggtttgcttgtcttccctttacctcccctgcaacacacacaaaataagagggacctatgccccaagaatatagaggaaagagggaggatgtaatgtggaaaaggaagggtgtacatgtgaaagaaaaaatcctgcaggcaccgtaaaaggagagaatcaacagcttttactctagctgtgaggggaggactactgcattgtcaatgttggaaatgagccttaaaataggtcactcgtgtggcccttgagatagatacactatattgaggaggataaacctgaatatgcaatttctccaccaatttatttatttagcaaagaaatacatgtggcatctccacttgtcatttaggcatctcaaaatcaataaatccaaaataacccttaacttctcaccttgcaactagttcctttgtttccccctccatcctccaagttgtttaggttaaaaactttggtttcatccttaacttttatatttctctcacgcgtaacatttaattaatcagcaagtcttgtctactctgctttaagatctatcaataataggatcacttcttcactgatactaccttactcttagccactggtaatatttgcctggactgggagggtctacctgctcccattcttgtcctgttgccatctattttcttcacagatgcaagggtaagttttttaacaatgtgaattgtattgtgacactatgatgttcagaactttgcaatggatttccgtgtctcggaataaaatccaaagttctagccacagcctccaaggtcatcacctacaattacccccaaagcttcctctgctccagccacattaactttcttgttcttgtctcagggtttttgcatatgctgttccttatgcaacagcatatggaacagattcatttattcaacaaatgtttgttgagtaccaagtatgctgcaggtcgttgggatatgtcagtaaacaaggtggacaaagaaccttgcccttgctgggcttacattcctagcatacttgcatctctcaccctctttgctcagatgtcacttatcagagaggtctttaactgtacgctttcaaacagtgatccctcccccacaccccctcatcacatattcctttatgcaggtttattttacttaataatttctatcaccatctgacacatgatataattctttctttcttacctgtctccctccagtagaatgcaagctccatagcagggactttcctgttttagtgtctgccatagttctagaactgcatctagcacataaaaggtgcattcacatatttacagaatgaattaatgcatgtgcagggtgggcacttttaatttggaaactcatgtcagcaattctgggaagatttcttgcattgtttcttcagtaattttcttctctacattttttttctggttttctctttttttaaacagaggtgttacgatgtcatattctgggtcttcctgatgactgttgacttttattgtcttttaattgattgtttctttttgttctagtttccaagagatttcctcagctttattttctaactcttatacaccatttaaaaattctcctataatgtttttagtttctaagagtccttttatgttctctcattgtttctattacattgttatgatcattttatttacaagctggactgaataggggaaagactttattatttcccatttctccctgctaaatcccattcctggatgcaatctcatctaggttccaaatttcttcagttactcctagttaggaaataaaaaaatcctttggttacttttagtcacaagaacagcctccttttcatgatttttaaagtttctcatgagcataaaactctgatctggttcccttttcccttcttcctgtcttcctaccttcccaaccatgtgcctggttagggcttggatatccgtgtttggagagatgcgtaattgacatttctacttctctgcttctccttctactactctctgctttctagatgctatttctgacgttttcagagctaggctcagaagaacagaggattaatgaaaaaaggccttttgtggcttgtgcagtttgtaatccgatgatttcctctgaggtggcaggtgcacaattgctggctctttcccttgagggatgtgtttggaggcctgcccagtgaggacctctgactgcagctccctttttgtgggcagggctgcacttcagggaccacattgatctcactctcaacacctgaacttctggcaatccacagttgggtcacatttccccttcagggaatactgttaggtaggattgaacatgactccaggttggtcctctccatctgtctagcttggcccatgagagttcatacattcttgccctgttatgcatattgttcctaatgcaccctcctctcttcattctgctgttaaaccaactccagctgcaaactttccccattgcatttcccccaattagataatagccactccatctcacaaagtctagggagcacataggaagttctccaaatagtccccttaaagctttttacattcaatttgaagtttaagaatgcataccctttcctccctccaaaagtacattcagggaagcattgtgtagggcacagtacttggaagagactggagaattgaggactgtagatattaatttttctttgaccagaggaggaaaaaggactttctaataatgcagccctgtaagctgcctaacagttcacctgctactgagggcagcagaaatgtcccagctctggccccagagtaggaatgcatccctgacatgttgctttactcccaagatctatatctcttatccacaatgttctaggatagtcaaaatatatgcctctggtagtcacagagacagggacataatattagaagaaatattgtgacaattaatagtacttatacagattttgaaggactgttagagaagagttgttaaggtaggatcatgagcatcagaccgacctgggtttgacttttagctctgtcactgattagcatgtgacttcaggcaagttattaaacatctcagaattttatctgccaaaaaatattaacagtaacacctacatcctacatagtagagttgtccgtatgccagacagcctgttggtcactccacaccatcagtgccatgcctgtccaaggctgggaactacctttcccagaatctccattcttatataattctgggttggaagtagtcaatgagactttgagtttgcgacttgtgcaagacttggtaggcagaagtgataggagaccattgttctcagggtaaatcttgctgaggtttatcagacagggtcaccagatgtgggagtccatagtcctttctatgagctctcactctgtagtgatggcaggattctcagtcttcacccatcagctccctatccatactccaggctttaggctgaagtcatcagcaacttttttttccagtctttgggctgtgactgtctcgactttcactactttaccttctctcacatctgggcaagcttgcatttctatatgaagccccttattcctgtacaacctatagtggctctgatttcccgactgaaacattatggtacagcatggacaacctaaagacatgtagcaaggacttaatcaattgtagccaatactaataataatcagaaaaagtattgtttagaataatttgagactaagagatgactgaagtgaaactatgtgagttccattgtttaggaacagcaaagatgaggaaggatacaaaaggagacattctttatagcctaatgacaagaactgctcccatttctgtaacacttttcaattcacaaagtgtttgcacatcggctgtccctatagttgcagagtttagctttccaatcaatgaactgatcacatgctttatggcatgtacggttgttactgtgctgcatggtaattaggcataagtggtagtagctggtttataaatgactgcaattggaattaattttagggagccaatttttttttgggtcacaaatacggacaatttccctttatatggtgttttatagtctcatagataaaaagacaagtctgcatagctcctcaaatccagttccttttttcttgctctcttctagggctggggtttctctatacccaattcccatccttcctttggctatggacgtcataagcagatgtcctgttggttcctggatctggctttcctcattgtttcaatggcaccaacgttaccagaatgtctggaagcacaggactgtggatgatccgccccaggagcaaaacataaccactttgccacaaagcaaggaaggggagaccagtctagggaagggaaaggaggagatgcagatccagtgttttgtctctgagagttttgaaccagaagtaggctggaaagcttatgaaaaagataaaggattctttttaggattctggcagtaggaggagtcagttctttgctaaggcaggaaccggacaggatgtggcaatgttccatctgggactctacactgtggcaaaaggaactcatgctgacaggtactcttcttcactcctgaaggtttgaagactaagagtctaacagctgcattgaaactagctcccaataggaccagagtttttttgtgtgtgtaagccttcaagtatgtgctgcttgtgaggtacactgactgcttaaacagtaacgtgctttcagtgatgcactgtccatattccacttcaaagaaggatgtgttgctgctcctactcggagtgctttctgctgtcagcccctttagaggttacctccacggcagacagccaccttttccaaggttacagccttcctaaggaggctcattttggcccaaggcaggacacctctgacaaatcattttagttcatgatttctcatggggttggctgaggctgtcaggcctgccttgcagcttcacttcttcttctacccagttctactctgttgccctcccttccacaggtgttgatctcaggaacactcactaatagacattcagcacgttaaacttcatctccgagtctgctttccagagaaccccatctgcaacagactactctccataacttcaatatttgttaatatttctattttacagttgtcccctctgccattctctttgacctcactggtttatacctgttatacctgttttattcatttactatcatttcatgaagttttttctttctttttgagacggtgtctcgctctgtcgcccaggctggagtgcagtggcatgatctcggcccactgcaggctctgccccccggattcacgccattctcctgcctcagcctcccaagtagctgggactacaggcgcccgcgacctcgcctggctaatttttttgtatttttagcagagacagggtttcgccgtgttagccaggatggtctcgatctcctgacctcgtgatccgcccacctcggcctcccaaagtgctgggattacaggcatgagccaccgcgcctggcccatttcatgaagttttaagaggaaattgagatgaatgcatgtgtttgccctggcattcagttactgtcattttacagagttttaagagggacatcaagcatgcacacatatgtctgaactggcattgtatcggtcagagttaaatttcagataatataatttattctagcttttcaaaacagaaagggtattttcagggtattcagtagtgaggaagactagtattgcaatactagtctaccagttcttcattcttcctttacaacgaacgtgactctgccactccttccgtgaaggggttgagtctatttccctagcccttgaatctgggatggccttttaatctgctttggctaacaaaatatggtagaggtgatggtatgctgtttcgaagccaagtcctcaagaggcttcacatactttggaatcctccgtactttggattccttttggaatctttccttttccatgaaaacaatccaggctatcctgctagaagatgagagcccaagtggaacgatgaggagttgtcctagctgaagccatctgagaccagccaatttctagctaacccatcagctggccacaaatccacaagcaggcttagtgggattagctaagctcaacctacatcagcagaactggccaactgacccagagattcataagcaataataaatggttattattttaagttgctgcatttgagagtgtttgttatgcagcattattgtggcaaccgacgattgatacaagtggcttaaagaatcattatgagagctgaagaagtagactctagggccacatcacagaacagactcactaaaggagcctacagtcaggaagtcgtggaaccaagaatctgcctgctaagttgagacacctttgctacaagctccgacttcacctctgctatgaccaggaagctgctggtagagctgccaactccagaactacgctgctgttgctgctactgtcatgatttacagcaatgcaaacctgtgctctgcttttttcccatctaactcagtttatgcaagtgcttctgatcagcagaatgtaaattatacccacacttcagttgcaaaggggtctaaggtcaaaggggtttttagttttccagcttctgcagtaggagaaggaggttggcatgaatttggaatgagtcagtctcagcatcaccacagcatgattaactaaaatacatacgattcctgaaacttattccatagatagtgctcaatgatactaaaacaacatatttatatattcagtgttttacatttggacatatcatgctacactgtcaaccatcattcattcaattaatagaagttgagaggttgaaggatgaattgaataacacgatactaagattttatactaattgctccagcaaaatacatgtaaaaatctttttttttttttgagatggagtctcgctctgttgcccaggctggagtgcagtggtgcgatctcagctcactgcaatctccacctcccgggtttaagcaattctcctgcctcagcctcctgagtagctgggattatgggtgtgcgccaccacacccggaaaatttttgtatttttagtagagacggggtttcatcttgttggccaggctggtctcgaactcctgaccttgtgatccgcctgctttggcctcccaaagtgctgggatgacaggcatgagccaccgtgccaggccttaagagataaaaatctcttaagggagtcaacaattataagccacaaaggagaggaaactgactttatgttctgaaaaatttttggtcccttattgatacttcagataccattatcagtagaaagactggcgatttcagaaagaataatagtagcaatctggacttaatctgcagttattttatttatttatttatttattcgagatggagtctcgctctgtcacccaggctggagtacagtggtgcaatctcggcacactgcaatctctgcctcctgggttcaagcggttcttctgcctcagcctcccgagtagctgaaacttacaggcgtgtgccaccatgcccggctaatttttgtatttttagtacagaaggggtttcaccaaattggccaggctggtctcaaactcctgacctcatgatccgcccgcctcagcctcccaaagtgctgggattacaggtgcatgtacattacccgtgataaaagaaatatttcaaaatttattttggcataaaggtagagatttacaagattcttagaaaggctgatctgaccttaagacacagaatccgatttgatgagatgagagaattcatgctttcaaatcagcaattagcaattctggaaaatatctgcgtccctgtgaggacttttcaaagagatggtgatttaggacaataaataatcaatgaagaaaaggaaagggaattcttagaacagaatcatacagtgaaggtattaaaatgaaagaaattttgtgccccaaatgtattccctggaccttgtgcagctgcagtacaacattattattatggtatgtgaggcttgccagtggtttatgccttactgagaattactttactcagccgtggccttgtatggtgaggagtcctttcggctcaccaaaaagagagaaaaaaaaaaagtcctgttgtcaagagaacctggagtccctccaaaaggtgccccactgattcaaaagccagacactcccttgtcaacaaaggcatctcacggctaaaagtctggagggcaaattgcacttggctcattgctaagtcttaatcatagaacctatttattcgattcttactgacattaatgtgaagtatcagcaattttgcttctcagacagaatccatggatttaattgtcattttttttagttgtgcaatcagaaattcattcataggaggaaaaatcagctaatacctatggaaaaatgcaaaagaaagcggttgtcagactgattgctttttggcaaaggctgagctcaagatttaccaatgaaagcccaattaaatgtgacctgagagaatgttaacagagctaaagagcattactaagcccaaagactggcatttcagttaccttgtaaggtatttcagagaaaattacatatatgtaaacacaaggctgtgtatcactatattgataaaatagtagtttctaaaacagctttactgatttccgaagcaacaagaaaaaaaaagacaacagaaagcaagtaattcacctttttgggaaccgatcttcagcaatgttagttgaaacttctcaaggaacatctggcttggattcagctacccagggcagaacaaaaaaagtgaaaggtctctagatcaggtgtttcccaggatggaatttaaattcagctcctttatcctgcctgctctttaatagtctatcttagatcaaactttctggctccaggtttaaaagcatctttagaataccaaggtgctcacatttagcccctttctcactttctcctttctttttattttctgtgttctttgtgtacttattgatcccccattagaagattataattatatttgaagacaggggctatgtcttattcatctttgtacctcccttcttcaaccctcgtctgatgtgtttgctcatatacacttttcttttgttaaataaaaataaatatagttagaggcaaatacaaattcttcactgtttcaactgctactgagaaaatgataggagattattaatttgtgaagtggtcaacttccttttttaatagaatgagtagtagatgagaatattttatatttcaagtgcaaataaaatttgcctcaaaggattttgatatgtttttgtctctaaaaggagcaacagccttatcgtgaggtatatgtcaagataaatctagaaagggccaatggagttattttatttaaggaaaatagcctcagtggtaactatcaataacttaaagtttccatatcttaccagtaaactgaataaaatgctcttttctttatagctgccgctaatggagttggactcatgagtgagggagaaagtgcctgtgaatgacatcattatgcgacatcataggacagttttttttttcttttattcactcgtctttcttttatttcaactgatggtataccataaacagtcttctaagccttgcttcttttctttgagagtcttctatgttagctcataaagaggtgcttcttgcttgttaggggttgtatggaagtgtgcaagttaataagctgttgcatgtcagttccagtctcacccttcagactgtgcaaatcacatggccagctccctgttatgtttgccaagaaaggaagctagggaaagactgggatgctctgttttgtttgctgttcctccccgcagcacctgaacagtgatcttctaccccacagtggcagttcattgcagtctccagcttgtctcttttccagacgttcccagagagtctcattttgtcccctcagaggcaccccaccagtggggcagtggccctttctcagcggtctgaccaactccaggaggcctctcctacaaacctccgcattctagtaacctcaacattttccttttgttctctcagccttacagtatgagctgcttcctggagttcctcttctttatccttttggctttaagttcttcaatagctaatgaaccaatagcttatattaagttctctttgttgaaatgccttgtgtagggtctgttttcctagctggacctaacatatccatgcaggatcagaaggcccaaaggagcagaacaacctgcgctactctttgaatttggatgaaccgtaatgtatttgactagttctctctaaatggacatttaggtagttttcaaccttttgtaactagaaacagtacattaaacaactttaaatgaatattttttttcacatatgtgtgagtctatctgtaagataaatttatagaagaggaactcctggatcaaattgccaaaatgcccttcatataggttgtgcaaattcagtctctcacgagcaatagacagaaatctattcctatgagaaatagagaaatcaacaaagggaagagtgagccaggtgtgataccactgtcccagtaagagggccttagctagtggaagagagaagcatagcatgagatctgtcacttgaggaattactttttggcttagactccacggacttcattttgagccctttggcgatgagaaaggctaaaacacaaatgaaaagaaggctctctaagacatagtgttactcacttcaaagagggtaacgcaaaaaggagaggtgctttgccatagattaccaccaatgccaggcagtttgaggagtggctgtacccagttgctgtgcccagtgaagactcagtaccaagctaaagtggctgtgatagccagcagcaagagtgacacctacagatgcatggctattggaacaaggggcagtgctgcccggcatacgctatgtggttgctgcgagcacatgtgaaatacctcctagggactccccaaaacatgggtggagctttgtagggtactgggtactgtttcctgcagtagcagagaagataagagctggtaaaacacaggctacaaaactcatttactaaggtagtcacttttttttttcccattcctatatctttgcctcttaaacttgggtaggcttttgtttaacaatagcaaagtaaaatcttcttccttaagtctttatgatacttctctagcaagcctgggatgtgactgagttatttttacaatctgctgtttggttttcctgtcatttactccctgctcagcagagctcttctgcagtgatcattgcgcttgtttagcaggcaggctacattctacacacttgcttttgctgatctcaccttagcattttgtggtaacaaagctgtgtgcacaaccaaagttgtgcctttcttactctgtaagatgggctgccttcctgcagatgacttttgttctatgttccactgtgtcttgtttgtgccattcttaatttacacgacagagatgctgtcatcaccaattaacattaatcaagggccccctggatgcatggctgcattgggactaatttaatatgctctttgttccagatatcaggtggcttcttcaaatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcacattacaccattattgaataaataatgaataaataaataaataaagatgtatgtccttcccaagtatatcagagaactatctggacaatttctttctttcccaattctcagaatcagcagtattctgtcaagaaacatttatcgacgatgatggcaatagtcgattaaaatcagatgaagttttatttttaaaaaaaggttgagcggagagacaaggctgaaggtttggaagttgagacaaccatcttcaataaacgttttctcatctaagggctgtatgtacatcattttggggaaggtagagattgaaggaggaagaacatcactggaggaagagacagcagtttgtctttcgagtttcaataaagtttcaaaaatcttg
